United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 9

SEQ ID NO: 41262 - DNA, 281 bp, Glycine max
  Peptide Sequence Number=SeqID_132947
atggccgccacactcactcttctaaagcttccaatccttcctaacaagccattactgccacgcccatcaacctcaaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 41263 - DNA, 848 bp, Glycine max
  Peptide Sequence Number=SeqID_132948
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41264 - DNA, 351 bp, Glycine max
  Peptide Sequence Number=SeqID_132949
atggtgaaagttggaacctcttacgtgccgatcaacgtctcattttcgccaaaagttggcccagggcttcccggtatcaacagggacaccaggatttatttattctgcgaagtgatcttccgtcacagggcgaattggagctccaccgcggtggcggccgctctagaactagtggatcccccgggctgcaggaattcgatcctcatctacggcgctggtggcgcggaccaactgtggggtggcgcgggcaacgacacgtttgtgttcggtgccagttccgactccaagatcaagcttatcgataccgtcgacctcgagggggggcccggtaccagcttttgttccctttag

SEQ ID NO: 41265 - DNA, 237 bp, Glycine max
  Peptide Sequence Number=SeqID_132950
atgacggagcattccatcgcagtttctcccatgtgcatgtcatgtaaggtcttttgcgtcgtctccattagcaaacaaatgcttaaaccttggaatgatgggattgatgtaagctccattggagcttgtaggcctaggatcttcttcatcaatggattcctttgcttcctggaagatgaatggcagtggaatggagaaggaagagagagaggagacgagacttcaaggagaagatga

SEQ ID NO: 41266 - DNA, 540 bp, Glycine max
  Peptide Sequence Number=SeqID_132951
atgtcgaagcatctcattcgacatccctccaaacacaatgtcatcaacatatatctgtgcaatcatcaagttttcagcatcttgtttgacaaagagagtcttgtcaatttctcccttcctatacccttgctgagtaaggaactctgtcagcctttcataccaagctcttggagcttgcttcaatccatagagagccttcttgagcctgtatacatgatctggatgagttgggtctacaaatccccttggctgctccacatagacttcttcattcaggtatccattcagaaatgcgctcttcacatccatctggtacagcttgaatttgaggatgcaagctacaccaatctcatcaaagtctacaccttcaatctgagtgtagccttgagcaaccagtctggccttgtttctggttatgacaccttcttcatcggttttgttcttgaagatccacttggtgccatcacattagttccctcgggtctaggaactagctcccaaacttcattccttttgaatgctccaattcttcttgcatag

SEQ ID NO: 41267 - DNA, 276 bp, Glycine max
  Peptide Sequence Number=SeqID_132952
atggaggggggaaatcctgggttttcacttaaggcttgtaatgagcttcaaaacaaagaaagggggaacataggctcaaaggggcaatcaaaggaattaattcaagggaggctcatttggctagaggcttataaaaataaaatgcctaaatcatctcccaacatgcatatgaagcaagaagtatcaacaagagttaagccaaggctattgtgcaagcaatcaatggagcaaaacacaccgaataaaatagatgatgatggctcaaattctcactag

SEQ ID NO: 41268 - DNA, 713 bp, Glycine max
  Peptide Sequence Number=SeqID_132953
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggagacaatgtatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41269 - DNA, 519 bp, Glycine max
  Peptide Sequence Number=SeqID_132954
atgccatatgtggaagccgcggaagagtcattagaaacagccttccagtcttttgaggtggtaagcattgcctctgtagattccttctctgggcaaccttgcctgtccgatacggcagtaatggtggcccgagtgatgttggggaatggttacgagcccggaatgggtttaggcaaggacaacgacggcagaaccagcatgataagtgccagaggaaaccgtgtgaagtttgggttaggctataaacccacacaaatggacataaggaaaagcgttgcaggaaggaagagcggaagtcaaggctcacgattgggacaagaagtcaaaggaggcccgccctaccacatcagtaggagctttataagcacgggtctaggacacgaaggccaagtcgttgcgatatgcgaagatgattcgccgagtgggtcggatttggtacgaccatgccctcctggtttccgactaggaaattggcgagtggaggagcgcccgaacatttacgcaaccagcataatgtaa

SEQ ID NO: 41270 - DNA, 486 bp, Glycine max
  Peptide Sequence Number=SeqID_132955
atggtcccgaggaagcttgcctcaaagaggtccaggaaggacaaggcggccgaaggaactagttccgctccggagtatgacagtcaccgctttaggagcgctgtacaccagcagcacttcgaggccatcaagggatgggacgacgagtatactgatttccaggaggaaatagggcgccggcggtggacatcactggttactcccatggccaagttcgatccagaaatagtccttgagttttatgccaatgcttggatcccgttgatgccgatgctatcggccagctcctgggatatccgttggtgttggaagagggccaggagtgcgagtatggccagaggaggaaccggtctgacgggttcgatgaggaggccatcgcccagctgctatgtactaccggggcaggattttgcccggactgctgctggggaggcgagtgcgaattatgcgcaccaacatgaccaccctgactcagatatgggatga

SEQ ID NO: 41271 - DNA, 892 bp, Glycine max
  Peptide Sequence Number=SeqID_132956
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacactcgactcgccgacagcgctcgtggtgcgacagggtccgggcacgacggggctctcaccctctctggcgccccttccagaggacttgggcccggtccgccactgaggacgcttctccagactacaattcggacgccgagggcgaccgattttcatggtgggcttttcccggtctcgttgggagccgtgcgtgcacgcaaagggtcgtcgatgggtccagaactgaccggctcgcacgtgattggtctcgagccatacacccccgcgcagcaacattgttacatgtttgcgttggggaaacgatgtgtgacacccaggcaggcgtgccctcggcctaatggcttcgggcgcaaacttgcgttcaaagactcgatggttcacgggattctgcaattcacaccaa

SEQ ID NO: 41272 - DNA, 252 bp, Glycine max
  Peptide Sequence Number=SeqID_132957
tttcctgatgaatctctgagtgaagcattggagagattcaaaggcttgttaagaagaactcccactcatgggtttttcaagccaatccaattgaatatgtttatagatgggctgagaccacaaaccaagcaactattagatgcttctgcagggggaaagataaaactgaaaacccttgaagaagcaactgagctaattgtgatcatgccattctacgagacagaacccaccaacccacgaagaaaagcttga

SEQ ID NO: 41273 - DNA, 208 bp, Glycine max
  Peptide Sequence Number=SeqID_132958
gaaatggctccgaaaaagctttccgcaaagtgatctaggagggatgccgcgactgaagggaccagtaccactctcgagtttgatagccatcgtttcaggagcgccgagcatcagcagcatttcgaggccatcaaaggatggtcgttccactgagagagacgcgtccagctcagggacgatgagtacaccgactttcaggaagagatag

SEQ ID NO: 41274 - DNA, 318 bp, Glycine max
  Peptide Sequence Number=SeqID_132959
atgtcattcttgatcctaaataccttcaaggtccctctctctaatgaaccatttgtccaaattaagcattcctttgcaatagaagccgatgtagctacttcttttggttataagaaagatcttgatggacaatgggttcgcaaacaggatcaccaggctaatgttccttatgaacgctttccatctccaccacctagggatccctcctcagctttactgaataatgttctcaacgagattcgagatcttcgtgcttttgttggaaaaaggtttgattccatggattcttgcatcactcatcttgaggatgacatgtga

SEQ ID NO: 41275 - DNA, 868 bp, Glycine max
  Peptide Sequence Number=SeqID_132960
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcccaacgatgagcttgtatggggtaaatttgaagacaagttttggccccgtgaagtgctgattgtgaagcgggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 41276 - DNA, 803 bp, Glycine max
  Peptide Sequence Number=SeqID_132961
gaggactacacatcctcgcctttagaggactacacgtcctcgcctttagagggctacacgccctcgccatcagaggactacgcgtcctcgccttcagagggctacgcgccctcgcctccgtagggctacacgccctcaccttcagaggactacgcgtcctcgcctttagagtgctacacaccctcaacatcagaggactacacgtcctcaccttcagagggctacacgtcgtcgccttcagagtactatacgtcctcacctttggagggctgcacgccctcgctgttagaggactacatgtcctcgcctttagaggactgcatgtcctcaccttcgaaggactacacgtcctcacctttagagggctacacgccctcgctttcagaggactacacgtcctcgcctttggaggacaacacttcctcgcctttagagggtggcacgcccttgcctttagaggactacacgtcctcgcctttagagggctgcacatccttacccttggagggatacacgtcgtcgccttcagaggactacacatcctcacctttggagggctgcacgccctcgctgttagaggactacacgtcctcgccttcagaggactgcacgtcctcaccttcagagggctacacggcctcgccttcagtggactgcacgtcctcgccttcagagcactgcacgtcctcaccttcagagggctacacgtcctcgccttcagaggacaacacgtcctcgtctttggaggacaacacttcctcgcatttagagggccgcatgccctcgcctttagaggactacac

SEQ ID NO: 41277 - DNA, 393 bp, Glycine max
  Peptide Sequence Number=SeqID_132962
atggccccaaggaagcttgtctcaaagagatccaggaaagacaaagcggctgaaggaaccagttccgctcccgaatatgacagccattgttttaggagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 41278 - DNA, 300 bp, Glycine max
  Peptide Sequence Number=SeqID_132963
atgacttgtgacttgcatgagatgcttaatctgctaattgattatgagaatcaaatttcttctgagaagaagaaaggaactgtcatggtagttggcaagagctccagggaaaaaggaaaagtaccaaaactgaagcatcttggacctaagggtggtatggcccaacccaagaacaaaatgaacaagattgaccaaactgatgctgaatgtttcttctgtaaggagaaaggtcactggaagagaaattgcaagtatcttgattctttgaaaaacaagaaacaagggactacagataactag

SEQ ID NO: 41279 - DNA, 444 bp, Glycine max
  Peptide Sequence Number=SeqID_132964
atgagaggagcaccactagaggaagagctcgcacctattattgcacggggtttcaataataccaacgtggaggcgcttcagaaggtccgcaaggcatgggagatggtgcaaaagaaggacaaggaactcagaggcagtaacaacgggcccatcggcggctaccgtaagtggttgaaagcccacatgcaaggtttggattggctcctgagtttgagaaccactaaaggggtggaagttgaagcaccggaggaagacaaagaggtgcaggcccttagggcagaactcgagcaagcccaaacagtcaaagaaaggttcaaatcaacatctcttaagatccgaaagcagaatgccgaactgagagacgtaaatatagctaccaccaaggccttggaacaagcgaccaaaagggctcgtagggaagaacatggccggaacaaattctga

SEQ ID NO: 41280 - DNA, 476 bp, Glycine max
  Peptide Sequence Number=SeqID_132965
tgcctcctgagcctctggttggtcctggttcctccggtcctcgagtgagcacaaaggggagttgtgttgatccctcaggaaatgatcctgagaagggtgactctgacaggtgcggcttatacatagaagcagatcctgcccacctggttgccatggggagagtttatgagggattcactgttgttcataacactcctttgttgcctggccaagtgaaggtgagtgtggaggaggttacagatgcagatgctccagttcctgtacccactgatgaggtttccttagtggggcaggcacttcacatcttccttgcttggccgacacatctggtcaagtctttatcacaacaggtacttattgtccttactatatctgtgtctccggcaaaaccacctccaaagcccgatccgaaggtcgatgattcactttatctgatgacattgaccatcccagagcttttcttgaggccttatcag

SEQ ID NO: 41281 - DNA, 465 bp, Glycine max
  Peptide Sequence Number=SeqID_132966
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagagcgtcctcagtggcggaccgggccaagtcccctggaaggggcgccagagagggtgagagccccgtcgtgcccggacctgtcgcaccacgaggcgctgtcggcgagtcgggttgtttgggaatgcagccccaatcgggcgggaagcggatgggggccggcgatgtgtcccggtcggatgtggaacggtgagagccggtccgccgatcgactcgggacattgaccgacgcggattgcgatggtggcccaagcccgggctgttga

SEQ ID NO: 41282 - DNA, 498 bp, Glycine max
  Peptide Sequence Number=SeqID_132967
atgttgctgatagtgaggaggaaaaaggaagttgacagtgatgagtgcaatataggagaatgtggtttagatgacttagattttaaatctgccttgagggagttgcatattgatggagaacatgggagttcaagtggaagaagaatgaataaattcagagggctagatgcaattttaatgcaagcaaattttgtgattgggaaatctactgttgagaatgaagttagaaactcttttaagataaagacatttaagcataaccataattgctgtagagaagtgaattcaacaaacaagcaaatagacagtgggtggtcagtaaacttgagggcaaactcagaatgcagccaacccttaaatgtgttgaagctttggaatatttcaagcaagagtttggagtgcacattgaagttacaaagatgtggagagctagaaagaagcaaagcaactagtggtgatagggaatgggacagaggaaacaatgatgcgacaaagtag

SEQ ID NO: 41283 - DNA, 162 bp, Glycine max
  Peptide Sequence Number=SeqID_132968
atgaatcggccaacgctcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 41284 - DNA, 242 bp, Glycine max
  Peptide Sequence Number=SeqID_132969
ggttgaaccaagctcatgcttttacgaaaaggttcatcaagtcaagttgaaatatggaagtaaccatcttgcaaaaattggggcaaaagatggatcactgcttcgtctactgctgtcgcaacgtgcccttcacgggcgagcgagggcgaggctcacaggtgcgctttacaaaggaggaaagatgcgcggagtcgccaccaacgtttatttgtggaaaacattgggaaaaccgaaggaaaccg

SEQ ID NO: 41285 - DNA, 411 bp, Glycine max
  Peptide Sequence Number=SeqID_132970
atggatgatgaagagggcatgcaggaacagatgaaggccgatctatcggccttaaaagatcaaatggcttccatctcggaggtcatgttaaaactccagaaaaccatagaggataaagccaccgcaaccgcctccagtacagttagggaagcggagccggtgctgcagcccgccttgaatccgggcctagacagaaacatggccgtgttcggtcgaaggtatagtccgcaagcttatccttatggcctgcctccgaacttcaccccccgtgccactccggaagatttaagccaagcccctacttttgaagggcaactcccaccttatgaagactatcccggacaagacgatggggaaaggagatacccatcttggccccctgctccacctcaaagatccgtccccacatga

SEQ ID NO: 41286 - DNA, 699 bp, Glycine max
  Peptide Sequence Number=SeqID_132971
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgaacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 41287 - DNA, 297 bp, Glycine max
  Peptide Sequence Number=SeqID_132972
atgatgacattcaagaatgaattcaagaatgagttcaagattgagtcaagaacacttcaaggatcaagaggaaagaatcaagaatcaagattcaagattcaagattcaagaataatcaagatcaagattcaagactcaaagattcaagaatcaagagaagacttaatcaagataagtattaaaaagtttttcaaacaattgagtagcacaagaagttttcacaaaatcattaccaaagagttttactctctgataatcgattaccagattatagtaatcgattaccagtggttttaa

SEQ ID NO: 41288 - DNA, 839 bp, Glycine max
  Peptide Sequence Number=SeqID_132973
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggctttgcttgttatgagggtaaacaggtcctatcacagaaatttcccaggacataccttgaagccactgcgcacttgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41289 - DNA, 492 bp, Glycine max
  Peptide Sequence Number=SeqID_132974
atggggtcaaaccaagtgccctcttttaaaaaagggttttatcatgtcaaagtcaagagcctagaactagccagcttgcgaaagctaaggccgcggatggatcaagttcaatgtcaagccttccataaggcatatggaaaaatttgggatttggccatgatagaagtttctgttgaagccattgcatccctcactcaatactataaccagtcactcagatgcttcacatttggggactttcagttggtgccaaccatagaagagtttgaagggatcttgggatgcccgctaggaagaaggcagcagtatctgttttccggattctacccctccatggcaagagtagcaaaaatggtcaagatctcgacacaagagttagaccgagtgaagcaaaataggaatagggtggtggggatacgaaggagggcttggaggaaagggtcgaagctttggcagatcaaggagagcgaacttcattcattgatatattag

SEQ ID NO: 41290 - DNA, 558 bp, Glycine max
  Peptide Sequence Number=SeqID_132975
atgaagcacttcactgacaccctcatcagtgccaacataggccaaccacaacagtgggttaacccctttctccaacaggaggaacgacaacagacagtggcacaatcccaccagcaagtcctacttgcttcactaggggcctccaagcgaagtcacccattatacctacaaaaggtagacaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41291 - DNA, 731 bp, Glycine max
  Peptide Sequence Number=SeqID_132976
ggaggactacacgtcctcccctccagaggactacatgtcgtcgccttagagaactacacatcctcgccttcatagggctacacgccctcaccttcagcggactagacgtcctcgccttcagagggctacacgccctcaccttcagagggctgcatgccctcgccttcagaggactacacgtcctcaccttcagagggctacacgccctcgccttcagaggactacacgtcctcgccatcaaagggctacaggccctcaccttcagaggactacacattctcacctttagaggactgcacggactacacgtcatcgtcgttagaggactgcacgtcctcgccttcagagggctgcacaccctcgccttcagagggttgcacaccctcaccttcagaggattacacgtcctcgccatcagagggctgcacgccctcacctttaaaggactacacgtcctcatcttcagagggctacacgctctcaccttcagaggactacacgtcctcgccatcagagggctgcacgccctcaccttcagaggactacacgtcctcaccttcagaggactacacgtcctcgccatcagagggctacacgccctcaccttcagaggactacacgtcctcaccttcagaggactacacgtccttgcctttagagggctacgcgtcctcattttcagtgggctctattgccacaccttaagagaatttaaggtcctctgcccttaa

SEQ ID NO: 41292 - DNA, 450 bp, Glycine max
  Peptide Sequence Number=SeqID_132977
atggtggtgacggttaaaaagctcgtagttggaccttgggttgggtcgatcggtccgcctccggtgtgcaccggtcggctcgtcccttctgccggcgatgcgctcctgtccttaactggccgggtcgtgcctccgcatgggataacaccacaggattctgatcctattgtgttggccttcgggatcggagtaatgattaacagggacagtcgggggcattcgtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 41293 - DNA, 436 bp, Glycine max
  Peptide Sequence Number=SeqID_132978
gaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgataggaaaccaccgggagccgtagcgaaagcgagtcttcacagggcaattgtcactgcttatggacccgaacctgggggatctatccatgaccaggatgaagcttgggtgaaactaagtgggaggtccgaaccgactgatgttgaagaatcagcggatgaggttgtggttagggg

SEQ ID NO: 41294 - DNA, 574 bp, Glycine max
  Peptide Sequence Number=SeqID_132979
gcacccctctctttcaagaggattcgcggcatgtcaagccctggcgggatacttaacgcgttagctacagcattgcacgggtcgatacgcacagcgcctagtatcccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctattgatcatcgccttggtaagctattgcctcaccaactagctaatcagacgcgagcccctcctcgggcggattcctccttttgctcctcagcctacggggtattagcagccgtttccagctgttgttcccctcccaagg

SEQ ID NO: 41295 - DNA, 633 bp, Glycine max
  Peptide Sequence Number=SeqID_132980
atgatcgaccctctcaatgagtcgatctcttgctttctcataaaagtggacccttgggtactagtacctatcacctttagaggactacatgtcctcgcctccaaagggttgtacgccttctccatcagagggctacacatcttcactttcagaggactatacgtcctccccttgagaggactacacgtcctcgccttcgaagggctacatgcccttaccttcagaggactatacgtcctccccttgagaggactacacgtcctcgccttcggagggctacatgcccttatcttcagaggactaaacgtcctccctttcagagggctacatgccctcgcctttagaggactacgtgtcctcacctttaaagggctgtacgccttcgccattagagggctacacggcctcaccttcaaaggactgcacgtcctcaccttcagagggctacattgcctcaccttcagaggactgcacgtcctcaccttcagagggctgcacgccctcgccttcaaagggcgacacatcctaaacttcagagggctgcatgccctcgcctttaaagggctatgtgtcatcactttcgatgggctccatatccacatcttaagagaatttaaggtcctctgcccttaa

SEQ ID NO: 41296 - DNA, 443 bp, Glycine max
  Peptide Sequence Number=SeqID_132981
atggtgaaagttggaacctcttacgtgccgatcaacgtctcattttcgccaaaagttggcccagggcttcccggtatcaacagggacaccaggagtttatttatgatttggtgggacgagtgtttcgagcgtcaacagagtatttcaacttcaagcttatcgcaataccctgtccctcctgttcagctactgaaatggtgttatccgctcacaattccacacaagcataccagccggaacatcagcgcaagtgtagcctggggctgcgccgctttcgccattcagggaaacctgcggcaactgcttaatgaggcaacgccggggatgaggcgggcctttgctattacgccagctggcgctaaagggcggatgtgtatacggcttactatgttggggcgaattgctgagctcgctaccgtcggtgatgcggcacgctctagaaa

SEQ ID NO: 41297 - DNA, 351 bp, Glycine max
  Peptide Sequence Number=SeqID_132982
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagaattggttcaagcttccccagccccttctcatcaatggactcctgacgtatacgaaggagtgcggttcgttcgataa

SEQ ID NO: 41298 - DNA, 444 bp, Glycine max
  Peptide Sequence Number=SeqID_132983
atggtaggcaaagatttgggaagtacggatgaccccatgatgtgcaaattcaaaacaagcacgccttcccgccatatggtttgcctcccaaactatacaccacccaatgtggtgtacattcccaatgaggatgtcaataactccactcccatactcattaagagccaacaacctcaatctgatcatgcacatgtctctcgacccatggaggagacacatgaaattccccaccacgatctagccaacttcgagccttgcctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaaggaggtga

SEQ ID NO: 41299 - DNA, 561 bp, Glycine max
  Peptide Sequence Number=SeqID_132984
atgtcgcctaatgtcgtcggagaagaagaagctgacaacattcatgctaatcgtaatgatcatgatgaaggagaattaattaacatcgtccaacgtaattttcttattatgcaaatggctacaccgcccagctctccccctcctcctcctcctactggtgcagcatcatatttgtcgtctaccttgaagcagacaagaaaggccacacacctaagatcactggcaactagaccagttggggcagaaacaccgctggtccatgtggatcctgctaccgggaaagcggacggtccctaccgaaagaagttaagaatatatttggggatcatcactcgtgataaggtggatgtcacatacgagaattggaagcaagtccctgctgctcagaaggatttgatatgggaggatattcagtggagacaatttaagtctaatttgacgtccaaatgggcacttgcagccgacaaggacagtgttgatgacactatatgcgaaaagtacgacattagcaaggagaagtgggctcaattttgtcagacccgtagagacccttcgtgggag

SEQ ID NO: 41300 - DNA, 429 bp, Glycine max
  Peptide Sequence Number=SeqID_132985
atggacccgatcaagtacatctttgagaagtctgctctgacggggtggatcgcccagtggccggttttgctatctgacttcaatgtcaagctactcaaggtgtacgaagactcgacactggtgattcaccagctgagaggggaatgggaaactagagaccacaagttgataccctacaaggcctatatcaaggaattggctgcgtccatgttccagctgacaccgcacggagacctaccgtacattgagttcaggtgtcgtggcagactcgcacagtattgtctggtggaagaagagcgggacggatcttcttcatcaatggattcctttgcttcttggaagatgaatggcagcggaatggagaaggaagagagagaggagacgccacttcaaggagaagatgagtctagaagaagctcaccaccatag

SEQ ID NO: 41301 - DNA, 477 bp, Glycine max
  Peptide Sequence Number=SeqID_132986
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatcaagctggatttgatatcccagaggcatctgatttgaggatgaaaaagaaaatactttag

SEQ ID NO: 41302 - DNA, 1033 bp, Glycine max
  Peptide Sequence Number=SeqID_132987
aattcacacgcgggggttagattggctcaccaaattgaaagttatcgatgaggagaacttcgaagctccggaggaagatgaagaagtccgagctttaaaattagagttaggaaaggcaagactcgccaaggagaagttcaagttagctgctacacacatccggaaggagtgcgccgagttacaagaggaaaacgcggccactgcaaaagcccttgaacaagaaaccaaaagggctcgcaaggaggaatatggccgagagaaattccgaggagcattgtggggtagcaacaatgagctcaagctccgaagagaggagagagatcggtccaaaaggagtttggctcaacacttggaagccacggagcaaagcatgctagctatcatagggcaatacaaggaagaattgaaccagtccatggcccatgaacaaaagctagtggaggattttgcagaagtgtatgccgaaaaagaagcaagggggagggtgattgatgctctgcatcaagaagcgactatgtggatggatagattcgccttgaccttgaatggaagtcaagacctcccgcgtctatcagccaaagcaaaagccatggccgaagtgtgtactgcccccgaggagattcatgggaatttcatcataactaagaaaacaccaaggcacccctatcacactcgatccagaaaaatggataatgaagagggcgtgcaggaacagatgaaggccgatctatcggccttaaaagatcaaatggcttccatctcggaggtcatgttaaaacttcagaaaaccatagaggataaagccaccgcaaccgcctccagtacagttagggaagcggagccggtgctgcagcccgccttgaatccgagcctagacagaaacacggccatgttcggtcgaaggtatagtccgaaagcttatccttatggcctgcctctggacttaaccccccgtgccactccggaagatttgagtcaagcccctacttttgaggggcaactcccaccttatgaagactatcccgggcaagac

SEQ ID NO: 41303 - DNA, 252 bp, Glycine max
  Peptide Sequence Number=SeqID_132988
attcaagtcggttcagtgagggcgaccgcgaaagtcaccgaatggaccactggaagacacccgggaccagagcatgtcgtgaaagaagcacactgggcgtgcttcgaccgtgtctccggggcacagttgaatgtagatatcatgaacgcgaggtgcaggataccaggccgagaaacccgggcaaccaccccctatgtgccgatcgctagcgcatccagggccccggcgcccagctccgctggagaggcctag

SEQ ID NO: 41304 - DNA, 695 bp, Glycine max
  Peptide Sequence Number=SeqID_132989
gaaaggagggagttctcttctcatgtggagactacccaaacattccgttgaaagggacgaggggttgtattaactacaatcccgcacttgctataagacagttagggtaccccatgagggaagcaccgatggaagagagtctctcgcctttccttgtgagagatttcggtgtgcaaagtttcaagattgtacaaagagtccacaaggcatgggaaaacccgttaagaaaagataaagaacttaggggcatccgtaatggcatcatcggtggttatcatgaatggctgaaagttcatacacaagggttagattggctctccaagtttaaaattatcaacgaggagaacttcgaagctccggaagaggatgaagaatgtgccgagttacgagaagaaaatgcagctactgcaagagcccttgaacaagaaaccaagagggctcgcaaggaagagcatggtcgagacaaattccgtggagctttgtggggcaggaacatggagctcaagcttcgaagggaagagagagaccaatcacgagtatatagcatggtcttaaaggaggagttagttgcttgctcaagatccaagagggagtttggcccaacacttagaagccacggagcaaagcatgctagctataatagggcagtacaaagaggagttaaaccagtcttttggctcatgagcaaaagctag

SEQ ID NO: 41305 - DNA, 393 bp, Glycine max
  Peptide Sequence Number=SeqID_132990
atggcaattcaggctgatgaaggtagagctgaagagaaggtggagggatataaacaacagttggcagctgagtcagcactggaaccagtttttgattttgttgaacttgaggaagttgtggaagatgaagatgaccaacaagagaaagagacaccaataaaagatagtcaagaaaaaaatgaaaaagaaaaagagaaggttgatgaggagaaaaagaagagcaagagtgaggtttcaagagagaaaaagagagagattacttcagctgaaggcaaggaagtaccatatccattggtaccttccaagaaggataaagagcaacacttagccagatttcttgacatcttcaagaaactggagatcactttgccttttggagaaactctccaatag

SEQ ID NO: 41306 - DNA, 300 bp, Glycine max
  Peptide Sequence Number=SeqID_132991
atggaaattgctctaggtggggtagttgagggtggcacgatgaagttttccattggagcttgtaggcctaggatcttcttcatcaatggattcctttgcttcttggaagatgaatggcattggaatggagaaggaagagagaggagatgccactacaaggagaagatgagtctagaagaagctcaccaccataggaggccatggataagagcttggaagaagatagagatgaatgaagggagaggaagagaagagtacaaaattttgtgctctaagagagctctgaaatctgaagtttaa

SEQ ID NO: 41307 - DNA, 524 bp, Glycine max
  Peptide Sequence Number=SeqID_132992
atgattatgaggggccaagacatttatagtagccaagatgaggctagtacttcaccttcctctagtgaaagtgaagaagcaaaaggggaagaatctagtgaagaaatctacccccaagaagatggacaaccattagtggttaaagagaagtgtaaggacgtaagtgtctccttcaagaggttagctatgaaggaaactcattttacaataaagacaaacattgaagaaactttccctcatagacaacctccacattttctcttttgtaaaaagacacttgttagcactgccacacctcgtgggcttgaggttattcctcaagtaaaggagttgttggatgagggtttggttcgtaagagcttaaatccttgtgctttgttggtgcccaaaataggtattattaggcaccaaatccctacaataagtgatacgatgaatgtgttgagtgttgcaaccctcttttataaactcagtcatgcacccaacgtcttcatgattgatgcacatagggactcattaggtag

SEQ ID NO: 41308 - DNA, 633 bp, Glycine max
  Peptide Sequence Number=SeqID_132993
atgtcttctcgggggaagaaaaccatatctttcctccgggtgtctcccctcttgagcagaattgcaactgtggtcaaggatttagcaagaggtttggaccgcataaaacagactcggaacggcatagcgggcctaccacagaagtacctagaagacaaggcaaggggtatggccaatcaaaggagactgggtcctgtttatggatgtgttagctttgctaattttcggggtcgtcctctttccaaacgtggatggtttggtgtgaaaagagtagcgcacggatcatctgttgcttacccgccctctgtgtttggttggtttccccccctgttccaacaagacacaagacacccatgtccgctcctgagccatcgctcatgtactgaaaagaggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccgtgggatcctctag

SEQ ID NO: 41309 - DNA, 374 bp, Glycine max
  Peptide Sequence Number=SeqID_132994
gtggacccttggtactagtacctatcacctttagaggactatatgtcctcgccatcagaggactgcacatcctcgcctacagagagttgcacgccctcgcctttagagggctacgcgtcctcattttcattccggggccaccccttgatattggagggcaaccaactgtgcgagcacatccagagagggagactatcacgcatctactatgcatactggggcaagatttcacccgtgccgttgcaaaaagacgagtgcggatcatgcgcaccaacatgaccaccctgacgaatcgtgcccacaagacacccagtggacccgaagaagtccaacagggccctggggtttccagctctggttacgggcctctgtag

SEQ ID NO: 41310 - DNA, 417 bp, Glycine max
  Peptide Sequence Number=SeqID_132995
atggagacgtgtttggaagtaaaggaattgttacagcggatgatagatcaaggtcgactggaagtcggcattgaagaaaaaaaagagcagcatatatgcatgcaatctacggaggggagcggtgttgcgaagcccaaacccttggtgatatacttcactaaaaacgcagcttcgcaaaagcccggacaccccttaatagccaaacctgttcctttcccgtaccaaaatagtcacgcggtcccgtggagatatacacctccggggaagaaggaagaagaagtcactgacgtcagctcgctgtcagctaaatggtcgtgtgttcgcacctccggacctaccagtccaatccgccgacgtcaagggaaaaggaaaagtggtggaggaacaagagggcgaagcaccccccgcttcgaataa

SEQ ID NO: 41311 - DNA, 171 bp, Glycine max
  Peptide Sequence Number=SeqID_132996
cctcgcttttgtcgaccaccccacctttgctatcatgacccaagagtctggtagcaggcagagacaccttctggttatccgcacctcgtcattcggagaccccgagttcgattggcaagcagaggccaatgtggtcatctgcgccctttctggagatgtcagcatctcccg

SEQ ID NO: 41312 - DNA, 391 bp, Glycine max
  Peptide Sequence Number=SeqID_132997
atgatggtagacactctgctagtgttctactatgagaagctagtaggttacatcccgtccagctttgcggatctagtgtttgccgggaaaagaatcgaggtaggattgaaaagaggaaagtttgattatgtttcctccacaaatgcgaatgccaaaagaatcggggcaacaggggcaaaaaggaaggagggagatgcccatgccatctcttcaacacccgcgtgggtcaaaccccagcaaacacctcatggtacccatcagtacgcgcaacatcacccaagcttctcggctcatactgggaacgcctctagttcaacacccgtgcagcctaaggcacccacccagagggaagctccccaagttccaactccgaacacgactcgaccggcca

SEQ ID NO: 41313 - DNA, 186 bp, Glycine max
  Peptide Sequence Number=SeqID_132998
atggtgaaagttggaacctcttacgtgccgatcaacgtctcattttcgccaaaagttggcccagggcttcccggtatcaacagggacaccaggatttgggatttggcgattctgtcgaatggaactatatcttccgtcacagggtccgctgcgactaatccaccacatacaccgccggaagcataa

SEQ ID NO: 41314 - DNA, 471 bp, Glycine max
  Peptide Sequence Number=SeqID_132999
atgtatcttgtttgctttctttcaaagaagatcactgggcatgacataaaaaaacttgatcatgccagcttgaggttgatctcaaagctacaaaaggataaccttgacaacttgggaaagtttgcctctaagtgtgataatggaatatttctttggtactctgaaacattgaagacatatagggtatatgagtctagaaccttaatagtagaagaagttatccatgtgaagtttaataacaccaacgctgataaggaattattagaggcagatgagtcctttgcatatctaagactagacgatggaatcaaaaactttgtgtcgtccagttacaacacaaaaattgcagcatccaatccaccattggatagtcctcaagaagagataagggaaccaactggacacaatatgagaaagaaccatccagaaagccaaatcattggtgatctaacaaaacaaattccaaactag

SEQ ID NO: 41315 - DNA, 672 bp, Glycine max
  Peptide Sequence Number=SeqID_133000
atgactgagaatgttcctcacatgactgaagatgtccctcatatggctgaggatgcacctaagatgactgcggacgtacaggctgatgatggtgctgaggggtcacatgctgatgatgctgagggattcccaagtgggccatgtgacccatcagtgctgacttcatttgcagaccatgttgcacatgccatttggagtgaacatgaacgtcctgagttgaagttggtgttgcacaggaggaaggtgacgttaattgggaggccagtgcctgagattgaaggattggttgctgccacaggattaagtccattgatcgggtgttcagttgttattgacgatcctagacttatatctgcatttgtggagaggtggcacagggagaccaacaccttccaccttccagtaggagagttgacgatcacattggatgatgtgtcgtcactcctccatctgcttatcagtggcgccttccatagctttcatgctctttctgtggacgaggcgatatttttcttgacagagttgcttgaggtgtctgctgaggaggctagagcggagacaacacgatcacgcggggcatatgtacggctaggatgggttcgagacatctatgagataagatgccaggcacgacgatggattgtagcagctcgtgcttatctactgcaccta

SEQ ID NO: 41316 - DNA, 399 bp, Glycine max
  Peptide Sequence Number=SeqID_133001
atggtgaaagtcggaacctattacgtgcccatgaactctcatttcgccaaaagttggcccagcgcttcccgtgatcttccgtcacaggagctccagtggcttctgcttctatcagctgtccctcttgttcagctactgacggggtggtgcgtaacggcaaaagcaccgccggacatcagcgctggcaagtgtagcggtcacgatgcgcgtaaccaccacacccgccgcgcttattgcgccgctacagggcgcgtcccattcgccattcgggctgcgcaactgttgggaagggcaatcggtgcgggcgtcttcgctattacgccagctggcgaaagggggatgtgctgcaaggcgattaagttgggtaacgccagggttttcccagtcaagacgttgtaa

SEQ ID NO: 41317 - DNA, 174 bp, Glycine max
  Peptide Sequence Number=SeqID_133002
atggcaaaagaatttgaagagatcctaggatgtcctctagggggaaggagaccatacctcttctcagcaaccaggcccacttgggccttccagaagattcctccagaaggctgttgcttctggaggaagcaacctggctcgcctgggcgagctgagctcgcctgggcgagctga

SEQ ID NO: 41318 - DNA, 153 bp, Glycine max
  Peptide Sequence Number=SeqID_133003
atggtcattcccaagttcaaggtgccggactttgacaagtacaaggggaatacttgccctgagaaccatctaaagatcccaggtggcacccccaatgacgaaaagggagatgataacaatgatagtaaacacattaatagtgttctactatga

SEQ ID NO: 41319 - DNA, 924 bp, Glycine max
  Peptide Sequence Number=SeqID_133004
ccttaaggagttgggacggttgatgggacccctccaaaggcaagccttccgcaaagtgtatggaaagattttagatttgaccacagcggaggtatttacggaagccattgtatccctcgcccaatactatgaccagccgttgagatgcttcacgtttggggacttccaaatagtaccgactattgaagaatttgaggagatattaggatgccctcttgggggaagaaaaccgtatcttttctccgggtttcttccctccttgagcaagattgcagctgtggtcggagattcagcgagagagttggatcgtatgaagcaaactcgaaacgacgtagtgggcctaccgcagaaatacttggaaggcaaggcaagggatatggcgactcaagaagagtgggtcccgtttgcggatatactagctttgctaatctttggggttgtcctctttccgaaagtggacggtttggtggaccttgccgcaattgatgctttccttgcatatcaccatagcaaggagagcctggtggtagctatcttggcggacttatttgatacatttgaccgaagtcccgagacgcctcagaaatcaaaaggaagcaggcttgcgcgatccgtgaaattccgtaatgtggcggaaatcgaaaagaggtgtttttgcgcaatccggggtacgaatagcaatctggcccacttgggccctcctgaagattcctccagaaggctgttgcttctgcaggaagcaaccttgctcgcctgggcgagctggacggcatgcttctcccctattttgctacaaatagggggagaagtgaagaagaaagggccgaggcacttccgtaacgtttccgtgagtaattacgtgaagattctcgaccgttcttcaagattcatcgttcgttcttcgttttcttcagtcttcaacgg

SEQ ID NO: 41320 - DNA, 225 bp, Glycine max
  Peptide Sequence Number=SeqID_133005
tggcttctgtttctatcagctgtccctccctgttcagctactgacggggtggtgcgtaacggcaaaagcacccgccgggacatcagcgctggcaagtgtagcggtcacgctgccgcggcgatcggtgcgggcctcttcgctattacgccagctggcgaaagggggatgtgctgcaaggcgattaagttgggtaacgccagggttttcccagtcacgacgttgtaa

SEQ ID NO: 41321 - DNA, 418 bp, Glycine max
  Peptide Sequence Number=SeqID_133006
agcttccgttgttcaatttcgagcgtctagatgagttatgtccccgaatcggacatctgtgtgaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41322 - DNA, 456 bp, Glycine max
  Peptide Sequence Number=SeqID_133007
atggtgaaagttggaacctcttacgtgccgatcaacgtctcattttcgccaaaagttggcccagggcttcccggtatcaacagggacaccaggatttatttattctgcgaagtgatcttccgtcacagtggcttctgtttctatcagctgtccctccctgttcagctactgacgggggtggtgcgtaacggcaaaaagcaccgccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 41323 - DNA, 515 bp, Glycine max
  Peptide Sequence Number=SeqID_133008
ttccagggcagcaccctggcgttccaggccgcgctgggcaacaccatctggctgatcgtggcggcggtcgtggcgatgtacatcgtgctcggcgtgctgtacgaaagctttatccacccgatcaccatcctctctaccctgccgacggcgggcgtgggggcactgctggcattaatgctggcgggcagcgagctggacgtgattgccatcatcggtatcatcctgctcatcgggatcgtgaagaaaaacgccatcatgatgatcgacttcgccctggccgccgagcgcgagcagggcatgtcgccgcgcgatgcgattttccaggcctgcctgctgcgttttcgccccatcctgatgaccacgctggccgccctgctgggcgcgctgccgctgatgctcagcacgggcgtcggcgcggagctgcgccgtccgctgggtatcggcatggtcggcggtctgctggtgagccaggtgctgacgctgttcaccacgccggtgatctacctgctgtttga

SEQ ID NO: 41324 - DNA, 669 bp, Glycine max
  Peptide Sequence Number=SeqID_133009
atggcccagaggaggaaccaggtcgatgggtttgatgaggaggccatcgctcagttgctatgtataccggggcaggattttgcccggactgctgctgggagacgggtgcagatcatgcgcaccaacatgaccaccctgacccagatatggatgacgttgctgctcagcaacatccagcccagcgatcataattccgacctccccctaccgaagtgtcagctggtgtacgccgtcctgacacggatgagcattcacgtggctcagttgatcgctgatgccatttatctatttgcaggtatggcgccgactaggcaccctttggacccggataagtccaacagggccctgggatttcccgcattgatcacaggactttgtcagtcgttcggagtccccgtcgcacctagcaaggcgaccaaccaccgggcgcacgtgcagacccatgactgtctttaccagctgagcctcagcctgcagagccagggttttacttcttttccatgccctactctggatcagttcagggcagaggtcgcatggcccggagattggcctgaggcccaggcaggggaggcacccgcagaggctcccggcgaggcagatgaggctcgcgaggacgaggagatgaccgatttgcttgatttcttgggagggagcggagccacatga

SEQ ID NO: 41325 - DNA, 504 bp, Glycine max
  Peptide Sequence Number=SeqID_133010
gaaacatccatttttatcttatctgcatacttgtcattcctcatgcattgaatctgaatctgagtttgaatttgatcctggatctgatttttatgctgagagtaaatttgaatttgagtctggttctgattttctgggtgttgtatctcttgatgctgaggaactctcctatttttctcctaccctggttcctcccactgttcagccaccacctacaccagtgttgaagcttttactagtaaacctcaagtatgcttacttggaggacaagaaaaaatttccagtgattatctctacgtcccttgctgttgagcaagaggagaagttgttgctagatacttttagaggatggagctacgctagtgaggcagcgacagaggcgactcaaccccatcattctagatgcggtgaaaaaggaggtctcacagtgatcaagaatgagagggatgagcttatccccacaagagtgcaaatcagctggcgagtctgcattgattatatgag

SEQ ID NO: 41326 - DNA, 639 bp, Glycine max
  Peptide Sequence Number=SeqID_133011
atggagagaagtatgatagatgctgccagtggtggagcccttggaaacatgactcctgctgaagccagaaatttaattgagaagatggcttccaactctcagcagtttagcgccagaaatgatgccatagtcattagaggagtgcatgaggtagctacaaactcagctgcatcatctgagactaagaagcttgaaggcaaactggatgcattggttaacttggtaacccagctggccttgaatcagaaatctgtacctgttgcaagggtttgtgtttgtgctactttgctgaccaccatacagacctttgcccttccatgcagcaacctggagcgattgagcagcctgaagcttatgctgcaaatatttacaatagacctcctcaacctcagcagcaaaatcaaccacagcagaacaattatgacctctccagcaatagatacaaccctggatggaggaatcaccctaacctcagatggtccagcccttagcaacaacaacagtagcctgctccttccttccaaaatgctgctggcccaagcagaccatacattcctccaccaatccaacaacaacaacaaccccagaaacaaccaacagttgaggcccctccacaaccttccctcgaagaacttgtga

SEQ ID NO: 41327 - DNA, 267 bp, Glycine max
  Peptide Sequence Number=SeqID_133012
atgatacgcggagataccttacggttattcgcacccttttgtcatccaaaggcggcgggcccgatgacaagcagagaccaagtttggtcattctgcacccttgtatcatccagaggcggcgggcccgatgatacgcggaaatacccgagtggttatccgtataacattcttttgctatctgcaatttgtgaaattctaggagcgacaagtcatggtcacccgcgactctcgttaaccgagaggaacgaaattagtgtcatacactga

SEQ ID NO: 41328 - DNA, 360 bp, Glycine max
  Peptide Sequence Number=SeqID_133013
atggagttaatagagaatatggcaaccagtgatcacaccatccttcagaatcgagcctacgcacccacaaagaaaaatcttcttgagctcacttctcaagatgctattttagctcaaaacaagctcttggccaagcaattagagaccctcccagaaactctgagtaagctccctcaacagttgcatgcagtgcatccttctccacccccaatcatgcacattgggggatgtaacatctgtggtggggctcatgagttaggcttgttcatggctcaaaaagatgcatccaaggaagttaactacatggctaatcagaatcatcaaggattccatcaagaaggactgctagggtgccattag

SEQ ID NO: 41329 - DNA, 339 bp, Glycine max
  Peptide Sequence Number=SeqID_133014
atgacaaatcattcatttctgtctcagttgtatgatatagtccggaaagaaatatggtaccggccagacatgtttttttatagggacatgcttatgatgcttgcacgaaacaaaagggtagaagaagctaaaaaggtttggggtgatttgaaaacagaggaagttttatttgatcagcatacattcggagatattatcagagcttttctagataacgggttgccctcagaggcaatggacatatatgaagaaatgagacagtctcctgaacctcctctttcattgccttttcgcgtgatattaaaagggctcattccctatccagaattacgtgagaaa

SEQ ID NO: 41330 - DNA, 698 bp, Glycine max
  Peptide Sequence Number=SeqID_133015
gtactagtaccctcaccttcaaaggaccgcacatcctcacctttagagcactgcacgtcctcgcctttagaggactgcacgccctcaccttcagagggctgcttgccctcgccttcagaggactacacgtcctcgccatcagagggctgcacgtcctcaccttcagaggacaacacgtcctcgccatcagaggactacatgtcctcgccttcataggacaacaagtcctcgccttcagaaagctacacgcccccggcttcagaggactacacgtcctcgccttcagagcactacacgtcctcgccatcagagggctgcacgccctcaccttcagaggactacacgtcctcgccatcagaggactacaagtcctcgtcttcagagggctacacgccctcgcctttagaggtctacacgtcctcaccttcagaggactacacgtcctccccatcagaggactacaagtcctcgccttcagagggctacacgccctcgcctttagaggtctacatgtcctcgccttaagaggactacacgtcttcgccatcaaagggctgcatgcccacaccttcaaaggactacacgtcctcgccatcagagggctacccgtcctcgccttcagaagggctactacacgccctcaccttcagaggaccacacgtcctcaccttcagagggctacacgccctcacctttag

SEQ ID NO: 41331 - DNA, 390 bp, Glycine max
  Peptide Sequence Number=SeqID_133016
atgccgatctccccctacggaaatatcagttggtctgtgccgtcccgacatagggatcgcgcccacaagacacccagtggacccagaaaagtccaacagggccctagggtttccagctctggttacgggcctctatcaatcctacagggtgcccgtacccccccagcaaggtcatgccatcccgacataggtaaggatcgcgcccgcaggacacccggtggacccaaagaagtccaacagggtcctggggtttccaactctgattacgggcctctgtcagttctacggagtgcccgtcgccccaacaaggtcattaggccccgcattaaccgggctttcatcaagaagtactgcgcccccagacgggcgcagggcgagacaccacagtag

SEQ ID NO: 41332 - DNA, 708 bp, Glycine max
  Peptide Sequence Number=SeqID_133017
atgactaccagccaatgcatctggagtttccagatgaagacatcaaggccttgttcgaagcatccagtggattcccttcgatgcagatgctctgagtcagttcctaggccacccactggtcttggcggagggctagcagtggagatgggtgcgaatcatgcgcaccaacatgacctccctttcccagatatggacaacgtgagtgtgcacatggctcagctgatttctgatgccatttatcagtttgcagggacagtgcctacgagacaccctatggacccggagaggtccaacagcgccctggggtttcccgctctgattacaggcctttgtcagttctatggagtgcctgtcacccccagcaaggtgatccggccacccattaccagagccttcatcgagaagtactgcacccccaggcaggcagccgatgcaccaccgtcacccccggagtccacatcggctcacctacgaagattggagcattgcatacgacatgtggctagccaaaaggtagccaaccacaggggtcagatggaagcggggcccgcggggacctctggaggtggggacaaagcccaggaggatgaggatatggccgacctgatagacttcctcctttattatgtccgttatgtttggactaaatatgccattgtcactttcaattatctgttactcatcacgagtgatttttaccgtgtctag

SEQ ID NO: 41333 - DNA, 570 bp, Glycine max
  Peptide Sequence Number=SeqID_133018
aagagctacaccgccctcgccttcagaagactacatgcctcgccttcaaaggactacacatcctcgccttcggaggactacacgtcctcgccttcagagggctgctcgccctcgccatcagaggactacacgtcctcgcctttagagggctgcacgccctcaccttcagaggactacacgtcctcacttttagagggctgcacgctctcgccttcataggattgcacgccctcgccttcataggactgcacgccctcgcctttagagggctacgcgtcttcactttcagggccagtagtttcattttatcagttcttgggccaccccctgatattggaggggatcacgcccaacaaacaccaagtggacccagagaagtccaacagggccctggggtttccagctctggttacgggcctctgtcaatcctacagggtgcccgtcccccccagcgagggatcgcgtccgcaagacacccagtggacccaaagaagtccaacagggtcctagggtttccagcttggattacgggcctctgtcagttctacggagtgcccgtgccccagcaag

SEQ ID NO: 41334 - DNA, 594 bp, Glycine max
  Peptide Sequence Number=SeqID_133019
atgatctctggcgcaacaccagaggcgggtaaaacatttattagctcaaacctcgctgccattatgtcgctgacgcggcaaagagtactgttaattgatgccgatatgcgccggggtactggacacaaggtgttcggggtcagcaacgcaacgggactggctgaagtgctttcgggagaggcaccatttccaacggcgataacccgcgtccaaaaagataattacgattttgatttcttaccacgaggaaaaaccccggttaatccagcagaaagattgatggggccgattctgccggagctcataaaatgggcgtcaaacaattatgatcttgtgattatcgatacaccacctgtattggctgttaccgatgcagtgctgattggaaaacacattgggacgttactgctggtggcgcgttatcaaactaacactgtgcgcgaaattgaactgagtattaaacgtttcactcagtgcaatatcactgtacaggcttgcgtactcaatatgatcactaatagtttcaggaattattatacctacggttatgggaataatacttacgcatacgatgagaccaggataaagcattaa

SEQ ID NO: 41335 - DNA, 612 bp, Glycine max
  misc_feature (609)..(609): n is a, c, g, or t
  Peptide Sequence Number=SeqID_133020
atggaaatccgttctactctaaagctgatcaatgagaaaagactaaggaaatcttttcttaacagggttttaagctgggagcctatttcttcctgcttcagtgtctatattgttctgaagccgggaaatataccctattttaatcacaacatctaccattattcttgcattgaacaggtttggaatgcttatcagtatgagaatgaaacctggcctgagacgtatatgctaagctccacgccatcgaagcatcatcctgaatttgcagaaaaccattacaatgaggagatccttcacctcaatacccggagattcatagaatcaattacttctgataagaagctgcaggccatattattagggtctaattttctgtatggcggagattctgaaaagaccccgttttatgtgcatgcacttaccgttaattcctgtattcagagtgcttataaatgtgcgaaaggaggaagccagatctccaagttgctcatccgcaaattacgggaatatggtgcagatgttcacaagcattctgaagtctctgaaatgatctttactgaggatgttttggtggccgtaaggactaaaacgggtaaggaatatgctgcntaa

SEQ ID NO: 41336 - DNA, 657 bp, Glycine max
  Peptide Sequence Number=SeqID_133021
atgcaggttggaggttgtagtatttatggaggagcgcatgaatccggctgttgcataccccaagataatgttgcaaaagaagttaccaacaaggcggaaatttcaatcaaaatctggggcaaggatggaggtcacatccaggaaatcagttcagtttcaatgtctaaccataagagcactgagtcagccatcaagaatctggagattcgagtgggacaactagctatacaggttggaggttgtagtatttatggaggagcgcatgaatccggctgttgcataccccaagatgatgttgcaaaagaagggcaaggatggaggtcacatccaggaaatcagttcaataaagaccaaggaagaccttccaacagacctcctaatcaagagcctaatttatatgagaggactaccaagatagaagaaactttggctcagtttatgcaggtctcaatgtctaaccataagagcattgagtcaaccataaagaatctggagatccgagtgggacaactagctaagaaaagagctgagaattcttttggaggttttggagctaatacagagaagaatctcaaggaagaatgtaaggctgtcatgactagaagcaagatggagaccattgtagaggacgaaagtaggactattgaggagaagaag

SEQ ID NO: 41337 - DNA, 533 bp, Glycine max
  Peptide Sequence Number=SeqID_133022
atgactagaggcaatccatctgacttacaaccctttgatcctgagatagataggacatttcatagattagttaggcatcattttataccttttgatcattctgagcattccattactggtgaatatgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaggaatttcatattgtctgctccaccatgaaacccccagatgtccaagaggatcacatatttctgaaggcttttcctcattcattagagggagtggcaaaggactggctgtattaccttgctccaag

SEQ ID NO: 41338 - DNA, 219 bp, Glycine max
  Peptide Sequence Number=SeqID_133023
atggtgtggcgtctccaatcacctttcctccttctccattccgctgtcattgatcttcaagaagcaaaagactccattgatgaagaatatccaaggcctacatcacctttcctccttctccattctactagcattgatcttcaagaagcaaaggaatccattgatgaagaagatccaaggcctacaagctctacatggagctacattatgtggtattag

SEQ ID NO: 41339 - DNA, 294 bp, Glycine max
  Peptide Sequence Number=SeqID_133024
atggcgcctcctctctccgcttcgcgtttgtcttccgctgcattcccatgcttagctgtagaagcaaggcttcgtggtgaatgtgattcaaagaacaactcaagtgaatcaaagaagatctcaagtaaatcaagaacaagtcaagagttcaagaatcaagaagaattcaagactcaagaagaaagcctagaatcaagaatcaagattcaagattcaagatctcaagaatcaagatcaagattcaagactcaagattcaagaatgaagaaaagactcaatcaagataagtattaa

SEQ ID NO: 41340 - DNA, 375 bp, Glycine max
  Peptide Sequence Number=SeqID_133025
atgacgcctgaagtggcacaagaaattgcagacaaaattgaacaagcaacacatgggagttttgttccgcatgggcgacaggacatacttaacacatcccttggccgacctgagcatccaggccgtgttcgcgtcgcagggacaggtgtcacaataagccaatactttggccaagcctcacgtgcttctagcacatcgtcaccatcgatcaaccaacaacaattggctgatatcatcagtggaattaaggatgacataagaaagcagctacaagatgagataagaaaggaggtacaggatgagataagaaaagaggtacgacaagaacacaagcagcaacaagaggcttggatgagggcaattgaagaaaaatag

SEQ ID NO: 41341 - DNA, 881 bp, Glycine max
  Peptide Sequence Number=SeqID_133026
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgaagtagtgctcgtaaacttgtagacaagccatcagacgacacatccaaacttcccaaggctgaagcggaagccaatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41342 - DNA, 445 bp, Glycine max
  Peptide Sequence Number=SeqID_133027
atgacgggctcgaaccgccgaccccctccttgtaagggagatgctctaccaactgagctaatcacccccgctgtgtggagtcgcattatagggatccttcgaaaaaaacgcacttctgcccgcgccgccagcgtgacagtgattgaggaatcagcttcacctgctagaatatgcgcactgtttttccgcgttaaccccccgacgggctacctgcacgtcggtggtgcgcgtactgcgctttactcatggctttatgctcgccataaccagggcgaattcgtcctgcgtatcgaagataccgacctggagcgctccacgccggaagcgatcgaagccattatggatgggatgaactggctgaatctcgactgggatgagggcccgtactaccagaccaaacgtttcgaccgttataacgacgttatcgacgaaatgctggaagccg

SEQ ID NO: 41343 - DNA, 378 bp, Glycine max
  Peptide Sequence Number=SeqID_133028
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaaacacccgccggacatcagcgctggcaagtgtagcggtcacgctgcgcgtaaccaccacacccgccgcgcttaatgcgccgctacagggcgcgtcccattcgccattcaagctgcgcaactgttgggaagggcgatcggtgcgggcctcttcgctattacgccagctggcgaaagggggatgtgctgcaaggcgattaagttgg

SEQ ID NO: 41344 - DNA, 462 bp, Glycine max
  Peptide Sequence Number=SeqID_133029
atgacaaaaagatattggaacataatcttggaagagatgatggaagcaggagttcattttggccacgcaagtgagggaaaacaattcttaattgttggtacaaaaaaaaaagcagcggattcagtagcacgggctgcaataagagctcggtgtcattatgttaataaaaagtggctcggcggtatgttaacgaattggtatactacagaaacacgacttcaaaagttcagggacttgagaatgcaacaaaagacggggagactcaatagttttccaaaaagagatgccgctatattgaagagacatttagctcatttggaaacatatcttggcggcattaaatatatgacggggctacctgatattgtaataatcgtcgatcaacaagaagaatatacggctctttcgagaatgtataactttggaaattccaacaatttgtttaatcgatacaaattgtga

SEQ ID NO: 41345 - DNA, 142 bp, Glycine max
  Peptide Sequence Number=SeqID_133030
ttgccatatagggaatgagaagttgaggattggtgccatattgtggcttgaagaatttgatcaagaaagcaaggggccaacctccttaagagctattggactaagaaactccaaattgagtgaaacactaaagagagaatag

SEQ ID NO: 41346 - DNA, 596 bp, Glycine max
  Peptide Sequence Number=SeqID_133031
atgaccgagttacccattgacgaaaacacaccgcgcattttgatcgtcgaagacgagcccaagcttgggcagttgctgatcgactatttacgtgccgccagctacgccccgtcgctgattagccacggcgaccaggtgctgccgtatgtgcgccagacgccgccggacctgatcctgctggatctgatgctgcccggtaccgatggcctgaccctgtgccgggaaattcgtcgcttctccgacgtgccgatcgtgatggttaccgccaaaattgaagagatcgaccgcctgctggggctcgaaattggcgcggacgattacatctgcaaaccatacagcccgcgtgaagtggtcgcccgcgtgaaaaccattctgcgccgctgtaaaccgcagcgcgagcttcaggtgctggacgcgcaaagcccgctgattgtggatgaaagccgtttccaggcgagctggcgcagcaaactgctggacctcacgcccgccgagttccgcctgctgaaaaccctctcccacgagccggggaaagtcttctcccgcttgctggccggaatcaaaaagctggatgtttcagatgttgcgtccgccag

SEQ ID NO: 41347 - DNA, 444 bp, Glycine max
  Peptide Sequence Number=SeqID_133032
atggaggatgggttttctcaaggatcaattctcatcattctaggcagaccctttatgaaaactgctagaactaagataaatgtatatgcaggcacactatccatggagtttggtgatataactgttcattttaatattctggatgctatgaaatacgcatctgaagatctttctgtatttcgtgctgaaataattgacgatgttgtggatgaatacatgactgatctttactctaatatgcatgccactcactgctcctcttcatgcattgagtctgaaattgtacttgatcacatgtttgaatttgatgctgagagtgaatctgaaagtgatattgattgcatgtctggtggtggtgttttacctctcgagattaattttatagagtcagataggactaaccatgtttcaggaagtacacatacctctgactttctttatgag

SEQ ID NO: 41348 - DNA, 330 bp, Glycine max
  Peptide Sequence Number=SeqID_133033
atgaccgttcgaagccttgggttcgatggcccctatgacgtctatcccccacatggaaaaaggccaaggggcggtcatgacattcagaggatgtggcagagcattgacattgttcgcgaacgcttgacatttatggcatttccttacatggatgcagcaatcactttccatggtgagccagtaataacctgctttcaggatcttcctggccatagcatgcccattggtgtgcgttccaaacgaaccctcgtggacttcctcgatcatgtggttcacctctttggcatccacgcatcgcaggagagtcatgtcatggtttcttttatatag

SEQ ID NO: 41349 - DNA, 848 bp, Glycine max
  Peptide Sequence Number=SeqID_133034
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaactcccttggggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41350 - DNA, 300 bp, Glycine max
  Peptide Sequence Number=SeqID_133035
atggcttgtggtggccatcggtggtcgtgggtggtggagaagaaggtgttagggtttgggtgggtgtttagagaggaggagggtgaaaacattgtgtttttcatgctgaagaatcgagagtccacttttgctgctaagtgtgacaattcttgcttagcgcaattccctctcaagttggaatttgcgctgagcgtgataatttgcactgagcacaatttctcttgcgctaagcacaacaattctcgctcaacgcaattccctctcgggttggaattgcgcttagcgcacttctcacgctaa

SEQ ID NO: 41351 - DNA, 495 bp, Glycine max
  Peptide Sequence Number=SeqID_133036
atgtcttcagtcattgcatgccttcaaaaggcgacaatgtcctcatctatatttcaaagacgacaatgtcttcagtcattgcatgccttcaaaaggcgacaatgtcctcatctacatttcaaagatgacaatttctttagtcattgcattccttcaaaaggcgacaatggccttcatttgcatttcaaagatgaaaatgtcttcagtcattgcatgccttcaaaaggcgacaatgaccatcatttgcatgccttcaaaggaaacaatgaccatcatttgcatttcgaagacgagaatgacattcttcagcccctgggcccacctgggcctattagaagacttagaagagaagaaaccagctcgcctgggcgagcatgggaggctgaggggaaggggttcagcacccttagtgagcaaattccactgaaattggtgagaagaaggagaaaaaagaagaaaaatcaaggccgaggcgcttccgtaacgcttctgtga

SEQ ID NO: 41352 - DNA, 203 bp, Glycine max
  Peptide Sequence Number=SeqID_133037
gcggtgttgtccttgctgaggtgttgttggctgattcacgattcactcgaccggatatgggttttcacccaacaaaactcaatttcgtgcctagcgatgcggatgagcgccactcgattggtgtcaagtcttgcgaacgtgagggtggcatgagtggtaatcgggatgtttttgttgcacggctccatgcttgcgcatgcaac

SEQ ID NO: 41353 - DNA, 159 bp, Glycine max
  misc_feature (86)..(86): n is a, c, g, or t
  Peptide Sequence Number=SeqID_133038
atgggggagacacatgaaatgccccaccacaatctagacgacttcgagcattgcctcggatatgccactgaagggcaagcagttgntggtaaaatccctccaattatggaagaaatgggagaagttggatcatctagaggaaaggctcagggtcgttga

SEQ ID NO: 41354 - DNA, 186 bp, Glycine max
  Peptide Sequence Number=SeqID_133039
atgggacaccttagtgatcaaggggtttccacggaccctaagagaataaaggtcattcctgattggctcactccaccatgtgtcgagggaaggagcccagagtatgaagaacctcgggatttgaggtcaaatcctttccaaggtggaggggatgatgcaatcctaccccccaagggtattggatag

SEQ ID NO: 41355 - DNA, 372 bp, Glycine max
  Peptide Sequence Number=SeqID_133040
atgttcctccagaaggcggtcgcttctggaggaagcaacctggctcgcatgggcgagctgggtggcaagctcctcccctattttcctataaatagagggaggagtgaagaagaaaagggttcagcccttctggtgatttggcgaagattttcaaccgttcttcatcgttcgtcgttcattcttcgtcgttcttcagtcttcaaccgtgaaactaaggctaaaatcaactcgcaaagtcaagctcgtccacaaaaaatcacaaaaaaggattttaaggttcgatacctcagtttttctcaccaagtaaaaatgggtcattttaaggtccaacgccttaaaaagatctccttccaagtaaaaagaatcgcttga

SEQ ID NO: 41356 - DNA, 692 bp, Glycine max
  Peptide Sequence Number=SeqID_133041
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccagttgtcagggcacaagaggggaggtggcttccaagtagagggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 41357 - DNA, 357 bp, Glycine max
  Peptide Sequence Number=SeqID_133042
atgttgtccttcaaccagatgcagtcccagatgcaatcacaaggactcgaactgcctcctaagcctgaggttgggaacgatctagacacgggtgacttagagaaatgcgggttgtacatcgaagaaaatccttcctgcctagttgccctaggacgactttatgaggggttcacaaccgttcacaacatccctttgcgccatgatgaagtcaaggttggtgttgaggaagctagagatgcaaatgctctcattcctgtacgcactgaaaagggagctgtgggaccaacggaacttgcagatgggccagatcatgatgtcgatggttccctatatttgatgacattgactatcccatag

SEQ ID NO: 41358 - DNA, 237 bp, Glycine max
  Peptide Sequence Number=SeqID_133043
acttatcaaggtaatccttgtggcgtctacccagacttatcttccttcaccggaagtggcgtctacccagacttatcttccttcactggaagtgccgtctacccagacttatcttccttcactggaagtggcgtcatcgaaatctgtgatccgttcctagtcaggttcacatcatctggtatcagagcttcggctcttgatacagtttctatcttatcctattatttttctttgtaa

SEQ ID NO: 41359 - DNA, 864 bp, Glycine max
  Peptide Sequence Number=SeqID_133044
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctagcagctctttctgccccagttcctgcagattttcaacgtcttgaagccatgtttcaaagcatccatcaggggcagattatcttattacaaagtttacagatggtggcacctccagtctctattccttcagtagagcagtttaatgagtgggtagcctggcccgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41360 - DNA, 435 bp, Glycine max
  Peptide Sequence Number=SeqID_133045
atggctccgaagaaactctccatgaagaggtctagaagagacgctgcaacggaagggtccagtgccacccccgagtttgatagtcattgtttccggagtgccgagcaccaacagctcttcgaggccatcaaaggatggtcgttccacacagagagcgacggagaaagcttgcagacgttgggcgtcgctggtgcactcccaggcaggagggatgcaggcatgcgttcaagagcagacgcatcccttgatgcagacctcacaggccgatcccgctgggtcactaggcatagagcattatctacagcacttggttcagccagcaggtgccaaccaccgggggcaggttacagatacattgtctctaccgcttcaaccttagtcacaacggggcagggtttcgctctttttgcgtgccgctatcgcagagcagtttag

SEQ ID NO: 41361 - DNA, 327 bp, Glycine max
  Peptide Sequence Number=SeqID_133046
atgaaaagaatacgaatctggggatcccacggtcatgtggctccgctccttcccaagaaatcgaacaggttagtcatatcctcgtccatgtggggttcatccatcccaccggggggtcctacaggctcctccccgacctgggcatcaggccagtctctaggcctccctatagcagaagaacatttgcgggttaccgtcgggtgtccccgcatgccaccggactcttgggtcacgataacaaaaggtggggtggtcgacaaaagcagggcttttgctcctacgtatcctcaatttgtgatgaggaactcagacctacgtagttcttga

SEQ ID NO: 41362 - DNA, 417 bp, Glycine max
  Peptide Sequence Number=SeqID_133047
atggtgtttcaatcctacgcgctgtttccgcacatgagtgcgctcgacaacatcatgtacggcctgcaatcgtccggcatgagcaaaaaggaagcgcaggatcgtgcgcgcgaagggctgaaactggtcgggctggagagtcaggggcagcggctgccgtccgaactttccggtgggcagcagcagcgcattgcggtggcgcgcgcgctggtgctggagccgcaggtgctgctgctggatgagccgctctccaatctcgacgagcgcctgcgccgccgggaagaggcgctggcggtgtcggataaaattattgtcatgaaagagggcgatattgctcagcaggggcgcgccggaaagcctggagaaggcagcgaagcgctggtgcgactcgggcagggagcgctatcgcgtgcggcg

SEQ ID NO: 41363 - DNA, 544 bp, Glycine max
  Peptide Sequence Number=SeqID_133048
aagaggaaagaaatttcttcatctgattctgatgatgatgtcgaactagatgtctcgacatcaaagagggccaagaaatctggaaaaaaggtgcctgaaaatgtccctgatgcaccattggacaacatctcattccactccattggcaatgcagaaaggttgaaatttgtatatcaacgcagacttgctgttgaaagagaactgggaagagatgccttggattgcaaggagatcatggacctcatcaaggctgctggactgctgaagactgtcaccaagttgggagattgctatgaaagtctaatggagtggtgggatattgctgtctctgagcatcaaattgccaaggaaatcactgccaaacaagtccagcattggccaaagaaaagggaagctgtctgcagggaagctaagtgtgaaatatgcaatcctgcacaggattgggagctgcaaactgggtacccaccaatcatacgtccactgttgccacaggggacacatgtcccagacattgtctcgacatcagggaaagctgctgcttcag

SEQ ID NO: 41364 - DNA, 426 bp, Glycine max
  Peptide Sequence Number=SeqID_133049
atgagtgatggattttgcggtactcatttgcagatcatggttaggaccaaaggattatgtcgtgccttaggtcaggtaactggcagaggtgtgggcagaggagatcatgatgattccgataatgctccacaacatcaacgacctactgcatccgcacggaggcagcgacgcgctgtgactatggatcacgtcgatgagccagtcatccttgacccagatattcaggatgacccgatggaggcaccagctgctgtggaggacattcctgcggacgtaggcgcagaggcggctgaggatcagcatcagggatttccgggtggtccaagtgacccatccgtgttgacagcgtatgcggatcacgttgcttgcagcgtatggatgggagaggagcgtcctgaattgaagctatcctctcatgggaggaag

SEQ ID NO: 41365 - DNA, 164 bp, Glycine max
  Peptide Sequence Number=SeqID_133050
atgggggtgcaaatagcacccaggcccacttgggccctccagaatattcctccagaaggctgttgcttctggaggaagcaacctggctcgcctgggaatttcgcaaaggttcaaccgttcttcgacgtcttcattcgttcttcatcggtcttcgatctcaacgg

SEQ ID NO: 41366 - DNA, 406 bp, Glycine max
  Peptide Sequence Number=SeqID_133051
atggtggctcacgcctgtaatcccagcactttgggaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 41367 - DNA, 720 bp, Glycine max
  Peptide Sequence Number=SeqID_133052
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatgcagaaggctgaagaaagcaaagtccctgaggactcactggaggaatgtgccatcacttgttcaaatagccacggcccttgtgactccaaccagcctcacaagaacatcaacatcacctttgaggaagacaaagtcaactcagctctggttgtagacagagaatcctatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 41368 - DNA, 884 bp, Glycine max
  Peptide Sequence Number=SeqID_133053
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataggcgactacttcccgggcaacgacaaggccctggcccagcagacggtgcgccagttcggccgcaacctgccgaaggacaagaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41369 - DNA, 519 bp, Glycine max
  Peptide Sequence Number=SeqID_133054
atgaccatgattacgccaagctcgaaattaaccctcactaaagggaacaaaagctggtaccgggccccccctcgaggttgcggccgaactggcgcaccgtctgctgggccagggccttgtcgttgcccgggaagtagtcgcctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41370 - DNA, 609 bp, Glycine max
  Peptide Sequence Number=SeqID_133055
atggcccgcatgaagaaaacaagggagatgaagactgaggtcgcaaaggaaatcgttgaaaaaatcgatttctttgaggagcaagcgacacagggatccttcatcccccatggacgtcaggatcatcctggacgtgtctgtgctgctggagttggtgtcaccatcaagcaatacttcggatcagctccacagacgtcccacagctcttcctcgttgcctcctgaagaattgcagcagttgacccagcaaatcagggaccagctagaggagtcgatcacagaaaaagtgactcggcagctcatggcatcgttcagccagatgcaatctcagggacttgcactacctccggagcctctagttggtccctcaggtcctcgagtaagaacaaaggggagttgtgttgatcccttaggaaacgatcctaagccgggtgactcagataggcgcggcttgtacatcgaagcaaatcctacccgcctggttgtcttggggagagtttatgagggatccattgttgttcataacactcttttgttgcctggccaagtaaaggtgggtgtgaaggaggttaaagatccagatgctccagttcctgtacccactaatgag

SEQ ID NO: 41371 - DNA, 1773 bp, Glycine max
  Peptide Sequence Number=SeqID_133056
atgcgtacagaatattgcgggcagctgcgtcagtcccacgtcggacagcaggtcaccctgtgtggttgggtcaaccgtcgtcgtgatcttggtagccttattttcatcgatatgcgcgaccgtgaaggtatcgttcaggtgttcttcgacccggatcgtgcggatgcgttgaagctggcttctgagctgcgtaatgagttctgcattcaggtcaccggtaccgtgcgtgcgcgtgacgagaaaaacgtcaacgcagacatggcgacgggtgccattgaagtactggcgtccgatctggttatcattaaccgtgctgaagcgctgccgctggactccaaccacgtcaacacggaagaagcgcgtctgaaataccgctacctggatctgcgtcgtccggagatggcccagcgcctgaaaacccgtgcgaaaatcaccagcctggtgcgccgtttcatggatgaccacggtttcctcgatatcgaaaccccgatgctgaccaaagccacaccggaaggtgcgcgcgattatctggtcccatcccgcgtacataaaggcaaattctacgcgctgccacagtctccacagctgttcaaacagctgctgatgatgtccggtttcgatcgctactatcagatagtcaaatgcttccgcgacgaagacctgcgtgctgaccgccagccagaatttacccagatcgatgtggaaacctccttcatgaccgccgaacaggtgcgtgaagtgatggaagcgctggtgcgtagcctgtggaacgacgtgaaaggcgttgagctgggcgacttcccgatcatgaccttcgccgaagccgagcgtcgctacggctctgataaaccggacctgcgtaacccgatggagctggtggacgtggcggacctggtgaaatccgtagagtttgcggtctttgccggtccggctaacgacgccaaaggccgtgttgctgcgctgcgcgtaccgggcggtgcggcactgagccgtaagcagattgacgactacggcaacttcatcaagatctacggcgcgaaaggtctggcttatattaaagtcaccgagcgcgcgaaaggcctggaagggatcaccagcccggtcgcgaaattcctgaacgcggagatcgtggaagcgatccttgagcgcaccggcgcgcaggacggcgatatgatcttcttcggcgcagataacaagaaaatcgttgcggatgcgatgggcgcgctgcgtctgaagctgggtaaagatctgaacctgaccgacgagtccaaatgggcgccgctgtgggtgattgacttcccgatgttcgaagatgacggcgaaggcggtctgaccgcgatgcaccacccgttcacctcgccgaaagacatgacggctgcagagctgaaagcggcaccggaagatgcggtcgccaacgcctacgatatggtcatcaacggctacgaagtgggcggcggttccgtgcgtattcacagcggtgaaatgcagcagaccgtgttcggtatcctgggcatcaacgagcaggagcagcgcgagaaattcggcttcctgctggacgcgctgaaatacggtacgcctccgcatgcgggtctggccttcggtcttgaccgtctgaccatgctgctgaccggcaccgataacatccgtgatgttattgccttcccgaaaaccaccgcagcagcgtgtctgatgaccgaagcgccaagctttgccaacccggccgcgctggctgagctgggcattgacgtggtgaagaaggaagagaaaaactga

SEQ ID NO: 41372 - DNA, 279 bp, Glycine max
  Peptide Sequence Number=SeqID_133057
atgggttatgtccttgcatttaaagtcaaagttcaacccaagtttaacaatgttgttgttcttagatactcaaatgacatagaattgatcaatgttgtggtggacatgctgcctaatgctgaggcatgttccaaggttcatgctcctattcttgactctgatgatccttcccaacttgaatctattttatcaaatcacgatccacttctaggtctttcattgacacccacaaaacggattacatctgttgactgtgatgatgaaccgaaaagctcttag

SEQ ID NO: 41373 - DNA, 672 bp, Glycine max
  Peptide Sequence Number=SeqID_133058
atggctgagaagacaaagaaaaaactggaggaagctgctcaaaccagaagcactgcggccgtgattgaccctccatctcccatcagacagcacgcatcacagggctcctttgtcccccatggacgtcaggatgtccttactgctgccattgggcgaccaaaacaccctggtcgtgtgcgtgctgttggagccggtgtgaccatcaagaaatactttggattggcttcacagacctcacgcacttcttcctccatggctcccaaagaactagagcaactgactcaacaaatttgggaccagctggaggagtcgatcacagaaaaagtgactcagcagctgatgttatccttcagccagatgcagtcccagcttcagtcacagatgcaatcacagggacttgcactgcctccagagcctgaggttggtccctcaactgctcgtgtcagcacaaaggatagttgtgttgatccctcagggaacgatccagacacaggtgactcagacaaatgtgggttgtacatcaaagaaaatcctccctgcctagttgccctaggaagagtttatgagggatccataatcgttcacaacatacctttgctgcatgatcaagtgaaggtcgatgttgaggaggttaaagatgcagatgctcccgttcctgtacccactgacaag

SEQ ID NO: 41374 - DNA, 546 bp, Glycine max
  Peptide Sequence Number=SeqID_133059
atggagtctatctttggaggggtgaagttcccagctcttaaaacattgtatgttgttgactgtcatagtctgaagtctttgccactggatgttacaaattttcctgaattagaaactctggttgttcaagattgtgttaatctggacttagatctgtggaaggaacaccatgaagaacaaaaccccaagttaaggttaaaatttgttgcattcgtgggtttaccacagctggtggccttacctcaatggcttcaagaaactgccaactccttacagtccttggctattaaaaactgcgacaatcttgaaatgcttccggagtggctgtcaactctgactaatctgaaagtacttcatatattagcttgtccagagcttatatctctcccggataacatccatcacctcaccgcacttgaaaggttgagaattgcctattgtcctgaactacgtagaaaataccagccccatacgaataggaatgatttgttgagacatataagcgttgaagctcctttggcaacccctggacgtggatcaggaatg

SEQ ID NO: 41375 - DNA, 93 bp, Glycine max
  Peptide Sequence Number=SeqID_133060
atggtgagtatgccacctgtcgcaacgtgtccttcgcgggcgagcgagggcgaggctcacgggtgcgctttccaaaggagaaaaggtcgataa

SEQ ID NO: 41376 - DNA, 483 bp, Glycine max
  Peptide Sequence Number=SeqID_133061
atgatagaagtctctacagaggccattgcctccctcgcccagtattatgaccagccgttgaggtgcttcacctttggggacttccaactatcacccatggtggaagaatttgaagagatcctaggatgccctctaggggggaggaaaccatacctcttcacaggtctcgcacctttttcgccaagaagtgaggcatgcttgcccattagaaagccaccgttcatgcacagagaaaggaagggtgaattgggatcaactcttagcaagaaaagaaggagcatctgtcaactgcttccctcgatgaaaggaaggaagaaccgaagttcttatttcatgcggaggatttccaaatgttcccttgatggggacaaggggttgcatcagctacaatcccgttcttgctataagacaacttggctatcctatgagaggagcaccactagaggaagagatcgtgcctgtcatttcatgaggtttcaataa

SEQ ID NO: 41377 - DNA, 147 bp, Glycine max
  Peptide Sequence Number=SeqID_133062
atgaagcttgcttctacattttccttggtgaagcttgatgtaatcctccctatgaagggaccagtccccagagccatgagcaggaggctccaagaggattgggctagagctgctgaagaaggccctacggttctcatgaatctgagg

SEQ ID NO: 41378 - DNA, 489 bp, Glycine max
  Peptide Sequence Number=SeqID_133063
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgccggtaaggctaaactgaaaggacaagttttggtgactgcgctcctccagccagttacctcggttcaagagttg

SEQ ID NO: 41379 - DNA, 464 bp, Glycine max
  Peptide Sequence Number=SeqID_133064
gtattattaggcaccaaatccctatgataggtggtatgatgaatgtgttgagtggtgcaacactcttttgtaaaatcactcatgcacccaacatcttcatgatttgtgtacatagggactcattaggtagtgatcaagggcttcccatggaccctaagagaataaaggtcattcctgagtggcctactccaccaagtataagggaaatttggggcttcaatgatgcaagctccattggagcttgtaagcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 41380 - DNA, 763 bp, Glycine max
  Peptide Sequence Number=SeqID_133065
atgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcagatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggag

SEQ ID NO: 41381 - DNA, 228 bp, Glycine max
  Peptide Sequence Number=SeqID_133066
atgtatttattctctatgtatgtgcttcaccaacttaaaagtttttcgaagggaaaagggattgttcatacagaaaatcaggcaggaaaaacactgacaaggggagccaatgcagctgttgttgggtttgcatactttctcgaatgttatcaaactcaagagtttacgcagatccgtgagagttccatagattggattcgtagactcgtaagagtttacttcatataa

SEQ ID NO: 41382 - DNA, 358 bp, Glycine max
  Peptide Sequence Number=SeqID_133067
aggactacacgtcctcgccttgagaggactacacgtcctcaccatcagagggctgcacgccctcacctccagaggactacatgtccttgccttgagagggctacacgtcctcaccttgggtgctagttaccctcaccgtcagagggctgcacgccctcgccttctaagggctacacgtcctcgccaacagagggctgcacgccctcaccttgagaggactacacctcctcgccatcagagggctgcaagccctcaccttgagaggactacacctcctcgccatcagagggttgcacgccctcacctccagaggactacacatcctcgccttgagagggctgcacgcccttacctttag

SEQ ID NO: 41383 - DNA, 614 bp, Glycine max
  Peptide Sequence Number=SeqID_133068
gtggacccttgggtactagtacctaacacctttagaggactgtatgtcctcgccatcagaggactgcacatcctcgcctacagagggctgcacgccctctcctttagagggctacgcgtcctcattttcattcctgggccaccccctaatattggagggcgaccaactgtgcgagcacatccagagagggaggctatcacgcatctactatgcataccggggcaagatttcccccgtgctgttgcaaaaagacgagtgcggaccatgcgcaccaacatgaccacccttacggatcacgtcgcttcactcctagtgtatccgatgaagtccaacagggccctggggtttccaactctagttacgggtctctatagtcctacagggtgcccgttccctcgacaagggattgtgtcgctcactcctcgtggatccgaagaaggccaacagggtcttggagttgccagctctaaatacgggtctctgtcagttctagggagttcctgtcgcccccagcaaggtcatcaggtcccccctcccgatcgagctttcatcaagaagttctgcgtctccaggcaggcgcagggcgaaacaccacagcagcctggggatggccg

SEQ ID NO: 41384 - DNA, 781 bp, Glycine max
  Peptide Sequence Number=SeqID_133069
tgatgaggaggctacattagagacccgacaggctggtgggcctcatgtccggttggggtggcttcgagacttgtatcagagccagtgcagcaccagacgatgggttgtagcagcccgcacggacctggcccagacaaggggattcgcctggggggcggctgcattagtccacatgtacgaccatctgaatgacgcgtcgcaggcctctacacgacagctgggcgtgcatacatccgtcgttcatgatgcttatgatgaggggagcccacgggcctgcaggtggcttacgggtaaggctcatattacggggatcaagggagccccgtatcggagacgtttggatgccctgagtgtgactgacgtgtgctggatgccctatggtgagcaccggcgagtcagggcctttgacttgatatcatcgtacactggccagctcagatggggtcagattgtggttgatgatatagatgaccagtggctgaattttccagaccatttggtgccttcaggggagctctgtgtagttcctggacaggtggcgacagactacatggagtggttttttcggatatcgcacccattcgtcatgcggaccgaggagactgttgcgctgagacatccgcctccccctcatcatgaggagttcgtcgagccacccatccccgagatttcagtcgcgaccgatctccctacgcattcagtggggatggctcaggatttaggagcgattgctgaggatttggagcgggtcatcaacctcaggatgtcactgaggcactga

SEQ ID NO: 41385 - DNA, 869 bp, Glycine max
  Peptide Sequence Number=SeqID_133070
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatcagaatgcaggtttaaacaatcgtcagaatactgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41386 - DNA, 295 bp, Glycine max
  Peptide Sequence Number=SeqID_133071
gaaattgctccgaaaaagctttctgcgaagaggtctaggagagacgctgcgactgaagggaccagtgccgcccccgagtttgatagccaccgtttccggagcgccgagcactagcagcgcttcaaggccatcaaaggatggtcgttccacagagagaggcgcgtccagctcagggaggatgaatgccctcagccagttcctgggtgacccactagtgttagaggaaggccaggagtgcgagtttagtcagaggaggaacagggctgacgagttcgacgaggaggccattgcctaa

SEQ ID NO: 41387 - DNA, 415 bp, Glycine max
  Peptide Sequence Number=SeqID_133072
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagatactagggcgtttctcccctggcgcttccctcgtgcgctctcttgttcctgcctttcgggtttaccggtgtcattccgctgttatggccgc

SEQ ID NO: 41388 - DNA, 96 bp, Glycine max
  Peptide Sequence Number=SeqID_133073
atgtgggctggttacgcatacacggagaagatgcactggcgacatcttggggatattcgtgggaataagcctagtgcagctgaatggcttgattaa

SEQ ID NO: 41389 - DNA, 854 bp, Glycine max
  Peptide Sequence Number=SeqID_133074
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataatacggcattggcttaaaatcaacgggattaaacacaaggagtcggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggaaaaaaaaggctgcaccggtgcgtcagcagaatatgtgatacaggatatattccgcttcctcgctcactgactcgctacgctcggtcgttcgactgcggcgagcggaaatggcttacaaacgggccggagatttcttggaagatgccagaaagatacttaacaggaaa

SEQ ID NO: 41390 - DNA, 584 bp, Glycine max
  Peptide Sequence Number=SeqID_133075
atggtgaaagttggaacctcttacgtgccgatcaacgttcattttggatttgtcaaaattggcccgtggttacttggtactctttgtggacacctgattatcttgcacccgaaattatccatcacagcttattgcgcaataccgtcgacctcggggggcccggtaccagcttttgattcctctgttcctcctgttcagctactgaaacgggtggtgttatccgtcacaattcgcacacaagcataccgagccggaagcatcagcgctggcaagtgtaaagcctgggggctgcccttcgccttcaggctgccaactgttcgggaaagggctgatcggtgcgggcctttgctattaagaacgccaacgcggcgaaagggggatgtgctgcaagttgcgattaagttgggtaacgccgggtttccagtcacggacgttgaattcgtccgatttacaggatttgctaaaattccgttgcctcgcttactgactcgctacgctcggtcgttcgactgcggcgagcggaaatggcttacgaacggggcggagatttcctggaagatgccaggaagatacttaacagggaa

SEQ ID NO: 41391 - DNA, 749 bp, Glycine max
  Peptide Sequence Number=SeqID_133076
tatgcatagtagcagtgtgatagcctccctttctagttgtgctcgcacagttggccctcctccaatatcagggggtggcccaggaaccgtgtggatgtcgagcacactgaaaatgaggacacgtagccctctaaaggtgagggcgtgcagccctctggagatgagggcatgcagccctctgctggcgaggacgtgtagtcctttcaaggtgagggcgtgtagccctctgacggtgaaggcgtgcaaccctctgatggtgaggacgtgtagtcctctcaaggcgaggacgtgtagtcctctaaacggtgagggtatgccccccttcgaaaatggggaacatgtgagggcgtgtagccctacaaaggtgaaggcacatgaccctttgacggcggggacgtgtagtcctctgaaggtgaaggtgaaggcacatgaccctttgacggcgaggacgtgtagtcctctgaaggtgaaggtgaaggcacatgaccctttgacggtgaggacgtgtagtcctctgaagttgaaggtacatgaccctttgaaggcgaggacgtgtagtcctctgaaggtgaaggcgaggacttatagtcctctggaggtgagggcgtgcagccctctgatggtgagggcgtgtagccctctcaaggcgaggacttatagtcctctggaggtgagggcgtgcagccctctggtgctgaggacgcgtagtcctctcaaggcgaggacgtgtagtcctctcaacggtgagg

SEQ ID NO: 41392 - DNA, 291 bp, Glycine max
  Peptide Sequence Number=SeqID_133077
atgggataccaattgggaaagagggtttttagtttatgtaaagaactcaaaaacttcgacatccttaccttcaggaacactcgaaaggtggcaacgccactaaaaaaggcacgactttggctacgtggcggtggtgggagcagcaggtccacttcggcttcaagtagcggtggtgggagcagcgggaaacaaaacgtcagggtggtagcgggacggagttcacggcgggatgaagtagttcaggcaatagtgggggtgctaggacggtgtacctacaagcaccgtctttga

SEQ ID NO: 41393 - DNA, 299 bp, Glycine max
  Peptide Sequence Number=SeqID_133078
aggaaccagcacgcacgcgccagcgcactgtggaatggatattacctacacctactccatatcgtctagtggagccaatccaagtgatcgaggtgacgtcatccgaggaagaccctaaggaggacccagaggagctacctcctgagcctgctatggatgctcttgactttctagagggtgatgaggacccactccctgaggtggattctcccgaggacgtcatgtcggcatttgaggcagactctatggaggagagcggccctggagagatggcgactagtggaggctctccatcatag

SEQ ID NO: 41394 - DNA, 468 bp, Glycine max
  Peptide Sequence Number=SeqID_133079
atgtctcttgccactttatttggtaaattgcaggaacacgagatgaaacttcaacgcctcaatcagaatgaagaaaatgacaaaaagaagagaagcatagcccttaaagcctcatcttcaatacaagaaggaaacgaagaagatgattcagatgatgaagaagatttttccttctttgttaagaaatttcagaaatacatcaagaaaagaagaattgacaggcgtcagaatttcaataatggaagaaaatcacaagatgattctcaagccaactgtccatcaaataaagaatggtcggagaaaagtgaaaagaaaagatttgacgaaagaagaactaagaaagcatacattgcatgggatgacaatgattcatccgatggttcagaaatggagattaatcttctaaccaaatattataaagtgacgagaacatctctcaaggatgataaacaaggagaaaaagcatga

SEQ ID NO: 41395 - DNA, 168 bp, Glycine max
  Peptide Sequence Number=SeqID_133080
atggcctcctatggtgtggcatcacctctctctcttcctttcttcattccgctgccattcatcttccaagaagcaaaggaatccattgatgaagaagatcctaggcctacaagctccaatggagcttacatcaggagggtatatcccttgtggatctttggcttgtaa

SEQ ID NO: 41396 - DNA, 399 bp, Glycine max
  Peptide Sequence Number=SeqID_133081
atgactatacaaatgcaacgtttgttgaaccgtaacaaagaagagctctacagacaaatagccaaatcttccttgtttactcttaaacctctatcccctagagaagtgtgtgatgaccaaatcagaatgagagaaaagagagaacaagagaaagaaaatagtgaggcaccacaaaggaatatgaaaaagaagagtgatgcacccgaggaaaagagtgatacacataagagagagagtgatacacatgagagaaaattttgtgccatcttgctaaacctatccaccaccacaaagatagagtctacacctctttgggttctaggaagcctaaggacaaagtccatactaatgtctacccaaggtgcagatgggatgggtaagggtgtgtatagcccatga

SEQ ID NO: 41397 - DNA, 1328 bp, Glycine max
  Peptide Sequence Number=SeqID_133082
tacacgtcctcgccattagagggttgcacaccctcgccttcggatggctacatgtcctcaccttcatagggctacatgccctcacctttagaggactagaattcctcaccctcagaggaccaaacgtccttgccttcaaagggctgcacgccctcgcctttagagggctgcacatcctccctttcagagggatgcacgccctcgccatcagagggttgcacgccctcgcctttagagggctacacgtcctcgtcatcagaggactacacgtcctctccttcagagggctacacgtcctcaccttcataggacaacatgtcctcacctttagagggctacacgccttcgccttcagaggaatacacgtcctcgccatcagagtactaaacgtcctcgcctttagagcactccacgtcctcaccttcagaggactgcacgtcctcaccttcggagggctgcacgtcctccaatttagaggactacacgtcctcgccttcagaggactacacgtcctcaccttcagtggattgcatgttctcaccctcagaggactacacgtcctcaccttaagaggactacacgtcctcccattcaaaggactgcacgtcctcaccttcagtgggctgcacctcctcaccttaagaggactgcacgtccccaccttcagagtgcaacacgccctcgccataagagggctacacgtcctagccttcggtgggctgcacgccctcgtcttcagagggctgcacgccctcaccttcagaggactacacgtcctcaccttcagaggactgcacgccctcgccatcagagggctacacgccctcgccatcagagggcagcacgccttcaccttcagtggactgcacgtcctcagctacagagcgctgcacgccctcatcgtcagagggctacacgtcctcaccttcataggactacacgtcctcgcattcataggactacacgtcctcgcctttagaggactacatatcctcgccattagaggactacacgtcctcgccttcagagggttacacgttctccccttcataggactacacgtcctcacctttagagggctgcacgccctcgccttcataggactacatttccacgccttcagaggattacatgtcctcacaatcagaggactacacatcctcgccatcagagtgctgcatgacctcgcctttagagggctacatatcctccctatcggagggctacacgtcctcgccttcagaggactacacgtactcgccttcatagaactacacgtcctcgcctttagaggactacagatcctcgccttcagagggctacacgtt

SEQ ID NO: 41398 - DNA, 158 bp, Glycine max
  Peptide Sequence Number=SeqID_133083
gaaatcatgtgcaaaataaagtcatggtgcagctatggtttggaattagggtgaaagaacccggtggaccattcggtcccaccatcaaatcttgttcggagccccatgaattgattgccattcatgcatcctccaccatcgagtccggagccccatga

SEQ ID NO: 41399 - DNA, 267 bp, Glycine max
  Peptide Sequence Number=SeqID_133084
atgtatgcatttaagaagacgacatggaccctccatcgaggtatcatccccttcgacaaacatattgcggcagtagggactaccagcaacaatatgttatcaaagagaaaaactctagatgagggttcactgttatcaagcaagtcagagacccaacatgaccacagattcacctccactccttatgttcccatggacccgggtatagggccccttttcaactcaccgtgtgtgcaaaaaggtgttggtgttgtgtgcatcaaatga

SEQ ID NO: 41400 - DNA, 328 bp, Glycine max
  Peptide Sequence Number=SeqID_133085
ttgaacaaatgttggggaggtgtcggtgttgaaaatgtgtttgacaccgcaacacttcaaagaagagagatgtttgtatttgatactttcatggtgacatttatcattgctgcttcgtgccttctagcgggttctgtgaggaacgcgtaccacaccaagtaccgtgatctcatgggagagagagcaccttcatgccagaccttgaggaagggagtgtttggagctggagctgccttcattgttctcacaggcataacctcagagctctattatgttagtttttcaaaagctaataataatggtccccctccctatgctagggacactg

SEQ ID NO: 41401 - DNA, 315 bp, Glycine max
  Peptide Sequence Number=SeqID_133086
atgtctcctccacctctagaacatcacaatcactcacaaactcatcttaagttctcaggacgacttcctcttcaagctcggttctctacaggtcttcacacagcaaaatctctcaaactctctggaacttggacctttctctctctagaaaaccctagacatcttagcgcgtgcttttctcgctcagcggatggactgaagcggtgcgcttcgctggatgacccttcgcttagcgcaaatgcacaactcatccttcttccagattcttcctcgcgctcaactgaggagtgttgcgctctgcggatggctcgctaa

SEQ ID NO: 41402 - DNA, 927 bp, Glycine max
  Peptide Sequence Number=SeqID_133087
atggatgtttgtgtttattggaggagggtgtgtgccatttttgttttaagagtagcatttcttggtaaaactaactttccaaatgtttgccttcgtaggaaatggccccgagggaagcttgcctcaaagaggtccaggaaggataaggcggccgaagggactagttctgctcctgagtatgacagtcaccgctttaggagcgttgtacaccagcagtgcttcgaggccatcaagggatggtcgtttctccgggagcgacgcgtccaactcagggacgacgagtatactgatttccaggaggagatagggcgtcggcggtggacatcactggttacccccatggccaagttcgatccagaaatagtccttgaattttatgccaatgcttggccaacagaggagggcgtgcgtgacatgaggtcttgggtaaggggtcagtggatcccgttcggtgcagatgctatcggccagctcctgggatatccgttagtgttggaagagggccaggaatgcgaatatggccagaggaggaaccggtctgatgggttcgatgaggaggccatcgcccagtcactatgtataccggggcaggatttttcccggactgctgcagggaggcgagtgcgaatcatgcgcaccaacatgaccaccctgacccagatatggatgacgttgctgctcagcaacatcctgcctagcgatcataatttcgacctccctctgccgaagtgtcagctggtgtacgccatcctgacacggatgagtgttcatgtggctcagttaatcgctgatgccatctatatttttgcaggtatggcgcctaccaggcaccctttggacccagataagtccaacagggccctgggatttcccgcactgatcacaggactctgccagtcgttcggagtccccgttgcacctaccaag

SEQ ID NO: 41403 - DNA, 639 bp, Glycine max
  Peptide Sequence Number=SeqID_133088
atggtcattgaccaatccctcttctatgatttgactcaattgactagtgaaggtgtaccatttgaaggtgcactagatgatgattggaaatttgatttttccatgcataatgcccatcggttggtttgcaccaaccaagcggatatgactagaaggctgctttccggctcattggctcttgaaagccgcatccttcattatcttattgttcgtatcttactcccaagatcttcaaaccatgcacaggtttctaaagaagatcttatagtcatgtgggcctttcatactggccgaaaaattgattgggcacatttagtccggtatcgcatgcataaggtattgcgattaaatgctcttttaccatatccacatttagtcactcttttccttcaacatttcaacatccctcttgattctgaaccatatattccaatcaagagatctttcttgatcggtgctgttgtggttgcgtcctttggttaccgcaaagagcgtgatggatcttgggtaaaaaaggatgctcaaccaaatgatgatgaaggacaattaccgattgaaggggactcttctctccttcaaagtttgatgctttggaacaacaagtggacatgcgattcgatgcaatggactcaaggatga

SEQ ID NO: 41404 - DNA, 464 bp, Glycine max
  Peptide Sequence Number=SeqID_133089
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccctggttcaaactcgcccagagcatgatcccggggctcttacgggcttcccccataggctgagcaaagggtgcatgccccaactagggttgctagccttcaaggggaacaggaacaaagtggttgacattctcgttgggcacgtgcagtgcattgggtggtgtatagttgggag

SEQ ID NO: 41405 - DNA, 101 bp, Glycine max
  Peptide Sequence Number=SeqID_133090
atgaagaagattatccagaagatgaccgtgtcatacaaagattggcacgagatgctcccattcgcgttgcacagttaccgaataggattttttcagccctt

SEQ ID NO: 41406 - DNA, 249 bp, Glycine max
  Peptide Sequence Number=SeqID_133091
atggagcgttatctacagcacttggttcgccagcaggcggccaaccaccgggtgcaggggcagggtttcgctccttttgcaagccctactccagagcagtttggggctgagatcgcatggcccggagactggcctgaggcccaggcaggggaggagcacgtaggatcccccggtgaggtagaggaggcccgtatggatgaagaaatgattgacttgctcggtttcttgggaggaagcggagccacgtga

SEQ ID NO: 41407 - DNA, 748 bp, Glycine max
  Peptide Sequence Number=SeqID_133092
gtctgtatcccggcaagctgcggttaaccgagctgaaaccggcgcaggaagcggctatcgcctttggcatcagccgcagcgagccggaactgcaggacatcatgaacaaagcgctggccgcgattccggccggcatgatgaccgatgtattaacccactggcaggccacgcccgccgcgcatttcgacacctggaagctgtaccgtcaaacggacgcgccgcaccaaagcgctgctgcgccaggaaattcagctgcgcgatcgcctgatcaatggtccgccgcggccgttttatgtggcctcgctggatgggatgatcgtgcacaccaatccggcgtttacccagtttttcaccccggaagagcaaacccatctgggctattcgctgaatttgttatcgatgacgggcggcagaagcgtcacatccgtcactggatgacgtcgtataccggcgatgaagtcggcagcggcggactgatttgtggctggcaggatgttaccgactacctgcaattgctggaagatctttcgctggcacgcgaagccaccgaactggccagtcagagcaaaagcgacttcctcgccaccatgagccatgaaattcgcacgccgctcagcgcggtgattggcctgctggaactgcagacgcaggaaggccgcgccgataccgaactgattcgcgtggcgcacgaagcggcggtcagcctgatggatatcgtcggcgacattctcgatatggcgaagataga

SEQ ID NO: 41408 - DNA, 550 bp, Glycine max
  Peptide Sequence Number=SeqID_133093
gatccccgcccgggtgcagaacagtggcaccgatgactacgaagggcaccaggcgatcaacgtcccgcgtctgcgcgccgcactgcaggccgattacagcctgccggtcccaggcctggccctgctcggcggcgcccgctacagcgccagcaagtatgcaagccaggcggggaacgtggaggtgggtggctatacggtgttcgatctcggcagccgctatcgcacccgcatcggcggctatgagactgtgctgcgcctgacggtggataacgtcttcgacaaacgctactggcgggatgggctgcctggcagccccattgcgggacaggacgggttgcacagcagccccgagcccaaagacgaacaaacaaaaagcccccggcatttctgcgcgggggcttcttgtggaatgtggcgcccatgttgcccctgccccgtcgcggcaaggggcgcggcccagacgctgaccgaccggtcagccttatcgctttacctgaccggcgtcgctgggtaccgtcgtcgccacgtcacccaaaggactctgtcatga

SEQ ID NO: 41409 - DNA, 498 bp, Glycine max
  Peptide Sequence Number=SeqID_133094
atgccgatctccccctgtggaagtattagttggtctgtgtcgtcacgacatagggatcgcgccccctatgaggagtcccatggacccggagaagtccaacagggccctagggttcccagctctgatcatcaggcccccattaaccaggctttcatcgagaagtactacgcccctaggcaggcacagggcgaggcaccacaaccgcctgagggcggccagcagcgggcaacagacgcaccgccaccacctccggagtccacctcagctcatcttcaaaggctgaagcgtagcctacgacacgtggccgaccagcaggcgaccaagtccaaagccaaagacattaaagaagtgcaactaggaggcaacctagaattggctgcgaagaagctccccgtgaagaggtccaggaagggcaccattgaagagagttccagtgcagccccacaagccgacacaggcttcgaaaaacaccaattccagagtgtggaacatcagtag

SEQ ID NO: 41410 - DNA, 933 bp, Glycine max
  Peptide Sequence Number=SeqID_133095
atggagccggctatagcgaagggcctctataataatgtaaaaggctacaatttgaagtcttttgatgaaaggatcataccagagcctattttagatgagttcttaaaaattggactcatttctccagaagatgtcacgaatgcagctgggtacgcgaaagctaatatcatattctattttaaaaatagagaagtaggtgatatcgctaaaccactaaataaacagtctattcccttaacgtttgatgatggtagtcctatttctaagtcagagatatatgctaaggagttgctagaggaggctctctctgaatgcattaagccatcttctggagaaatcgatatcagtaatttacctgttaaaagtcttagttctacttctcgaaagtaccctaagaatataaccgttccaaggaaatcgggcaatatatccctgaggccgttcttggtggccgatactgagaccataattaacaaaaatagtcaacatgtaccctatgcggtcggtgtcatggttgttaatccggggattcccgttagtaggcgtgaaaggatcgatacttacttcagcgaagattactcttcaagaatcttcccaacctttgaagaaaggagctgccaaatgctcaaatcatttatctttagggtcgcggctattactcgacaaaataggtctgctaaaacaatctactttcataatttaggtcgattcgatggcatttttctacttaagcaccttgcattatatcatcctaattacacggtcaccccccttatgagagacaatagactctacgaggtagctgtctattctaaaaaaaggctattatttacgttccgagactccttacatctactccccggcaaactagatgaccttgctaagaatctatgccctgagttgggttctaaaggatctatttcctatgaggat

SEQ ID NO: 41411 - DNA, 172 bp, Glycine max
  Peptide Sequence Number=SeqID_133096
atgtccgttcgcagccttgggctctatggctcagatcacatctatcccccacatggaaaagggccacggtgcggccaatacattcaatggcaagggcggagcattgacattgtttgcaaacgtctggcatttgtggcacttccttacatggaggcaacagtcgctttccatg

SEQ ID NO: 41412 - DNA, 576 bp, Glycine max
  Peptide Sequence Number=SeqID_133097
gtagctgagtctccgccaaaaccacctccgaagcccgatccggaggtcgatgatccgctttatctgatgacattgaccatcccagagcttttcttgaggccttatcaagttagatgggatgccactgtggtcaatgtcttctacataaagcacgaagacctcttcgaaattgcacacggtggtcaatgtcttagcatatcagtgttacaattgttgattctgcatctcactgaaacatgtatgcgagtggggaattctgatatctatggattcctcgagccacagttcattcagaggtctgggcaatcacagtttgagtctgaaagttacataaagagttggatgcagagttcacaacgtgatgtctatcttggagcctacctaaatgggttccactgtaaccgacactggcagatggtggtcatcctgcccaaggaacacctagttgtctggttttgttcattgcataacaggccagacaactaccttaaggggattattaatagtgctatcaagggtcttgatgatgctccacagcctaaatcaaaggcttctgctaggtggattgtcgtcaag

SEQ ID NO: 41413 - DNA, 478 bp, Glycine max
  Peptide Sequence Number=SeqID_133098
atggttagaacacgaggtttaggtcgtgcgttaggaactggtagaggtagaggcattagtgaggatgtgcatcacgctgatgttcctcgacgttgcatgcctactgcttcagcacgcaggcaacgggttcatgtgcgtgaggacgttacagagagacctgaggatgtgcctcagttgcatgaggatgttcctcatgtgtctgatgctaccccagagatgacaggtgccgtcgatgttgttcacacagagggagtgactactgatgggagcttggggtcacctgctgcagatgagggattccccggtgggccacgcgacccatcggttttgaccgcgcctgagatcgaaggcatgattgctgccaccggattgagtccactgatcaggtgttctgttatcaccactgatcctggactcatattcgccttcgtcgagaggtggcatcgtgagactagcacgttccacctgccagtggcga

SEQ ID NO: 41414 - DNA, 552 bp, Glycine max
  Peptide Sequence Number=SeqID_133099
atgggggacgacaaaaggtcttcgtacgtcattgggatcagggtgaattctggagttggcctcgtgggaaagttccttatcgcattggaaccgacgccaaagtgggcgttgccggccgaacgagtcggggttggagctggagcttggggggcctccctctggatgggtgcgggtgctctaggttgtacaggtgctgaattggaagagtccccgacgcgagctgagaagctcggttgctccggtcctcctagcgttggtacttgtggaggagacgtaatcaaacttccctctcttcaaacctacttcaattctttccccggcgaataccatgtccgcaaagctggagggcatgtccctccatcgctgagcgtactctttaaaggtctcactttcctttttaaccatgttctgcagctgagtgcgattgggagccatatcgaaattgtactgatattgcctaaggaaggcagtaataagatccttccaagtgcagatgcgggaagcttccagattagtgtaccaaatgactgctggagatgcaattggttttga

SEQ ID NO: 41415 - DNA, 303 bp, Glycine max
  Peptide Sequence Number=SeqID_133100
atggaagcatgtttagcaatagaggacctattgcaacagatgatagaccaaggccggctggaagtcggcgatgaggggggtgaagagcagcacatatgcatgcaatccgcagatgaggaaagtcttagaaagcctaagcctttggtgatacatttcaccagagacgcagctccccaaatgccccgacacctctcggtagttagacctattccatttccatacaaaaacagccacgcagttctgtggaggtatgcgcctccgagtgaaaggaaggaaggagccaccgacgtcagctcgctgtag

SEQ ID NO: 41416 - DNA, 402 bp, Glycine max
  Peptide Sequence Number=SeqID_133101
atggaagttattggaaataagcagattaaaaagaaggggcaatttaatatcatttcaaagaactatcctttgaaaccagatgaaatcaaaaagaaatacaacctgaaggatggtggagaaagatatcttatttttacacaatccaaaaaagccattgcaagtgtagcagtaagctgtaaaaaaatacaagctggaggaaataagaatactttaaagctagaagagggagcagaaagatattcagatgatgtgcaaaaaggtggagaaactcatggtcatgatgctacagctgaacataaagaagctgctgttgctgaaaaacatggaacagaagctccaaaaacagacagtactgctgcagcaaaacccgtagaagctgaaaaagctaaagctgaacactaa

SEQ ID NO: 41417 - DNA, 231 bp, Glycine max
  Peptide Sequence Number=SeqID_133102
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggctcaatcatgtgttggcagtagacaaagaagcgatgtaactcgatccatcttctgccccaactttttgcaagctggttacttccatacttga

SEQ ID NO: 41418 - DNA, 636 bp, Glycine max
  Peptide Sequence Number=SeqID_133103
atgaataccctcgtcttcagagggctgcacgccctcaccattagaggactacacgtcctcgccatcagagggctacatgccctcgccttcgtagggctacaagccctcacctttagaggactacacgtcctcgtcatcagaggactacacgtcctcgccatcagagggctacacgccctcaccttcgtagggctacacgccctcacctttagaggactacacgtcctcctcttcagaggactacacgtccttgccttcaccttcgtagggctagacgccctcacctttagaggactacacgtcctcaccttcagagaactacatgtcctcaccttcagaggactacacgtcctcaccttcatagggctacacaccctcacctttagaggactagacgtccttgccttcagaggactacacgtcctcaccatcagagggctgtacgcccttgccttcagaggactacatgtcctcaccttcagaggactacacgtcctcgccttgaaagggtcatgtaccttcgcctttgtagggctacacgccctcaccttcagaggactacacgtcctcgccttcaaagggtcatgtaccttcgccattgtagggctacacgccctcaccttcagaggactacac

SEQ ID NO: 41419 - DNA, 414 bp, Glycine max
  Peptide Sequence Number=SeqID_133104
atgatctcatcttccctattggttgggattggggtgttgaaggcatacatacctttttcaaggtgtgatgattggagatgccacttcaaaaataaagaaatacatgataaattaagtgtggcaaagccttccgtagctagttaccttaggaaagagatacagccagagcaagaagctgatagagtgcatggattacctgcgcagcctccggtaaagttcaacaatatggtggttatatcactatcaatgaaactcaaggaagagcactgttctataggtttttcgaggccactcacaaaccagaacaaaaacccgctcacttatggctcaatggagaatcacaaaccagaaggtcacgaagtgagtgcagcaggagtaaacattgataatcacatgaatgaaggcagtggctag

SEQ ID NO: 41420 - DNA, 390 bp, Glycine max
  Peptide Sequence Number=SeqID_133105
atgcctgttcatagtcaactcatctcttttcatactagacacctattcactgaatatagctttaccaagtcacacaagttccccgagagttcgatacttagttcttaccgttttatactacttgcgcgatccggtgcacttgccgcaaccgaacaagtttttggcaccgttgccgggaacttctttctatttggaaaatctcccacaggcaatttagttcctctagacttggagattaaagctacattgagaaggaacagagccgagaggataagaaaattactgcaggacaagacagtagcgtccattcttgaggaagaaactcatttttctgattcttcattatccgactcaccatcattaagggaatccgcaacttatttaccataa

SEQ ID NO: 41421 - DNA, 258 bp, Glycine max
  Peptide Sequence Number=SeqID_133106
atgggctgcgcatacgccccgacgagggcggggacaaattcgtcagcggtaaatccgtcaacgaagaaccgtataagcaaaatctggaaaaagctggccaacgagccaacaagcctgcgggatgcgccaccgcctggcagccttctcgcggcgatcgatattgcggcaatcgatatcaagaacctgaatcgtcaggcatcggtcgctggcgccacgcgcctgccaccgtcatccggaaaatccggcgagcctcccctg

SEQ ID NO: 41422 - DNA, 312 bp, Glycine max
  Peptide Sequence Number=SeqID_133107
atggaggctatgaaagagaaaatggccacaatgatggaggccatgatgagcatgaagaagataatggaagccaatgcggttgcaattgccgctaccagactgttgctaagatatggtaggcaaagatttaggaagtacggacgatcccatgatgtgcaaattcaaaacgagcatgccttcccgccgtatggtttgcctctcaactatacgccacccaatgtggcgtacactcccaataagaatgtcaataactccactcctatacccattgagagccaacaaccccaaactgatcatgcacatgtctcctaa

SEQ ID NO: 41423 - DNA, 791 bp, Glycine max
  Peptide Sequence Number=SeqID_133108
atggcaggggtaataatgagaaaaaatacaacgccaatattcattggcggcgtcttgctgtcggcgttatccgccggcgcacaggccgagatcaccattctggataaaaacccgcagagcaatgtgttgctggcaccgctcagtttaaaggtgggcggcagcattcgccccgagtggatcttcaataacggcccggagccgggctatgacaaaaacggccacgacggcggcacgcgttttcgcttcagcggcgactatgcgctgacgcagaacacctcgatcatcggctattacgagtggggcgtcgatctggcgcacgcgctcagctgggacgggcactataacgaagacggcaagcgcgactatcagcgccagctgtacgccggtttcaaagacgatcgttatggcaccctgacctacggccatcaatacggcatctattattcggtggtcggcatcaaaagcgacgtctgggataacgatggccacgcgggcggcaccggcatcggtatttccggcgactacgacggcggcaataaaccgaaaaacagcatcaagtacaccaatgatttcgggccggtaacgctgtacgccaactatttattgccggaagacgatctgcacaccgcggataacctgatttatcgccgcaagggcgggggcgggctaggcttcgattacaaggtgacgaaagacttcaccttcagcgcggcctacagttataccgacgcgaagatcaaagacaatctgtacagcgaaaaggattatcaccagcagctgtccggcaccgc

SEQ ID NO: 41424 - DNA, 207 bp, Glycine max
  Peptide Sequence Number=SeqID_133109
atgactgaagcacgtcaaaagggggtacggaaagtaatgaaaacgagaataaaatacacaaaacaaatggggaccaccacggggttatgggaattttacggaagcattacgggtgtcccggaagcctcgaaatcccatttttcaacaaaacggggggtgtggtggccacctagctcgcccaggcgtgctaggttgcttcaaccttaa

SEQ ID NO: 41425 - DNA, 267 bp, Glycine max
  Peptide Sequence Number=SeqID_133110
atgattatgaggggccaagacatttatagtagccaagatgaggctactacttcaccttcctctagtgaaagtgaagaagcaaaaggggaagaatctagtgaagaaatctacccccaagaagatagacaaccattagtggttaaagagaagtgtaaggaggtgttaaggaaaaaaagcccagagtttcaagaacctcgggatttgaggtcaaatccttttcaagggggagggaatgatgcaatcctaccccgtaagggcattggatag

SEQ ID NO: 41426 - DNA, 210 bp, Glycine max
  Peptide Sequence Number=SeqID_133111
atgtattctcttgatttcaggattgtcatcatcataaagggggagattatggaagcaatgccttccaagattattttgatacaagaatcaagatcaagacaagattcaagaataatcaagatcaagattcaagattcaagattcaagaataatcaagatcaagattcaagattcaagaataatcaagatcaagattcaagattcaagtaa

SEQ ID NO: 41427 - DNA, 296 bp, Glycine max
  Peptide Sequence Number=SeqID_133112
atggccagaacacgaggtttaggtcgtgccataagtagagttgtaggcagagatagacctgctggcgatgttcctgagaggcgtaggcctactgcctcagcccgtagactacgcgttcatcagatgactacggagggacgtgatatggctgaggacgtcgctgacatgactgatgatgtccctgagcagcctacggaggcacctgagatgcgtgtggacgcacagggtgctgatagtggtgaggggtcagatggtgatgatgctgcagagggattccctggtggtccacgagaccc

SEQ ID NO: 41428 - DNA, 278 bp, Glycine max
  misc_feature (211)..(211): n is a, c, g, or t
  Peptide Sequence Number=SeqID_133113
atgttggataaacatggagttgtgggaccagcaaaacctgcagattggcaagatcatgaggttatgtgggatgctaccgtgttcggggtgtttaatgaagacttccccttgtacataaagcatgaagatttgtctgaaatagcacatggtggtcaatgtctcaacatctctattatacagttgtggattctgcaatcgcaatttgaatcanaaagttacatgaagaactggatgcagaattcagaacggaatgtctacataggagcctacatgaatgg

SEQ ID NO: 41429 - DNA, 1447 bp, Glycine max
  misc_feature (1420)..(1420): n is a, c, g, or t
  Peptide Sequence Number=SeqID_133114
gctcgtccgggtcgatggcgatctgtccgcagcggtagtcgacatcgaccgagccgtcatcgtgcacgaccctggtggcaccgttcgtgaggaacagcagcagcccgttgtcggtcacgacgggggaggcgccgatctcgacgagcgcctcgtcccaggtgcctggcgtcggcgagtacatcggctcggtgtcggccgtcccgggggtccagtggatgaggtcgtcgctggtcgcccagtagatcgccccctcaccgaagtacatccaccacttcccgtgcatctgctgcggcacgatgaccccggccttggaccagttgaagccgcgcgggtccagggtcttgaacgtgtcgaagtcgtcgaacaacggaccgtgcttggtccaggtgcgcaggtcggtcgaggtggccaggcacaactgggcgctgtgccgatcccagcccgtgtaggtgaggtagtaggtgccgtcgatgagcgcgatgcgcgggtcctcgcagccgtaccgctcgtagtcctccgatggcgacaggatcggcgcgtcctcgcgggtgaaggtcaccccgtccttcgaccgtgccaagccgatgtgggagacgatgtcgtcggcgtgcgcgcggtacaggagtaccacctcgtcgccgtcgacgagcgcggcggggttgtacaggttcgccgattcccagctgtcgccgcgagggcgcaggatcgggttgccctcgtagggccccttgacggctgcaccgaggtcggtggcgcggaagaagcgctggaacacgatgaacaggatgacgacggggaacgcgagcgctgttgccccggcgaggatggcgccgttggggttcgccgtggactgggccacgttggagatgtagttcgcgagcgacaccgccagcggctgcaggctcgcgtccttggtgatgaggaagggccacaggaactcgttccagggtccgatgaacgtcacgagcacgacggtcaccagcaccgggcggatgagcgggatcgcgaccgaggtgagcaggcggatctccccggcgccgtcgatacgggcggcttcgaagatctccaccggcagcgccttgaagaactgcacgaagatgaacaccgccgtcgtgttgatgaggaacggcaggatcatgcccaggtacgagtcgcccaggccgtagttcctggtgatctgcacgtagagcgggatcatcagcagctggaacggcaccatctgcaccagcagcatcagcacccagatcacgccgcgcccccggaagtcgaggcgggcgatggcgtagccggcgagcagaccgaataccacggtgcccagcagcacccctgccgtgaagatcagcgagttcgcgagcgagccgaccaggtcgatgcgcgagtcgatcgcgacgaagttgtcgacggtccacccgctcgtcgngaacagctcgtcgggggagttcgtcgg

SEQ ID NO: 41430 - DNA, 60 bp, Glycine max
  Peptide Sequence Number=SeqID_133115
atgagggaatatccagaaaggattttagggaatcgctctgattctatctctgttcgttcc

SEQ ID NO: 41431 - DNA, 291 bp, Glycine max
  Peptide Sequence Number=SeqID_133116
tcaagagggtccgcacttgacaatgaagaacacattggagaatggaggattgcactagagggtccacattacgcaatcatgaagaatggctccaaactcatcggtggaggatgcatgaacgaaaacgcaattcatggggctccgaataaaaggcgaggatggaggattgcactagagggtcctcacaagtcaatcatgaagcatggctccaaactctttggtggaggatgcatgaacgaaaatgcaattcatggggctccgaaaaaacgcgaggatggaggattgcactag

SEQ ID NO: 41432 - DNA, 816 bp, Glycine max
  Peptide Sequence Number=SeqID_133117
atggcttctcataaaaggaaggcactagcttcagtgtcccaggcacaatatgacagatcaaaattcacatcacaagatgccagggacaaatatgcagacaatattcttggccgaaaaatccttccagaaaggaatgtgaagatgttctatgccaaatttgatgcatttagaagggaagttgagaagaggaactggcataaggagctcactaacttctcagagggaagcattgatgttgctattgtgagggtgcgagggcacctaattaaatttgatgttgatgccctcaacaccttcttgaagacaccagtggtcatagaggaaggtgagagcttgcccgcctactctaggtttgctaatctgaggcctgttcctcaagagcttgtagcccgtctatgtatccctgggaggggatttgagctgaatgcagatgggctgcctctgaagattttgaggaagaatcttactacactggcccagacctggagtgttttatctttttctaacatagccccgacatctcatacttcagatattactctggatagggctaagttgatgtacgggctcatcatgaagatggatatgaacttgggatccctcatctcaggtcagatctctcttatagcacatcatgactcctcaaggctaggtttttgttccgcctcactcacagttcacttcttcttcttttcttttcttttcgaaacacgaaagtggggtcacgtgtgttatcggcaagcgcaccagatcgtcaagtattttaaattaaaacagagtgatccgagtatcgaacatagggaacttgtggattag

SEQ ID NO: 41433 - DNA, 246 bp, Glycine max
  Peptide Sequence Number=SeqID_133118
atgggagaaagaaataattcacaaagtcaagtcgtggcatatctatggttcggaattgtcgcaacctacccttcggcgggagggcgacgcgaggctcgcgggatgcgtgttccacgaaaggaatacgcgcggagtcgccaccaacgtttatttgaggaaaacgtcggaaaaaccggaaaagacgagatctacgaactttttagtgaaaggttcgggagttgtatttacgcacggggaaggtattag

SEQ ID NO: 41434 - DNA, 249 bp, Glycine max
  Peptide Sequence Number=SeqID_133119
atgatctccagacttgagagtggttttacacaaccaacggtcgagaatatccgctcaaaccttcaagctcgaggcaaaacaatcatgtcaaagaaaattgctgaaacgtctcgagctgatgtgagacccaagaaacccactgggggtgaagatccaagaagggaaacaagaagagaaggtcaaaagaagatgatagcactgagactaccacgacttcaaaacgctcgaagcatgcggtggtcgaattag

SEQ ID NO: 41435 - DNA, 494 bp, Glycine max
  Peptide Sequence Number=SeqID_133120
agtttgaagaaatcctgggatgcccactgggaggaaggaagccatatcttttctctgggttctatccctccacgacaagagttgccaaggtagtgaaaatctcagcacaagagttggaccgtgtaaagcaaaacagaaatggagtagtcggagtaccaaggaagtgtgtcctctttccgaatatggaagggtcagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcacacctttttctccaagaagtgaccacaatgcgagggtactccaaggagttcgcaaggcatgggatgcggcgtgaagaaaggacagagagcttaggggaagcagtaatgggatcatcggcggctatcataagtggctga

SEQ ID NO: 41436 - DNA, 381 bp, Glycine max
  Peptide Sequence Number=SeqID_133121
gtgagggcgtgtagccctctggaggcgaggacatgtagtcctctaaaggtgagggtatgtagccctctgaaggcgaggacgtgttgtcctctgaaggtgagggtgtgtagccctctaaaggcgaggacgtgtagtgctccgaaggcgaggatgtgtagtcctctgaaggcgagggcgtgcagtgtagaagtaaagcttcatggtgaatcaaaggtgattcaaaggtgttttgatgataaaaatgtgataacaaaagatgatgacaaagatgatgacaaaaagctcaaagatcaatcaaagaacaactcaagtgaatcaagaacaattcaagatttcaagataagaatcaagaagaattcaagactcaagaagaaagtctag

SEQ ID NO: 41437 - DNA, 378 bp, Glycine max
  misc_feature (372)..(372): n is a, c, g, or t
  Peptide Sequence Number=SeqID_133122
atggatgctatgtgtatgatttttctaaaatcatgggaagattgtggaagcaatgccttccaaggttattttgatgatgccaaagaatcaagagttaagcaaagtttcaagcaaagatttaagaatcaagtttcaacattcaagactcaagaatcaagttttaagaatcaagattcaagaataatcaagatcaagattcaagaagaagactcagtcaagataagcattaaaaagtttttcaaaacattgagtagcacaagaatttttcacaaaatcttttaccaaagagttttactctctggtaatcaattaccagaaggtagtaatcgattaccagtagctagcattgtttttcaaactgatttacaaagnctgtaa

SEQ ID NO: 41438 - DNA, 1156 bp, Glycine max
  Peptide Sequence Number=SeqID_133123
tgccgcggatgcgcagtcgttgctctccgccaacggattgtcgctggcggccttcgcgccgacgccgttgtggctgcccgagaccgcgtcgggctggacgctgtattgcctggatggctacctggtggcgcgccagcccgacggacgcggcgcgctgtatgcgcgggaaatgaccgatgacgacacgccgtcgacactggcgcggacgttggggccggacgccgccgcttgcgccgccggcgcccgccagtggatcggcgccgtgccggcgcagtggcgtggcgatgcgcccgacccggtgttgccggaggcggcctgcggcgtgatggccgatatcccctggagcatcgcggccgccgccgacggccatgcggcggccggcgcatggggctggggcagggcgaccgcgctggccatggctgcggccgcggtatggatggccggcctggcattgcaggcaacccggttggaacatggcgcgcaggccctgcgccagcaacaggcgcaggcgttgcgccaggtgtttccgtcgatcaccacggtggtcgatccgctggcgcaggcgcgccggcaattggccgcgcgccgcgccggcacgggcgatgactggcgcgaactcggggttcctgttgcgggcggcgcgcgaacacatggccttcgccgcgggcgacgtgctggcctggcgctacgaggcgggcggcctggagctggacatgccgcccgcggcccgtcccgggacgccggatgcgcccgccgacggcaagccggcggctacgcccggctgggtccaggcggcgcgccaggcgggcttggcggtccaggccaccgcgaccggttggcgcctgcgccgcgcgccggcggatgccgaggccgggaaggcggaacgctcatgacgctggcgcctcctcccagcccgctgggcctgccggcgctctggcgcggtcgctggcgcgcgcgccgccaggcctggcaagcccgtggcgtggcggcctggacgcgcctgtcgcacagcgaaaaacgcctgctggcgctttgtgcctgcgtcgtcggcgcggcgctgtgctggctggcggtgatcgaaccgtcgctggcgcgcatcgagcgcagccggcaagcgctgcggcagctggaagcgggcgcgcgcgaactcgatgcc

SEQ ID NO: 41439 - DNA, 333 bp, Glycine max
  Peptide Sequence Number=SeqID_133124
atggaagacaaggttgtgagacatgtgaatggccctttgattgtcacaaaaaattattgggcgacattcaagttggatgccaagatgcgaaaaccagtggtgcttctcctagttgtagggcaacctgcacaatctgcatcacaaaaagcatcaagtctttcgggttggattttgaaaatgttgacacacaaggttgacggcatgagtgagatcgggtcgggtgaaggtcatgtctctcgagtatgtcgtgttggtggtgggacgggttgggaaataacgtcattaggtgatgaagggatatattgtttaggtttggattgggtatggatgtag

SEQ ID NO: 41440 - DNA, 498 bp, Glycine max
  Peptide Sequence Number=SeqID_133125
atggtggttatttggaatcaaagtggtggtagtgtaactgggaaagttcaaggtggtggtgtggagaggctgcagaggcatttcatttggattgatcatgagactagtatgggttggcatattgtggcttgggagatcttaactcagcccaatacgctttatgcagtatcttccacagtggattatgatacttgtcctatctgttttgaggagcctgaaatggatttgcatctcttaagggactgtgggcagtctaggcatggtttctttttggggtcactgcatcaatggattgcaaagaaccttgaaaggggtcctcctcactggaaaaccctattcggagtggagcaaactggtccagttcgctgtcaatgcggatttatgcagatggaccttatgtggggtgcatcagtccgcttacccacccctacttctctcctcaagtggagacctccacctagtgggggattgagactatgtttagggactggactgtga

SEQ ID NO: 41441 - DNA, 534 bp, Glycine max
  Peptide Sequence Number=SeqID_133126
gcattctattatgagggaaaggctatcatgtcaaatgaagagtttgataatctcaaggaagaactcatgtgggaaggaagcagcgttgtcatgctaagttctgatgagcaaaaattcctggaagcttcgatggcttatgtgtctggaaaaccaattatgagtgacaaagagtttgatgagttgaaactgaggctaaagatagaagggagtgaaattgtagctgagggtccaaggtgcagccttcgtagtagaaagctgccggagccttttagtttcattttcacttggtttgctgctgttcccctcattgtgtggatagctctgtcactaacaaatgccattgtaaaagactttgtgattttaaagggtccttgtccgaactgcggtactgaaaatacctctttctttgggactatactctcaatttcaaatggtggttccaccaacactgtcaaatgctccaactgtggaactgcaatggaatatgattcaactacaagattgattacgttaccggaaggaagtaacgcctga

SEQ ID NO: 41442 - DNA, 699 bp, Glycine max
  Peptide Sequence Number=SeqID_133127
atgaaggacagaggacattgctcagagaagaaaattgattggaacagaaggcttcagaagcagcttatattagatgatcttcgcgttcgttcaatgcaaaacaggattcgaagagtagcctccacccataatgtagaagcttcacaaacccaaattccattatcttctggtataaacttgcaaaccttaaactacatagtgacaatgggattgggtagcaagaatatgactgtgataattgacactagaagcgacttgacatgggtccaatgtgagccttgcatgtcatgttataatcaacaaggaccaatattcaaaccttctacctcctcttcctatcaatcagtttcatgcaattcatcaacctgccaatctcttcaatttgccacaggaaacacaggagcctgtggaagtagtaatccatcaacttgtaactatgtggttaactatggtgatggatcttacactaatggtgacctaggtgttgaagcacttagttttggaggaacaacaaaggtctatttggaggagtctctggccttatggggttgggaagaagttacctctcattggtatctcaaactaatgccacatttggaggagttttctcatactgcttaccaacaacagaagctggagtttctgccaaacatccctttctgcattgtcagatttctaagcagtggtgagtggaagtag

SEQ ID NO: 41443 - DNA, 270 bp, Glycine max
  Peptide Sequence Number=SeqID_133128
atgggggagggatgttgtacgcagccgtacccttgcatatgcaaagaggctgtttccggattcgaacccatgaccaacaggtcaccaaggcacaactttaccgctgcaccaggactcgccctcagaagcatgactctcctgatgcttgtcagagtggtgcgatatcaaagccggaagagattggcagatcagtgccttcgggtgaaagggcagtttgttcgccaagtacaagatgatcatccagtagcagatgtgggtggtggttcttga

SEQ ID NO: 41444 - DNA, 1776 bp, Glycine max
  Peptide Sequence Number=SeqID_133129
atgggacagttgaagaatgcccttgtgcttgttgggtgtactgagtttcagccactgaacttgaatcttgattttgacatgccagaccagcaatatgactatggtgacccaattccaaactacacatttatgcacaatgcaacgacagcaccagacgtatcatactacgactacatcgtaattggcggcggcaccgcagggtgtcctttagctgcgacactgtcccaaaattacagcgtgttgctccttgaacgcggtggttcaccctacggcaaccctaacatctccgacttagctgctttcggtgctgccctctcagacacctcccctacctctcccgctcagcgtttcatctccgaagacggtgtcatcaactcaagagctcgcgtcctcggtggtggaagttgcttgaacgctggcttttacactcgcgctagccctcaatatgtaagggaagcggggtgggatggaagggtagtgaatgagtcgtacgaatgggtggagaagatagtggcatttgagccacaattgaagcagtggcagtcatctgtgcgggatggactaatagagataggtgtggtgcctaataatggcttcacttatgaccatattgatgggactaaagtagggggcaccatctttgaccagaatggcttcaggcacactgctgctgatcttctgcaatatgccaaacccactggaattaccctgcttttggatgccactgtgcataggatcttgtttagagtcaaagatagatcaaaaccaatggcccatggagtggtgtttagagattcattgggtcgtaggcacaaggcgtacctgaagcccgatccaaggaacgagataatcgtttcggccggtgcacttggaagcccacaacttctaatgttgagtggaattgggccggaagagcaccttaaagcccacaacatcagaataacattggatcagccattagtaggacaaggaatgtcagataaccccatgaacgccatctttgtcccatctcctgtccccgtagagatctctctgattgaggtggtgggcatcaccacttttggcacctacattgaagctgccagtggtgaaaactttgccggtggttccccaaaagactacggaatgttctcccccaagattgggcaactctcaacggtgcctccgaagcaaagaactccggaggccctagccaaggcaatagaagtgatggaaactctggaccaagcagcattcagaggtggattcatcctggaaaaaatcatgggtccaatatcaagcgggcatttggagctccgaagccgtgatccgaacgacaacccctcagtgaccttcaactacttccaggacccgcgagacttgcagagatgcgtgcagggcctgagcaccgtggagaagataatcgagtccaaggcattctctcccttcagataccccaacatgcctgttcctgtgctgctcaacatgaccgcaagtgcccccgttaacttgttgcccaagcacaccaattcttcactatctttggaacagtactgcaaagacactgtcatgaccatttggcactaccatggaggctgccaagttgctaaggttgttgatagggactacaaggttcttggtgtggacgctctgcgtgttattgatggctccacctttaactactcccctggaactaatcctcaggccactgtcatgatgcttggcaggtatatgggagtgaaaatattgagcgagagactaggtggtgcggctgctgctgatgaaacagagcaataa

SEQ ID NO: 41445 - DNA, 1041 bp, Glycine max
  Peptide Sequence Number=SeqID_133130
atggatcaagacgacgacgaagcaggaacaacgaacctcagcaccagcgacgccgacgtggcagagaaagaaaccacaaacaacctcaatggagtccccaaacagaacaacgcgtttgaagaaacaacaggttttcaagtcttgccgctgaaaaaggaggagccaacatattcggaccctgacacggagattgttccggtcaaactgccaaagcgctcctccacgaaggaccgccacaccaaagtggaagggcgcggccgcaggatccgaatacccgccacctgcgccgcgcggatcttccagctcacccgagagctcggccacaagtccgacggcgagaccgtccggtggctcctggagcacgccgagccggccatcatcgaggccaccggcaccggcacagttccggccatcgcggtctccgtcggcggcgcgctcaaaatcccaaccacctcatccaactccaacgaggaagccgccgccgccgccgcctcctccaacaagaagcggaaacgcccctctaacagcgagttcgtggacataaacataaacataaacgacgccgtttcaaagtcgtccggtctggccccggttcatgtgccgcagggcctggtcccggtctgggccgtaagtaaccccagcatggtgatccccgctaacactttctggatgatccctcaggccgcgaccacacctaacccctcgggtggagtagcgggccctgcaagccagcagcctcagttatgggccttatctccctccgtgttcaacgtcgccgccaggcccatatcgcctctggttacaaccaatattccagaagcccggcccgttatgacggcctgcagtaacggttccaactccgccgttagcacgagcacggtgggggctaagctggcaacgaaatccagcatggcacccagtgttagttctagcggaaccaagagtggcaagactcaaatgttaagggatttttcgcttgaaatttgcgataaacaagagttacagctcttgggccgctctgggactcacgcgcagagttag

SEQ ID NO: 41446 - DNA, 1596 bp, Glycine max
  Peptide Sequence Number=SeqID_133131
atgcgccagttatcaccaacctcaaatcccaaagtacaagatgagcccaacatgttagccaccttgatccccaaatccccaacatgtcaacaacaacaacaaatgcaaaatcaccataataataataataacaccactcatttgtccctttccctgaacgaagccaagtgcatagccaacatctccttctccatggtcctcactggtttattactctattcccggtccatgatctccatgctcttcctcggccacctcggagaactcgccctcgcaggtggctccttagccatcggcttcgccaacatcaccggctactctgttctctctggcctcgccatgggcatggaacccatctgcggccaagccttcggtgccagaagattcaaacttctcggcctcaccatgcagagaaccgttctccttcttctcgtaacctcatgcctcatctcattattcttctggctcaacatgaggaaaatattactcctttgcggccaagaagaagacatagccaacgaggcagaactctacatactctactctctccctgatcttgtactacaatcgctgttacaccctttgagaatctaccttcggagccagtcaataacgctccctctcacatgctgcgccgccgtttcgattctcctccacgtgcccatcaactacctcttcgtctcaatcctcaagctcggaatcaaaggcgtcgcgttaagcgccgtcgtcacaaacctcaacctcgtctggttgttgattgtttacgtagttgtctccggcacgcacaagaaaacgtggccgggtatttcgcgcgagtgcttccaggggtggaattcatggaaaacgctaatgaatctcgcgattccgagttgcgtttccgtttgtctggaatggtggtggtacgaaattatgattttgctctgcgggttgttagttaaccctcacgcaagtgtggcctccatgggggttctgattcaaacaacggccttgatatacatttttccgtcttccttgagcttcggagtgtccacgcgcgtggggaacgagttgggagccgggaatcctcggagggcgaaactcgcggcgatggtgggcctatgtttcagttttgtgttcgggctttccgctttggcgttcgcagtttcagtgaggaatgtttgggcttccatgttcacactcgatggacaaatcattgctttgacgtcagcggtgttgccgattattgggctttgcgagctcgggaactgtccccagacgacggtgtgcggcgtcttgagagggacagcgaggcccaaattgggggccaacataaacttgggttgcttctacctcgttggcatgcccgttgcggtgtggttgggcttctttgcagggtttgacttcaaagggttgtggctggggatgttggcggcgcaagggtcgtgtatgatgacgatgatgttcgtgttggcaaggaccaattgggagggtcaagcgctaagagctaaggagctcacagactctgattctggtgaggagaaaaatctaatggaagaagaagaacaggaggaggaagggtttttgggatcttgtgccaccaaagaaggttctgtttaa

SEQ ID NO: 41447 - DNA, 1229 bp, Glycine max
  Peptide Sequence Number=SeqID_133132
aagatgatcttcttaaaagcactagaaaagtcaaacataaatctaatgatgatgaaggaggagtttatgagaagagtgaggaggctgaaggttatgttaaggagatggatcaaccgtacaagaacaagcttttgtcgcataaaggggctattcctttctccccttttgatggaagacgtttagtgcaagccttggaaagggtttctcatggtgactatgttagggaagcaagtaggatatatgatgttgaagccaaactaaataatatctgggctcgtaaaggacgaagcttgtctagagaagaaggtggtcctagagggaaggtgagtggtgatggtagggttaaggctggcatagttcctccagttagggcagagtcgcaagtgcaaggcgtgaaggatataacattaaatgaggaaggagtggaagaagaggagcaacttgagccagaagttagtcaaagactttcctcttggaaagccaaacaactatcctttcttggtcgtgtaatgcttgtcaaatctatcctacaagcacttccttcttatgcaatgcaatctgctcatcttcctagatccgtttgtgatgaaccgaaagatgttggggagttcggattaaggccaactaggatggtgaacatcttttatatgatgatagtaggttggaccttatgtgcgtatagggatgatttatgggtccaaattctgagaacaaaatatgaatgtggtgatggcattgtacctattattgattttaatagagcagggtctaacttgtggaatgatctggccttgactacaataccttcttatcagaatgctagtatggtctctcaatatgttgataatcatgttcgtaaaaccagacatctcacggttgatgcttctagtcgaaactgtggcgaagatattgaaatcttagatcacatttttagatggtgtcctagggccagagttgtctggcaatggatggcaagcaatgggaaatctgatgttttggttataagcagaattttggaatcagctgatgtagtggcagaaagtatgaactatatgaaatttattgccctcgatgaagctagagttcaagacatgaagaaggtagctactagtgtagttctcaaggattctaatggtaaagtcaacttctattttgctattgatataggccattgttcaaatgtaattgcagaactttgggctattatgcttggaatccatattgtgtga

SEQ ID NO: 41448 - DNA, 138 bp, Glycine max
  Peptide Sequence Number=SeqID_133133
atgcgggtttggaagggtgggaaaatccgttatgagattgaggaaaagggagggaaaataacggatcacgttattgggaagagagggaccccagacgagatgagcagggacatggagaatatgaatgtgggtgtgtaa

SEQ ID NO: 41449 - DNA, 126 bp, Glycine max
  Peptide Sequence Number=SeqID_133134
atggtgatggtaagactaaacctttcaattttggaggatattagggatgatattgatttatgtttcaagcttgctaaggaggaatatgttatcattcttccaggatcaattcctctcgtgacataa

SEQ ID NO: 41450 - DNA, 450 bp, Glycine max
  Peptide Sequence Number=SeqID_133135
atgaatgaaaactggcaattagagcctgagccagaggaagctttagacacaaggaagaatgaacagggagtagtggaagtcttggtgaaatggaaagaccttccagactttgaaaattcctgggagccagtggaaaagctcagatcagaatttcctggatttcttcttgagggcaagaagagttttgaaggcgggggaattgataagcaacagatagtatacacgaggaaacatggtaagggaagtgtaggggatcatcccactagaggagtaactaacttagtggggaataactgtgagagattgagcagtagcacagaggatcaagaagcaggggacactggagcctggagaccagagggtgccagagaaagccagaagtggctggagaatgagatgccacaggaaatcagtgggttagagctccgaagttggactcagacaagatga

SEQ ID NO: 41451 - DNA, 258 bp, Glycine max
  Peptide Sequence Number=SeqID_133136
atggagacagcctctaacggcacaggggaattcctggattctgcttctagaagaggattgccagctcagcgtcatttgctttgttgcatcatgctctgtgttttcattcataacactgcaactcgagcttttggtgatccagcacttgcaattccattgccgaagccaaatacactagctccaggaacaaagttaccacctgcggttgataaagtatgtgaaccagctacgttcatagtcacgtacactaagctctga

SEQ ID NO: 41452 - DNA, 390 bp, Glycine max
  Peptide Sequence Number=SeqID_133137
atggcagcacagttgatccatgatcgcgtggtgatggagtgcctagagggtgtttgggagaccctcgaaggcaatgagaggtgccgattccggggcacaattcgactcattgctacttcattagtacatccggaggaacccgcacgcacacttcaacagcctgtggagtggatactacctacacctactccatgtcgactagatcttgaagaggacccagaagagttacctcctgaacctgctatggacgcccttgacttacctgaggatgatgaagacccactccctgatgttgattctctagaggatattatgtcagcatctgaggcagactctacagaagagaatggtcctggaggaacagtgaatagtgacgactcttcatcatag

SEQ ID NO: 41453 - DNA, 1279 bp, Glycine max
  Peptide Sequence Number=SeqID_133138
atggcggtggtaccttacaccaccggttctgcacctcttctttctcctccttctacttctagtgttgccacaaagctctactccggattgaaacttcaagctgcgagtcctttcggagctgcaaaacctaacgtaaccgctgagttttatggaaaagaaaagcttgaagggttggaggccaaaattgatgcttgcatggaagaaaagatagaatgtatggaaatttccatgactaagatgctgttaaggaaggtgttaggcaaacatctagaagatgaacaggaaagttctaactgcaatgagactatgagagagattcttccggaaatggatgtaatttggattatcattagttttggtgaaatattgtacgacagtaaaaaggtagaactgcctacctttaatgaagaagacccagcacctttgactttggaaaaaattatggcagccttggttgcagggtttgaaaagctgaggcctgcgccttgtaacataccaaaattgacggaaaggaaaagcaaggccctaaatgaagatggagaagtaattgctattgaagtggctaaagataataaggaagaaccagtttcctactttcagccttggagacagtatgctaaccacaatacatcaatggcacgtattcgaatgatgccaatagggactcctaaagtcccctataggacacctggtgaaggaacttggcaatgggttgatgtatggaacgccctttatcgagaacgtgttatcttcattggacaagagatagatgaagaatttagtaaccaaatattggctactatgctttatcttgacagtatagaaaactccaagaagctttatatgtacatcaatggccctggtggtgatcttacaccaagcatggctatctatgacaccatgcagagcttgcaaagtcctgtagccacccactgtgttggctatgcttatagtcttgcagcatttctccttgcagctggagaaaagggtaatcgttctgcaatgcctctatcaagagttgcccttacatcaccagctggagccgcccgtggacaggctgatgacattcagaatgaagcaaatgaacttcttagaatcagagattaccttttcaatgagttggcacagaaaacgggtcaacctgttgagaagattactaaagacttgagtaggatgaaacgcttcaacgcacaggaagcccttgaatatggactcattgatcgaattgtcaggccaccccgcattaaggctgatgcaccacgcaaggaagcaggcacag

SEQ ID NO: 41454 - DNA, 309 bp, Glycine max
  Peptide Sequence Number=SeqID_133139
atggctgatctctttacgtggctcatctccttcttcatccttattgccttaattgtactcgtcatttaccagttaatgtgcctggcagacctagaatttgattatataaacccatatgattcctcatctcgaataaacaaagtggtattgcctgaatatattatagtaggtgtcctatgcggcttctaccttgtaacagggcattggataatgtcattgatctgtgctccttacctctactacaatgtgagatttgtgactgcccaagaaaagagtaacttattgatggcacaagacaagccaatttga

SEQ ID NO: 41455 - DNA, 1752 bp, Glycine max
  Peptide Sequence Number=SeqID_133140
atggaggagaggattcaaaatgcaagcctaacagtatatgcaagcttgggacattgctttgtaaatggtttggagaaccgagatgcaactgcaattttcaattgcttacgtgcatatgctgctatagataacaccaagaatgcagaagaaatttttcgagctactgttgtggctccattggtacagaggattatcccacatggatcatcagctgtggttgctggatcatctggggatggtcttgaaaatgattatcaattaattaaggagtgcattgataaagactgtaaatttttattggaaatttcttcagctgaaaattcaggtttgcatgtctttgacttcttagccaattcaatccttaaagaggttctctctgcaattcagaagggaaagccaggtgcattttctcctggaagaccaacagagttcttgaaaaattacaaatcaagcttagatttcttggcttatctagaaggctactgtccatccagattatctgttgctaaatttcgatctgaagcaatttatactgaattcatgaagagatggaatattggagtatatttctctttgaggtttcaggaaatagcagggtctctagattctgtgcttacaacatccagtcttgtccctgttctaaattcagatgctggcgaagcaaattatcaaggtttaacattaaagcaaagtgttactctgttggagagtttgagatcatgctggagagaagatgttctggttctttcttgttctgacagattccttcggctatccttgcagcttctttctagatactcaagttggctgtcatctggactgactgctcgcaaaaaccataacacaagcactagccctgggtgtgaatgggctgtttcagctgtcatagatgactttatttttgttattcatgacatacgatatttggaggagcaggttcgtggtgattaccttcaacatgtgcttaagcttttgtcttcatgctcccctgatgttctggaaccaataaggcagagcattttactgggtggtcaatcattaaaatctttagagcctttagtcattaaagcagtggtggagtcactagttgaaaagtcagttgaggacttgagacaaatgaaggggataacagcaacctataggatgactaataaacctctacctgtgaggccttcaccatatgtttcaggggtattacgtccccttaagtgtggtgtcaggtctccttatgtggtggctcgtggtccacaagtgtacccctcgaatctatcccaacaattggtatcagagtcgatggttcaagttggtgaccggcttagacgagtatgcaagtaccgcaggtggccagaatggttagcggtacagcgtgccccgcaggcttttttggatggggagagagctacaagatatttggccagtgaaattaggaataaaatactcctttgtgctgcaactgagattactgaccgttattatgaattagcttctgaccttgttagcgtggcaagaaagacagagtcttcactccagaaaattaggcagagtgcacaaagacgagctggagcaagttcagatatctcagataacaatgtgtctgatactgataaaatctgtatgcagttgttccttgatattcaggagtatgcccgtaacctctctgcactgggggttgaagcagtcaatattgcatcctaccgttcattatggcaatgtgtggctcctgcagataggcaaaacacaattaatctctaa

SEQ ID NO: 41456 - DNA, 213 bp, Glycine max
  Peptide Sequence Number=SeqID_133141
atggagggaaagaagggccaaagactgtctcctccattacccaatcacaacaaccatttgcaaggagacacaaaaagggaaaatcagaaaaacacaggaaattttcctctcttcccacatacgaaagggaaaattcacacttggaggactcgtcgtgccaccgtcaccgccacctcacatcgccgccaccaccgtcacacgtattgcatgtga

SEQ ID NO: 41457 - DNA, 621 bp, Glycine max
  Peptide Sequence Number=SeqID_133142
atgtcatccttgagagaagtaaacattttcttgtcttttaatcatccctccattatgaatgttaaagaagtagttgttgttgatgattttgatggtacttttatggtaatggagcacatggagtatgacctgaaggggctgacggaggttaagaagcatccctttagcatgagtgaaattaaatccttggtacggcaacttcttgaaggtgtcaaatatctctttcatgtaggagcacctgaaattttgctgggtgctaaagaatactcaacagcaattggcatgtggtcagtgggttgcataatggctgaattaattgccaaggaaactctgttcaggggtaaaagtgaacttgaacaacttgataagatttttccaacccttggtacgcctgatgagaaaatttggccaggattattcaaattacctggggctaaagcaaattttgttaagcaactgtttaatacactaaggaagaagtttccagctgcatcgtttatgctgctaacttatgaccctgaaaagaggataacagcagaagatgccctccttcatgattggttccatgaagcccctcttcccaaatctgatttcaagccaatttttccttcttggcagtga

SEQ ID NO: 41458 - DNA, 735 bp, Glycine max
  Peptide Sequence Number=SeqID_133143
tgcaacatcggaacctatggctatcctacaccagcagtgaaaaagattgagtcttactatgatgtgccagagggagtggatattcggggaagatataatgcagagtttgcaaaaatcctcacaaaagatgctttgaaattcgttgctgagctgcaacgggctcttccggggtttgatcctgccacgaggtacataagagaacaggaatgggtgtgtgcacctgttccaccagctgatgcactctcaccaagctggaaaaatcctatgagaggccaagtgaagttgaaggatgctgtggctgggaccataagcttgcatgacaaagtaagaaacagggattacaagctcaatgatcaaacaacaaagctttttgtgcaaccaagaggacaggctgagagaagtgaaggcagtggtctcattccaacctgcatgaaggttttcaacaacaacatgggcaatgctcccaacctcatggaagatgctgccactgctgagatcagcagggtgcagaattggcagtggcttaagtatggagatggacttggcgtgaagatcgaagagatgcataggattgaaaaggaagtgggaacatacaagttcatgaaaggaatgtacaaggaggcttgcaagatcttcactcgccaatgcacgtcaccttcacttgatgattttctcactctggatgcctataattacatagtcctgcatcaccccagggaaacatcaaagctctga

SEQ ID NO: 41459 - DNA, 570 bp, Glycine max
  Peptide Sequence Number=SeqID_133144
atgggcatgggtatgagaattgccaaatcaggttttgaagctaatgttgcttctgagcctgaggagaagtttggattccaatcagggtcagacttcacacttaaagaatttcaacaatatgctaatgtttttaaagatttctactttggattgaatgatgccaatgaatatgaaaaacaaccaattgatgaggttgaggtgtattatgaagctgacttggaaactagatcacttggaagtggttttcctaagacatcatccttaactaagaatgagtcagatagatatgccctgtctggttggaatttgaataagttcccgcgactgccagattctgccttatgttttgaaggaagtgatatctcaggagttgtagttccagggttgtatgatggaatgtgctttccctcattttgttgggcttacctcgatgtcgacggtggagcacagcccaatgcacgtcctcaatgccgtcaaagcaaagctccaaagcacaatgcaaggacaaacaaggggatgaagaagaagacaactacgcaagaagaagcagagcgacccaataagaggtaa

SEQ ID NO: 41460 - DNA, 204 bp, Glycine max
  Peptide Sequence Number=SeqID_133145
atggtgccaatggtggtggcgctttctgccaggccatgccacgtggcgatggtgtcgccattcccgccagcgactttgctttttcccacatggcgttggagtcgccattcaagctggcgatttggccatggtcgtggcgccaatcaaagtggcgtgttgctttgccctagggttgcagctaggttgcaggttgcagggacgtag

SEQ ID NO: 41461 - DNA, 656 bp, Glycine max
  Peptide Sequence Number=SeqID_133146
atgccgtacaagtcttggccgccgttggcttcacggtgtatcagagtagttgtagatgaaagtgaacttggatcggaaggaaacaaaccaagaggcttaggcaaactgagaagcacagacaaaacgggaggatcaacagcgagagcagcgacggcaagagcgcgacataatatcttaaaggttttcagacttgagaggatgtttcggcgcaagaaaagaaatgagattaggattcggcctttaaaaacacttagggagttgctaggtgcacccagcaatattgctggtgcacccagcaatttattgaaagcttttctcctctcttctctcttccgcgaaaaagcattctgtcttcttctcttcttctccgcgaggcttctccggcttcatcttctccgcgaggcttgtcttccatttgcatttgaggacgccggaaaaaatggcggaagcttggtgacggtgagccttccggaagacccgttaggggttcttccggaacttccggaagaagatcttccggaagatttccggaagaagggttcttccgtaggtaatgaaacgacttccggaagaacagatcttccggaaactctcggaacacctcttccggaatgtttccggaagatgtacttgttccggaaacattccggaagagg

SEQ ID NO: 41462 - DNA, 522 bp, Glycine max
  Peptide Sequence Number=SeqID_133147
atggctgcggagttagggcaacaaaaggtggagctatccacccttgtcacgcgtgccgctaatgataagtcctctgatttgttagcgtcgctaacatatatcagtattatcatgaaatcatggaaagttttgagacagagacataatgtgttcttaagaggaaagtgcttaaaattatatataaagaaaaagaactctgaattactacttaaaggaaatgcttctaagattgatgttagtcattattttgtttccctgtgtgtttggaaacacagtgcaaatgtgataaaccacattcatcagaagcaacttgaagtaacttccaccttgtgtaaattttctaatgcagggggtcatattaacccagcagtgacgtttagattgttcttggaacgcaagctctctctgacaagggcaattttttacataatcatgcagtgctttggagctatatgtggtgctggtgtagttaaggggttcgagccacacctctatgagaacactcctctaacttacaaatga

SEQ ID NO: 41463 - DNA, 234 bp, Glycine max
  Peptide Sequence Number=SeqID_133148
atggcatttccttacatggatgcagcaatcactttccatggtgagccatatgctcccgctcatgaagaaaccggccgccaatctcctcaatgtccttttatcattttcagaagccctcagtgggtattctttgctttcaacgaatcacttgatattgaaataccaaggcttaccgtctcgttcctcttccacttgacaacaatgttcgggtctgccacgacaccagaattcaat

SEQ ID NO: 41464 - DNA, 612 bp, Glycine max
  Peptide Sequence Number=SeqID_133149
atggcattcttgggagaaacaagcaatcagacaattatgaactccacattagcttttatttttccaaatggttccattgttcacaacgacaatggtgtttattttcaatcctccactctagtaccttttcgagtacctaacgtttgtgatttccaaacgttaaaaaccagaatacacaatacccttcagctaaccaacgaacaatatttggatgaaatttactacaggcagccattcatagatacaggtaaccatcttcgctttcaatgtatgcaactgaaaaatgatgatgatgttaacacaatgttgttgtgtaataatcaattttcatgtgttggtccgattgagttattatgcaccattggtagaacaccagatggtatactaaacttacttgaagccactatgacccctactcatgatgccctactttattacaatgggaggtggaacatgccatgccaaaatgactttgttagttactcgttcacagaaaaaaatcccaaaaagtttgacattccttccggatgtaccatggatgaactgaaggatttgatcatacaacttgcgcctcaagggattcccccttatggtattcatcaaatacaaacg

SEQ ID NO: 41465 - DNA, 664 bp, Glycine max
  Peptide Sequence Number=SeqID_133150
cgcggcgttcctgaatgacgtgcgcgccacgctcgcgggcgtgaaggacgccacggtgcgggtgcgcgcggtgtaccagggcagggcggggcgggtcgaaatcggcctgtccggttcgcatttcatggggccggtgccgacgctgatcgcgcaccatgccgccagccatccacaggtctcggtgctgctcaatcgagatgaacccggcggcgcagctggaggcgctgcgcggccaccgcatcgacgtcagcatctcgcgcaccgcggtcgacgacgacgaactgcaatcgttggcgctgtggtccgatccggtggtggcggcgctgcccgccggccatcgcctggcggggcgcaagcgcctggccctggccgacctggcgcgcgacgcattcgtgatgctgcgcacggacacctcggcgttcgcccgcgagctggccgacacctgcgcccgcgccggcctggcgcagtcggtggcgcagcgcgtggccgaagtgccggcgcaactggcgctggtggcggcagggctgggcgtggcgctggtgccgcagtcgacctgcggtcacttcggcgcgcgcatcgcggtgtgcgcgctgccggccgcggtgggcagcggcacggtctacgcggtcacgcggcgcgacgacggcaaccgcgcgctgcgggc

SEQ ID NO: 41466 - DNA, 417 bp, Glycine max
  Peptide Sequence Number=SeqID_133151
atgaacgaaatgaagatgaaagctaaaaaaacaagaaatgaattaaaagtctcggattcgaaaacttacccgttgaagaatgaagaacgaacgaagaacggtgaagaacgacggaaaaccttcacggatttgctcacagaaacatctcggaagcgttacggaggcacctcggcttggattttcttcacggaaacaattttttttcacccaaaacagctgaaatgcatagccaagggggttagggatatttggaacagcctcccttcacctatttataggaaaaggggggaggaggttgccgctcagctcgccgaggcgagctgggttgcttcctccataagcaaccctgcttcgaaactgttctggaaggcccaaattacgaaatttgaaaatttctatttgcaaccccaatcttga

SEQ ID NO: 41467 - DNA, 552 bp, Glycine max
  Peptide Sequence Number=SeqID_133152
atgaccggaaggattcttgccatatcattggcttttgaaagccgcatcctccattaccttattgttcacattttgcttcctagatcttcaaaccttgctcaggtttctgaagaagatctcattgtcatgtgggcctttcataaaggtttacaaattgattgggcacaccttgttagatatcgcatgcataaggcattgcgattgaatgcacctttgccttatcctcatgttattacccttttccttcaacacttcaacatccctcttgattctgaaccctatgttccaatcaagagatcattccttataggcgcttcagtcatagcatcctttagttatattaaggagcatgatggctcttgggtaaagaaaggtgctagaaatgttggtgaagaaagacatgagggagaagattcatctcttctttcgaagattttggaaaggtttgatggtcttcaaacctttgttggtgagaggtttgatactttggaattgcaagtggatatgcgcttcaatgaaatggagtcaagaatgacaaaggttgaagaagat

SEQ ID NO: 41468 - DNA, 513 bp, Glycine max
  Peptide Sequence Number=SeqID_133153
atggtgcaaaagaaggaaaaggaactcagaggcagtaacaacgggcctatcggaggctaccataggtggctgaaagcctacacacaaggtctgaattggctcccgaatttgagaaccactaagggggtggaagttgaagctccggaggaggatgaagaggttcaagccctcagggagaacgccgagctgagagacgtaaatacagccaccaccaaggccttggaacaagagaccaaaagggcccatagggaagaacatggctggaacaaattccgaggggctctgtgcggtagtaacagcgagcttaagctccggagagaggaaagggaccaatcacgagtggacagtttgatcttgaaggatgagttgaaggtttgcctaaggtccaagaggagcttgtctcagtggttgtgcgagacggagaccaacatgttagccatcatcaacaagtaccaagaagaattaaatctagccatggcccacgagcataaagtggcggacgagtatgcctga

SEQ ID NO: 41469 - DNA, 501 bp, Glycine max
  Peptide Sequence Number=SeqID_133154
atgaaacaggccaatgtaacccaattgaagaaaacacttaagaaagtgcatgatatgggaaatcaacagcagcaaggcaatcagttcaacaaagatcaaggtggaccttcgaataggccaatccaacaagggcttaacatctctcagaggactactaagctggaagagactttgactcagtttatgcaggtgggacaactggccaagcagataactgacaagttatccaacagttttgtggcaaatacagagaagaatcccaaggaggaatgcaaagctgtgatgacaagaagtaaaaggtttgtggagaatgaggaagagaagagtgttggactcaagaaaaaagttgttgaagagaaaggtattgatggaaggaaaaatgatgtgagaggtgaaaataatcaggaaaaagagaaacaaataatggtcaataaaaaagaattgaatgaccaagaaaaagaaaaagaagtagaaaaagaaaaagaaaataaaaaaagttga

SEQ ID NO: 41470 - DNA, 321 bp, Glycine max
  Peptide Sequence Number=SeqID_133155
atgtgtggaagcagtgacttccaagattattttgatgatgccaaagaatcaagacttcaagaatcaagtctcaaagaatcaagattcaagaacaatcaagatcaagattcaagactcaagattcaagattcaagagaagaaatcgagaaacaacagtcaagacttcacaagggaagtatttttcaaaattccaaatatagcactgtagaagcaaagcttcatggtgaatcaaagatgatgacaaaggagatgacaaaaagctcaaagattaatcaaagaacaactcaagtgaatcaagaacagctcaagagttcaagataa

SEQ ID NO: 41471 - DNA, 571 bp, Glycine max
  Peptide Sequence Number=SeqID_133156
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctggatcaaactataggtgctctcaacttaatgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 41472 - DNA, 843 bp, Glycine max
  Peptide Sequence Number=SeqID_133157
atggcggatcatgtccgcggcggcgccgatgcagtgcgccgaggtcgcgcaggcggccgacagcgaatagctgacgcccttgatctggtaggcggtggccaggcaggccgagaccgtcgagcacatcgtgcgcggcaccatgtacgggccgaccttgcgcacaccacgttcgcgcagcaggccggtgcgcaggttgctgacctgctcggggctgagcccggcatcggcgatggcatcgcgcatggacaggtaggcgaaggccgccgcatcgctcatgaagcgcttctgcttgcggtcgatcaagcgcctccagatcgaggtcgacacgaccgccgacctggctgcgcagcccgcttcggcatggtcgcgcgcgctgtagatttcgcgatcatccacgtacatgcgggcgtccgactgggccatcaccagcttgcggttgatgacccggctgatgtcgatctcgtagcgcaccagcttggcgtccggcagtacctggccggtgaactttacctcgccgcagcccagtgcgcggcccttgccgggggcgcccagccaggtcaggaagaagccggtcagctgccacatggcgtccaggcccaggcagccgggcatcaccgggtcgccgatgaagtggcagccgaagaaccacaggtccgggcggatatccagctcggcgcgtaccatgcccttgccgtgcggtccgccgtcctcgtggatgtcggtgatgcggtcgaacatcagcatcggatcgttgggcaaacggccggcagcggtgccgaacagttcaccgcgtgcgctggccagcagctgttcgcggttgaacgcgtggagtttttgtcatga

SEQ ID NO: 41473 - DNA, 279 bp, Glycine max
  Peptide Sequence Number=SeqID_133158
atgttaaaccaaaataatgtccctaaatcctacactgtaatttacaaaacaaaagttgaaaggaaagatattgagctggtagacgaggaagaaacacagattggtgttgatcgttctagtgcaacctctaataaatgtgagatttataaggaggaagcacggaatgcagcacagaagcataaaccaaagagggtgaagagtgtcaatgctgatgcagaagcctttgacgatcactggaaaattcagattgctttatgcattttgaagccgaagcactag

SEQ ID NO: 41474 - DNA, 288 bp, Glycine max
  Peptide Sequence Number=SeqID_133159
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagacttgggagagatcagagatgtgagaaacatggatttaacagccataattgctcaacctgtgattgggtatccttgcg

SEQ ID NO: 41475 - DNA, 115 bp, Glycine max
  Peptide Sequence Number=SeqID_133160
gtacatgatgaattcggttataacagtgttgtatttcaatggaagggtatatgaagataatgatggtgtaatattcgaaggcagtaaaaaaccgattcagagtgggatcctctag

SEQ ID NO: 41476 - DNA, 315 bp, Glycine max
  Peptide Sequence Number=SeqID_133161
atgtacatcaagtatggcccaaaatacatcatgaagcatagccaacaaaacatgttatccaatgaaacaaaaacccccacacttattcccaaaacaattccaaagctccaaaattccttaaggatatggaaagggaaacaaggctcaaaagggctatcaaaggaattaattcaaggtaagtccatttggctagaagcttatgagaaccaaattgcctcaatcatttccaaatatgcatgtgaattaggaagcatcaacaagaatcaagccaaggctattgtgcaagcaatcaatggggcaaaacacaccaaatga

SEQ ID NO: 41477 - DNA, 270 bp, Glycine max
  Peptide Sequence Number=SeqID_133162
atgtcttactttggtgtcattcaagaaatttgggaggttgattatacatcatttagagtgcctgtttttaagtgtcagtgggtgaacgggacaacaggaagaccaagtggaatgaattaccataatgatgagtcaacccttgacattggtcaaatgtctagtttttcaaaacaattgccttcaatgaatgaagctgatgaagtggatgatggacatgcaaatcgtgtagatcatgatgaaggtctatgggaaaacatccctacaggctga

SEQ ID NO: 41478 - DNA, 459 bp, Glycine max
  Peptide Sequence Number=SeqID_133163
atgttagcgagatctcttgattctgcaattgcagttacctttggtttccattgcttgcttaaacatctcaacactttcttaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41479 - DNA, 375 bp, Glycine max
  Peptide Sequence Number=SeqID_133164
atgaagagagaatctcctctatccctgcattacaaactgtttgaggggacacatgtcccagacattgtctcgacatcagggaaagctgctgcctcaggtgctgtgtccaaggatactctgattgctgaactcaaggacacatgcaaggtgctggaagcaaccatcaaagccaccacagagaagaagatggagctggaacggctgatcaataggctctcagaaagtggcattaatgatggagaagcagctgagcaagaagatgaagcagctgaggaagaagtagaagcagccgaggaagaagaagaagctgctgaggaagaggaagatgcagcagaggatactgaatcagatgatgattctgaagccaccccatga

SEQ ID NO: 41480 - DNA, 199 bp, Glycine max
  Peptide Sequence Number=SeqID_133165
ttgtaatcaagagactggttgtctcttggattgtgagaattgtaatcaagagactggttgtctcttggatggtgagaatcttgaacacaagggtgagggatcccaaggtgtgttcaaagtctataaaggatttacagagagagtggaaaatctcaagtggattgctcgaggattagacgtaggcacaggaagtggttga

SEQ ID NO: 41481 - DNA, 462 bp, Glycine max
  Peptide Sequence Number=SeqID_133166
atgcctgaacaaacattaggttgtcaggtgggtaatttggtggccactaactcagaaggtgagaaaataatgggttttcgcatagtaggtattgttaggtggacttcgttttctacaacccaagcagcctccaagagggttgacgtaccaaaaggctatgctgcagtctatgttggagataagatgagacggttcacaattccagtatcatacttgaacgaaccttcatttcaagaattacttagtcaagcagaagaagaattcggataccatcatccaatgggtggtctaacaataccatacaaggaagaggagttcctaaacgttaccgctcacttgaatgagctgaaattcatgctaacggagacagatagattagatgaggcaaatttgtacagatggcattttcttttttgtacagaatttaaaacctgttggctgaatacaaaagacattctttaa

SEQ ID NO: 41482 - DNA, 669 bp, Glycine max
  Peptide Sequence Number=SeqID_133167
atgcgtagtgattgcttagtgcaattctccattctctacctttttcggagccccatgaattgcgttttcgttcatgtgtcctcctccttcgagtttggagctatgcgtagtgattgcttagtgcaattctccatcctcaaccctttttcgaagcctatgaattgcgttttcattcatgagtcctctaccttcgagtttggagccatgtgtagtgattgcttagtgcaattctccattctgaacctatttcggagccccctgaattttgttttcgttcatgagtcctccaccttcgagtttggagctctgcgtagtgattgcttagtgcaattctccattctcaacctttttcggagccccatgaattgcgttttcgttcatgtgtcctccaccttcgagtttggagctatgcgtactgattgcttagtgcaattctccattctctacctttttcggagccccatgaattgcgttttcgttcatgtgacctcctccttcgagtttggagctatgcgtagtgattgcttagtgcaattctccatcctcaaccctttttcgaagcctatgaattgcgttttcattcatgagtcctctaccttcgagtttggagccatgtgtagtgattgcttagtgcaattctccattctgaaccttttcggagccccatga

SEQ ID NO: 41483 - DNA, 394 bp, Glycine max
  Peptide Sequence Number=SeqID_133168
gcttcgttctctaccaaaaccgcgagccaagttggaagattccgcttcggttgaagggttcctctcggtgtggggtttcaatggagaacaatggcggtttgtggtggctactggtggctgtggatgatggagaaagatcttggaacgttggaaatgattttggaagaaagaaggagaagaaatggcatttttccaaagctacacgaaaagcaaaggctgaaacactcaagtgtttctgcttgcgggaaaggaagcgctcctcacacgccagacgtcatatcgaagatcgcaacggtcaggtcgtggacatctgtcctgtgaacctccagacaaatttcaagaagattcaacagttagcgaaggatgggcagcatttttatcgagacaacttcat

SEQ ID NO: 41484 - DNA, 525 bp, Glycine max
  Peptide Sequence Number=SeqID_133169
atgtgtagaaactgccggaaatcgtcgtggtatcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 41485 - DNA, 225 bp, Glycine max
  Peptide Sequence Number=SeqID_133170
atggcgtatgggagcccgtacctacagatgaggtgttttaagtggtcccaggatgtctattccacgcatggcgaagggccaaggggagctcagactatgaaggttgttaggaggagtgtgtggcacgtctacaaactcttgacatctgcatcttctggtaaagtcaagggcgtctggcttgagtgttggccagtagtagctagctcgcaacgctttggtggctaa

SEQ ID NO: 41486 - DNA, 507 bp, Glycine max
  Peptide Sequence Number=SeqID_133171
atgagaactttgaaaggccgaagaggggaaaggttccatgtgaacggcacttgcacatggcctgcccaccctggaaacggctcagccggaggtagggtccagcggctggaagagcaccgcacgtcgcgtggtgtccggtgcgccccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 41487 - DNA, 574 bp, Glycine max
  Peptide Sequence Number=SeqID_133172
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacgcctgatttcaaccaactatctattatgctttcatcatgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 41488 - DNA, 531 bp, Glycine max
  Peptide Sequence Number=SeqID_133173
atgggttctccacttgcctccactactcctcctcctcctcctccttctccttctcctcctcgtccttctcttacttcggacgcatcggcttcgatgtctgccgtgaagcggaaacgcaaagcctcacgtctacgatcgttgtccactagaccacctggtgttgagagaccagtggtgcatgttgatcctgctaccgggaaggccgacggttcccacaggaagaaattaagaacatatttggggattgtggcacgtgataaggtggacatcacctacgagaactggaaggaggcagaatttgatatcccagaggcttctgacaataggacgaaaaggaagttactacagaccgtgggggagagatggaggcagtttaaatcaggcctcacaaggaaatgggcccttgcagccaatcaggatggtgtcgaggacactgtctgtgacaaatacggcatcaacaaggaaaagtgggcccagttttgccagactcacagagacccttcttgggaggtacgttcctttgccatttaa

SEQ ID NO: 41489 - DNA, 1314 bp, Glycine max
  Peptide Sequence Number=SeqID_133174
cccaaaatcaaagccgatgccgaagctgccgcgcagcagctgggcggtaaagccgacctgagcgacagcctgctggaagaggtggcttcgctggtggagtggccggtggtactgacggcgaagtttgaagagaagttcctcgcggtaccggctgaagcgctggtgtacaccatgaaaggggatcagaaatacttcccggtttacgccgaagacggccagctgctgccaaacttcatcttcgtcactaacattgaatcgcgcgatccgcagcagatcattgccggtaatgaaaaagtggtgcgtccgcgtctggccgatgccgagttcttcttcaacaccgaccgcaaaaagcgtctggaagataacctgccgcgtctggaaaccgtgctgttccagaaagagctgggtacgctgcgtgacaaaaccgaccgtattcaggcgctggccggctggattgccgcgcagattggcgctgatgtcaatcacgccacgcgcgccgggctgctgtcgaagtgcgacctgatgaccaatatggtgttcgagttcaccgacacccagggtgtgatgggcatgcactacgcgcgccacgatggcgaagcggaagatgtggcggtcgcacttaacgagcagtatcagccgcgtttcgccggtgacgatctgccgtccagcccggtggcctgcgccgtggcgattgccgataaaatggataccctggccggtatcttcggcatcggacagcatccgaaaggcgataaagacccgtttgcgctgcgtcgtgccgcgctgggcgtgctgcgtatcatcgttgagaagaacctgccgctcgatctgcaaaccctgacggaagaagcggtgcgcctgtacggcagcaagctgagcaacgccagtgtggttgatgatgtcatcgacttcatgctgggtcgtttccgcgcctggtatcaggaagagggccacagcgttgacaccattcaggcggtgctggcgcgtcgtccaacccgtccggccgatttcgatgcacgtatgaaggcggtttcgcacttccgtacgctggaagcggcttcggcgctggcggcggctaacaagcgcgtgtcgaatatcctggcgaaagccaccgaaaccctgaacgacagcgtgcaggcgtccctgctgaaagagaacgctgaaattcctggcgacctttgtcaccgcgctgggcgacaagctgcagccgtacgtttgcggaagcagccgctatcaggatcgccctggtggagctggcacagctgcgcgaagcggtggataacttcttcgacacgtcatggtgaatgccgatga

SEQ ID NO: 41490 - DNA, 372 bp, Glycine max
  Peptide Sequence Number=SeqID_133175
agacaggcccagggggatgctccacaggccgcagacgcgccgccaccacatcagacaggcccagttggatcatttgatacggagcagtatttacagcatttggttcgccagcaggcggccaaccaccgagcgcatgtacagacccatgattgtctttaccagttgagcctcagcctgcagagccagggttttacttcttttccgtgccctactccggatcagttcagggcagaggtcgcatggcccggagattggcctgaggcccgggcaggaggggcgccagcagaggctcccgacgaggcagataaggcccgcgaggatgaggagatgaccgatttacttgatttcttaagagggagcggagccacatga

SEQ ID NO: 41491 - DNA, 87 bp, Glycine max
  Peptide Sequence Number=SeqID_133176
tgttgtttttcaacagtggaaattggtctgattctgatgaccttgataggacagggctaagttgtcgtactatcatgaggaatcggg

SEQ ID NO: 41492 - DNA, 352 bp, Glycine max
  Peptide Sequence Number=SeqID_133177
gtgtgatgattggagatgccacttcaaaaataaagaaatacatgataaattaagtgtggcaaagccttcagtagctagttaccttaggcaagagatacaaccagagcaagaagctgatagagtgcatggattacctgcgcagcctccggtgaagttcaacaatatggtggttatatcactatcaatgaaactcaaggaagagcactgttctataggttttttgaggccactcacaaaccagaacaaaaacccgctcacttatggctcaatggagaatcacaaaccagaaggtcaggaagtgagtacagcaggagtaaacattgataatcacatgaatgaaggcagtggctag

SEQ ID NO: 41493 - DNA, 324 bp, Glycine max
  Peptide Sequence Number=SeqID_133178
atgaccggccctctcgatgagtcgatctcttgctttctcataaaggtggacccttgggtactagtacctatcacctttagaggactgtatgtcctcaccatcagaggactgcacatcctcgcctgcagagggctgcacgccctcgcctttagaaggctacgcgtcctcgttttcagggccagtagtttccttttatcagtccctgggccaccccctgatattagagggcgaccaactgtgcgagcacatccagagagggaggctatcatgcatctactatgcataccggggcaagatttcacccgtgccgctgcaaaaagatga

SEQ ID NO: 41494 - DNA, 333 bp, Glycine max
  misc_feature (229)..(229): n is a, c, g, or t
  Peptide Sequence Number=SeqID_133179
atggcttgtcggccgcgattgacgaagggcgcagaagacgacgttagtctctgcgtgctatcaggcttttcgtcttacagacagcaaaaaagaatgatttatacggataaccactcgggtatttccgcccgtcagcgtgactcaaatgtcagtgatgacagatcttacagcaaaaagaatgtttatacggataaccactcgggtatttccgcccgtcagcgtgactcanatgtcagtatgacagatcttgtgagcgcgaaagatgacgtaaatctccgcgtgtcaacgggcttgtcggccacgattgacgaagagtgcagaagacgacgttag

SEQ ID NO: 41495 - DNA, 922 bp, Glycine max
  Peptide Sequence Number=SeqID_133180
atggcagtaaatcagagccagttaggccagatgttcgagcaggttttacggctgtcgaaagtcgacgccagccagagtgtcgccatcctgaaaagtcactattccgatgcacgcaccgtgcaggccgccactgatgctgcactacgattgggcgcgaaggtgtactgcattgagctgccggccttcaatcacccgacggcaatgggtaacgacatgaccgcctactgtggtgataccgcgcttaccggcaacattgccgcacagcgcgcgctggaaccggcggacctgatcgtcgataccatgatgctgctgcattcgccggagcaggaacaaatcctgaaaaccgggacacgaattttgctggccgtcgagccgccggaagtattggcacgaattgattttcgtgccccgctcggccagtaccccacggtaacggaatatggctacgcggatgagccaggccgctgggatcactggccgagcggcttcctgtttacctggccgaatgaagatcaggctgaaggcgtgctggtgctggacgtcggcgacatcctgctgccgtttaaatcttacgcgcgtgaacgtattacgctggagatcgagaaaggttttgtcacccgcattcacggtggctttgaggccgagtatctgcgcgattacatgcgctacttcaacgacccggaagtgtacggtatttcccacatcggctgggggctgcagccgcgcgcacagtggacggcgatgggattacacgacaaaaacgacggcatgtgtatggacgcgcgcgccttttacggcaacttcctgttttcgaccggaccgaacaccgaagtgggcggtaagcgcaaaacgccgtgccatatggacattgctctgcgccgctgcgacatcaaagtggacgatttgctggtggtggcggaag

SEQ ID NO: 41496 - DNA, 567 bp, Glycine max
  Peptide Sequence Number=SeqID_133181
atgagtcatcattcatctagtgttaatggcgagggaggcatatgtcacatcttagaactcactcccataggagagaaaagggaaagaaatcctcaagaggctaacattaacctcctatacttccatgggaaggacaatgtagaggctaacttagattgggaaataaaggtagagcaacaacttaaaaggaagtctacttcaaaatcttatggctctcactcttatccaatgaaagaccaaggtcaaggcatcttagtggtgacaccttctaagcccaaagatgataaagggaagacaatagaaaagcaaccccttaaggctagtatgcaagagaagactagctccatgaagtgctttaaatgtcttggaagagcacacattacttctcaatgccccaccaagaaaaccatgattatgaggggccaagacatttatagtagtcaagatgaggctactacttcaccttcctctagtgaaagtgaagaagcaaaatgggaagaatctagtgaagagatttacccccaagaagaaggacaacctttaatggttaaggaggagtgtaaagag

SEQ ID NO: 41497 - DNA, 366 bp, Glycine max
  Peptide Sequence Number=SeqID_133182
atggcccagctattatgcacaccggggcaggatttcgcccagaccgctacagggaggcgggtgcggatcatgcgcaccagcatgaccaccttgacccggacgtggaggacattgctggtcagcaatgtcttgcctagtgatcataactccgatctccctctgccgaagtgtatgccacccaccaaacaccctctagacctggataagtctaacagggccctggggtttccgacattgatcacgggcctctgccagtcattcggggttctcgtcactcctagcaaggtgcagggtaatgcacctcaggtcgcggacacaccgccaccacctcatcaggctgatcccgctgggtcactaggcatgtag

SEQ ID NO: 41498 - DNA, 557 bp, Glycine max
  Peptide Sequence Number=SeqID_133183
atccaattttagaagaagtcccacagatgttgtacttggaatgtgatccaattccaaaagctgttgagaatgaggatgatttagattatgtacctgttgctgaccatgaggaaggaaatgttggtactggtgagcatgttggtgctggagagcagagacatgctggtgagcagagggatgctgatgttggtgagcagaaagatggtggtgagcatagggatgctgatgctggtgagcagagagatggtggtgagcagagggatgctgatgctgatggtggtggtgaagagagagctgttggtgatagtgaggaggaaaaggaagttgacagtgatgagtggtttacaaatttctcttgtatgatgaatgaagttaaagctgaagttgagacagatggttatcattcagaggagcttaatatccccattagtagtgatgatgaagatgaggatgttgaaggagttcaagtgggaagaaagaatgataacagagggctggaggcaaaatgcaagaagggcattttggtgattgggaaaatctactgtggcaaagaatga

SEQ ID NO: 41499 - DNA, 600 bp, Glycine max
  Peptide Sequence Number=SeqID_133184
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccggtgaagttacagaccttgagaaggcagtatgaacttctacagatgagtgatcaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccg

SEQ ID NO: 41500 - DNA, 70 bp, Glycine max
  Peptide Sequence Number=SeqID_133185
gtgaatagatttaaggaaccttatctgaaggacgtcgagacacaacactctgataggatgtggcattggg

SEQ ID NO: 41501 - DNA, 852 bp, Glycine max
  Peptide Sequence Number=SeqID_133186
atgacccttaatcaattttatggtagggcaacacgtacgtcgagtagttcctcagcaacagtaatgcagcaacagtgggttgactttattggaaacataaaggaacaagtaaggaatgaatatgaagaacaacacaagaggagtttggaggaatttaagaaggagttgtccagtcagatcttcattcagttgagtcagatgggatcacaatactctccccttattgaggaggatttacaggcattggctgcacgtcttagcactaaaggaagtaatgtagaaactgctgatgttgacccatcaggcgacaaaaataaggtgacgccaaagtgcccttcccgacatcagagattcaatatgtcaagcagagatcttcaaacattcattgcatggccaacaaatcttgcgaaaaaagtgtcacatgaggagtccgatactagtccaaagaaacttcctgaaacagatgaaagggggacgaatgattttgaccatgatccgttgcgtcaactgattaagagcctatatttcatgtacgacacacttgttgagttgaagtgggatggcagcaaatttgggctttcaaatgttgatgcttcattcttcttgacattctctgatgtaaatgaaatagtagctggatacaaatgtttgaacatatctatactacagttatggatgttgtttttggatgagtggagctcaactttgggtcatgcttccgtgtatggattccttgagccacaatcgatacacaatgcaaaggatcgacgtgctgaatgtgagcattacttacaagcatggctcaaggaatcgcaacgagaggtgtacctaggagcttacttaaatcagtaa

SEQ ID NO: 41502 - DNA, 389 bp, Glycine max
  Peptide Sequence Number=SeqID_133187
atactgccacatttgctaaatggattctggacattggagatggaattataggtcatgaaaatgatggttatgctacaattgaaattcctgcccacctacttattactgaatatgatgatccaatcagtgctatagtcaaatcaacattcccagacttagatcagcaccacaataatcctcaattctttatatccagggcgaggctcacgggtgcgctttccaaaggaggaaagatgcgcggagtcgccaccaacgtttatttgtggaaaacgacggaaaaactaaaggaaaccggtcaaaatgaaaattctaagttcgggagttgtattctcggagaactggaggtgatgttcgtcattggaagtgcggtagacagactttgtggttga

SEQ ID NO: 41503 - DNA, 64 bp, Glycine max
  Peptide Sequence Number=SeqID_133188
atggctaatattttcccttccaagcaaatgaaaacatgccggtatcagccgaaacacaacttcg

SEQ ID NO: 41504 - DNA, 258 bp, Glycine max
  Peptide Sequence Number=SeqID_133189
acttatcaaggtaatccttgtggcatctacccagacttatcttccttcattggaagtggcgtctacccagacttatcttccttcaccggaagtggcgtctaccctgacttatcttccttcaccggaagtggtgtatatcctgacttatcttccttcactggaagtggcgtctacccggacttatcttccttcaccggaagtggcctctaccctgacttatcttccttcaccggaagtggcgtcatccaacctccgtag

SEQ ID NO: 41505 - DNA, 371 bp, Glycine max
  Peptide Sequence Number=SeqID_133190
gcaagggaagtcggcaaaatggatccgtaacctcgggaaaaggatgggctctgagggctgggcacgggggtcccagtcccgaacccgtcggctgtcggtggactgctcgagacgcttccgcggcgagagcgggtcgtcgcgagccggtcgggggacggattgggaacgggcccttcggggcctcttccccgggcgtcgaacagtcaactcagaactggtacggacaaggggaatccgactgtttaatacatagcattgcgatggtccctgcggatgttgacgcaatcgaaaccacagccaagggaacgggcttggcggaatcagcggggaaagaagaccctgttgagcttgactctagtccgactttgtga

SEQ ID NO: 41506 - DNA, 773 bp, Glycine max
  Peptide Sequence Number=SeqID_133191
atgactgcgatgcactacaaattggttaagcaactcaaagatgataatacattaagaaaaagctttattgatttagccatcaaaacgttcgatctatcctttgacgcctggtatcagcagggatactggagcgaatcctatatcccttacgctttcgttgataagaataaagttatcgccaacgcctccgcgaatattattgatctggtctggcaaggccaaccccgacgctatattcaaataggtacggtaatgaccaatattgattaccgtaataaagggcttgccggacagttgatacaacatatccttgatgactggcgtgacaaagcggatgcttttttcctgttcgccaactctactaccgtcgacttctatcccaaatttggctttacgcggaccgacgaatatcaatatgtggcgcccgtttcgcctactcccggtgacttccgtaaactggatatggatagtgcgcaggatatcgccctgcttaagcactactaccagaaatccaaccccttttcacagctacgagtggagaataacttcggtctgctgatgttttactgttcggcgtttatgaagcattttgtctactactcggagaaaaaccaggccgtcgccattgcgatgcaaagcgcccatgagcttatctgctttgatattttttgcgatgccggacaatccatggcgaccattatcaatgaactcgcccagccgcaatcgcaacaggcggtgctaggttttacgccgaaggaagcgcgcctgggcga

SEQ ID NO: 41507 - DNA, 843 bp, Glycine max
  Peptide Sequence Number=SeqID_133192
atgagctgcgctacatgccatttaccggaaaatgcttttacagaccttaaagcaaagtcgccaagtaatgttgaaggaaaaaccgtgttgcggaattctccttctttatacaacgcagtatttgctaaaagatttttttacgatatgcgtgctttttatatcgagcaacaggcagagcatgttatctacaatgaacaggaattcaatacgagctatgaaagtattattaaaaaattaaaggaaaagccggaatataaaagagcattccgtacagcatttaaagatgggaagatcagtaaagaaaatttctccaaagcattgagttcatatgtagcttccctttattcttttgaaagtgattttgatcgctttatgagaaatgagaaagaaatctcagatgatgctaaaaaaggattcaatttattcatgggaaaagccaattgtgcaacctgtcattttgcccctcatttctcaggattggttcctcccttctataatgagaatgaatcggaagtgttaggggttacaaaagcgccgatcagtaaactgcctttagaactggattctgatttgggaagagtgaaaagcccggtgaaaaaagaaaattcctggatctatgaaaattcttttaaaaccatgacagtaagaaatattgcgcttacaaagccttattttcataatggagcatttaatactctggaagaagtgctggatttttataatgaaggaggaggcgaaggtctggggttaaaaataaataaccagactttaccagcggataaacttaatcttaccgaaactgaaatgaagcagatcattgcatttctaaacgctctgacggat

SEQ ID NO: 41508 - DNA, 438 bp, Glycine max
  Peptide Sequence Number=SeqID_133193
atgggacatccgagtaaaaagttattgctgttttattttctcagagcatctgttcaaaatttcgagcatctcgatatactacgggacacaatcggatatccgaagcttctattcttgaatttcaagcatctcgatatactacgggacacaatcgaacatccgagtaaaaagttattgtcgattgatttttacctaagagcttctgttttgaatttcgagcgtctcgatatactacgggacacaatgggacatccgagtaaaaagttattgtcgttttattttctcaaagcttctgttcagaatttcgagcatctcgatatactacgggacacaatcggacatccgagtaaaaagttattatcgtttgattttgctcagagattctattctgaatttcaagcatctcgatatactacgggacacaatcggacaatccga

SEQ ID NO: 41509 - DNA, 462 bp, Glycine max
  Peptide Sequence Number=SeqID_133194
atgagtcatcattcatctagtgttaatgatgaggatactagtcataaggatcctttatctagaatcttaaatgagttgagttccctcaagttatggaaagaaaaactagaaagaaaagaaaaagtaaaaaagagggaagaaataaatcaagatgagagggaacaaataagggaagaaaaaagaaggaaaataataaaagagttaagaaaagaaaaacatgcctcatgtagtagtcatgactcttgtaagagcctaagtgaagaacttcatgactattatgaaggaaggcataggtcacgtcttagacctcacttccatatgagagaaaaggaacgaaagcctcaagaggctaaaattaacctcccatacttccatgggaagtacaatgtagaggcttacctagattgggaaatgaaggttgaacaactctttgcttgccatcatattagtgaagagagaaaa

SEQ ID NO: 41510 - DNA, 47 bp, Glycine max
  Peptide Sequence Number=SeqID_133195
atgcagttcagcgaagacgaagacttaccttgggtggccacgcgagg

SEQ ID NO: 41511 - DNA, 126 bp, Glycine max
  Peptide Sequence Number=SeqID_133196
atgaaggagtgttcatggttggatatgttggatatcagcttctttgacaaggaaaccaatactggtgaggttgttggaaggatgtcaggtgacacacttcttattcaagaagccctgggagagaag

SEQ ID NO: 41512 - DNA, 563 bp, Glycine max
  Peptide Sequence Number=SeqID_133197
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtaccttcaaatcaagctgtggacatgacagagagcattggactcacaaatttaaaagctactccacttgaagttctcctaactccacgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 41513 - DNA, 546 bp, Glycine max
  Peptide Sequence Number=SeqID_133198
atgcttcaccttcatcaccagatgattctctttgacctgagtactcacctgatccaaattgtgaacatattgttgatcagaggcctttcatttgtgcacataaatgatagagtcattagggcaaagtttgatgaaccaactgcaaattggttgaaggtattagttgaccttcatgataggtggtttggagagtttaagtataggtggtacccaacagaaaagcgagccattagaggtgtttttgagacaaaaggttcacgcattttgaaaaatgcaatgaacaagatcaagaatggtcaagataaaggaaaatggataccagccaatgttcgagccttgccttggaccaacattgggggttctacagatttcctaaacaagagttccattgccaaggcgaatggaactgttaatagaggagccttaacatattgggtggttccatatctactgcaactcactttgaaaagagaaatatcaacatcgtcaagagaaaatcctacaacattcgatagaggaagacacatctacacaggattcccttaa

SEQ ID NO: 41514 - DNA, 204 bp, Glycine max
  Peptide Sequence Number=SeqID_133199
atggctttgaaaaagctttccgcgaagaggtctaggagagacgccgcggatgaagggaccagtgccgccccgagtttgatagccaccgtttccagagcgccgagcaccagcagtgcttcgaggccatcaaaggatggtcgttccacagagagaggcgcgtccagctcagggaggatgagtacacaaattttcaggaggagatag

SEQ ID NO: 41515 - DNA, 371 bp, Glycine max
  Peptide Sequence Number=SeqID_133200
cgaggaagcggaagagcgcccaatacgcaaaccgcctctccccgcgcgttggccgattcattaatgcagctggcacgacaggtttcccgactggaaagcgggcacgcaagcgtgcgctgagcgaggcatgtggtgcgcttagtgagcatgtgtctcgtttaatgcatagactttctgcgcttagctcacagggcacgcttagcgagatgggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 41516 - DNA, 207 bp, Glycine max
  Peptide Sequence Number=SeqID_133201
atgggctcagaaatctaccttgaggttcatgagaaccctagggccttctttagcaactctagtccaatcctcttgggggtaggattgcatcatcccctcccctttggaaaggatttgacctcaaatcccaagagtagggtaaggtttgaaaacccctttcctaggcatcttcccatgagggaacatggttcctcaccaactcaatga

SEQ ID NO: 41517 - DNA, 162 bp, Glycine max
  Peptide Sequence Number=SeqID_133202
atgagcatgcatgcatatgcatttttgtcatcctatgagtcggaggataagcaaagatttggtcgataccacaccgaattcaaggcaaaggcccgtgatcaacatatcatcatcccacatctggctcaagacgttaaagaagcgctactaggaggcagccta

SEQ ID NO: 41518 - DNA, 761 bp, Glycine max
  Peptide Sequence Number=SeqID_133203
tgccgtgatcgatttccagcctgtgcgggcccgcggccaggcgccgaccctggtggaccaggtggtggcggccgtgttgcgcgccatcgaggcgcaagagctgcgtccgggtatgtccctaccttcggtgcgcgacttcgcgcgccagtaccaggtcagcaccttcaccgtggccagcgcctacagccgcctggtgtcgctgggctggctggcggcccgcccgggcgccggctaccgcgtggcctcgcccgacgcgccgccgcgccggggcgagccgcagtcctgggagccgccgcggctgaacgcggcctggctgctgtcggacatcttcgcggaccattccatccctatcaaatcgggttgcggctggctgccgggcgagtggctcaacgaggaagggttgcacatggcgctgcgccacatgggccgggtgccggccatgcgcatcgccaactacggccatccctatggctatgcgccgctgcgcgagaccatcgccgccacgctcagcgcccagggcatggaagtcgacgtgtcgcaggtgctgctgacccagggcgtgacgcacggcctggacatggtgatccgcacgctgctgcgtcccggcgacaccgtgctggtcgagcaacccgcctacgccaacctgctgcagatgctgcgcctggccgggctgcgcgtggtgccggtggcgcgtacgctggacgggctggattgcaagaggcgctggagcaggccgcgtcgcagcaccggccgcgcgcgct

SEQ ID NO: 41519 - DNA, 312 bp, Glycine max
  Peptide Sequence Number=SeqID_133204
atgatttgggtcccaaaaggatctgttgttcacactaacactcaaggacccaataaagtttgggtacctaagtcacatattgatcttgtaggaaccattgagaaaaaaagtgggtgctcaaaacatatgatgggagatgcatcaaagttcacacatatctctcccaagaaaagcggacatgtaacttatggtgacaacaacaaaagaaatggcaataactcaagctacagggctccaaatgaggtgattccaaaacaaggtgaaaggtctcgtcttgaaattcaatttaggctcaagaatcacttaaattga

SEQ ID NO: 41520 - DNA, 795 bp, Glycine max
  Peptide Sequence Number=SeqID_133205
atgaggggagcgccaacagaagagagtctctcgcccttccttgtgagagattttggcgcgcaaagtctcaaggttatacaaagagtccacaaggtgtggagaagtccggtgaggaaagacaaagagcctaggggcatccgtaatggcgtcatcggtggttatcatggatggctaagagttcatacgcgagggttagattggctctccaagttgaaagttatcaatgaggagaacttcgaagcttcggaggaagatgaagaagtccaagctctaaaattagagctggggaagacaagactcgccaaagaaaagttcaagtcagccgccacaaacatccggaaagagtgcaccgagttacgagaggaaaacgcagccactgcaagagcccttgagcaagaaaccaaaagggcctgcaaggaggaacatggccaagataaattccgaggagctttgtggggtagcaacaatgagctcaagctccggagagaggaaagagaccagtcacgggtacatggcatgatcttaaaagaagaattagctgcttgcgcaagatccaagaggagtttggctcaacacttggaagccacggagcaaagcatgctagctatcatagggcagtacaaggaagagttaaatcagtctgtgacccatgaacaaaagctagtagaagatttcgcacaagtgtacgccaaaaaggaagcaagagggagggtgattgatgcattgcatcaagaagcgactatgtggatggataggttcgccatgaccttgaatggaagtcaagacttcccgtga

SEQ ID NO: 41521 - DNA, 366 bp, Glycine max
  Peptide Sequence Number=SeqID_133206
atggagatgacaacatgtatgttgcatgaaaaggagttgccaaaggagctatgggcggaggctgcaaacactatagttaaaagggacaaacttgataagaagacagaacccgaagttttcattggatacaacaacacctccaaagcttacaaaattttccaacctcaaaattggaaaattcttgtgagtagagatgtcaaatttatggaagatcaacaatggagctgtgatgagccaataaggaagcagctgccagaaatcccacagttccttgatgatgatgtagatgacattcctgtcagaggtacaagatctttatctgagatttatcaaaagggcaatgtagttgtcctagaacctgcataa

SEQ ID NO: 41522 - DNA, 393 bp, Glycine max
  Peptide Sequence Number=SeqID_133207
atggaaaagtttgaaaacaagaacattggagaaaagaaggcaaagaaggcctacatcacatgggatgataacgacttagaatcgtctgatgattttgaaaaagaagagattactctatgtctaatgggcaaaaactatgaaagcgacgaagaggatccgttgttcacactaacactcaaggacccaataaagattgggtacctaagtcacaatgttgatgttgtaggaacctttgaggaaaaagtggccttaaggacagcctgcttagttgatgcaatcctccctaggaagggaccagtcactagatccatgagcaagaggctccaagaagattgggctagagctactgaagaaggccctagggttctcatgaacctcatggtagatttctga

SEQ ID NO: 41523 - DNA, 756 bp, Glycine max
  misc_feature (34)..(34): n is a, c, g, or t
  Peptide Sequence Number=SeqID_133208
acacccccaagcatccctgagttacagcagctgncggaggcaacgcaaatcggggaaccggcaagttcttccgcagaagtaaggcagctagtagaccacctcagtgagcaagccagggaggtggccagtgaagcttcaatggaaagaacacccagagctcttgcaatgtggatggctgggctaacgctagcattcgctatctccatagcgcttgctcaaaaggttgacctgctttgtgacagatgtggaatggagcctgaatctaccattcatgttttaaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctataggttggcaggccccaccccatggtgtttataagattaatactgatgctgcaatttttaaccagcaagggattggctgcttgcttcatcccgcccttccttccctcacctcacgcaaggctactagagaaggggtgaaaccagccaagggcgggctccaaggcgacaatagcaatcgagtggccaagcgttga

SEQ ID NO: 41524 - DNA, 780 bp, Glycine max
  Peptide Sequence Number=SeqID_133209
atgtacagcacatcacctctctctgccctgcgccagtggcttgaagccagccatctcgacgggatgatcgtcccgcgcgccgatgcctggcagagtgaatactgcgcaccctacgatgaaaagctggcctggctgacgggatttgacggttcggccggtgtggcgctggtgctgcaggacaaagcactgctgttcgtcgatggccgctatcaggttcaggcgcgcgtgcaggtcaacacggatgagattgagatccaccatctgcataacgagccgctggcgcaatggctggcggaaaacgtgggggcaggcacgcgcatcggttttgacccgctgctgatgactaatacggagtttgatcagctgtccgccacagcgtgcgaactggtgccattgagtgaatcgccttttgatactctgtggactgaccgccctgccgcaccggcggggcttattcgtagcatgccggttgaactcagcggtgaaagcagcgcagacaaacgtcagcgcgttgccgccgtgctggccgccagccatgccgattatctggccgttaccctgccggacaatatcgcctggctcctgaacgtgcggggagcagatatcccttacagcccggtaccgctctcttttgtcctgctgggtcgagacggtcacgttgagtggtttgttaacgacaataagctcagcgccctgccagacgccgtgcgcaatgcgttcactattgcgccgcaggacgcctttatcgagcgctgccagcgcattgctgccggtaaacgg

SEQ ID NO: 41525 - DNA, 957 bp, Glycine max
  Peptide Sequence Number=SeqID_133210
atgctgctgatcctgctggctctgctggtttacagtgccctggttatctggagcgccagcggccaggacatcggcatgatggagcgtaaaattggccagatcgcgatgggtctggtcattatggtggtgatggcgcagatcccgccacgcgtctatgaaggctgggcgccctatctttacatcttctgtattattttgctggttgcggtagacgcgtttggtgccatctcaaaaggggcgcagcgctggctggatctgggcgttgtccgcttccagccctcggaaatcgccaaaatcgccgtccccctgatggtggcacgctttatcaaccgcgacgtctgtccgccgtctctgaaaaataccgccatcgcgctggtgctgattttcctgccaacgctgctggtcgcggcgcagcctgacctgggaacctcaatcctcatcgcactctccggcctgtttgttcttttcctctcgggcctgagctggcgtctgattggcatcgcggtggtgctggttgccgcgtttattccgattctctggttcttcctgatgcatgattaccagcgccagcgcgtcatgatgctgctcgatccggaaaccgatccgctgggcgcgggctatcatattattcagtctaaaattgcgattggctccggtggcctgcgcggtaaaggctggctgcacggtacacagtcgcagctggagtttttaccggaacgccacaccgactttattttcgccgtactggctgaagagctggggctggtgggcatcttaattttgctggcgctatacgtcctgctgatcatgcgcggattgtggattgcagcacgcgcgcaaaccacctttggtcgcgttatggctggcgggttgatgctgattttattcgtttatgtcttcgtaaatattggtatggtgagtggtattctgccggtggttggcgtaccgctaccgctg

SEQ ID NO: 41526 - DNA, 596 bp, Glycine max
  Peptide Sequence Number=SeqID_133211
acccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttattaaaaaagctcgtagttggaccttgggttgggtcgatcggtccgcttccggtgtgcaccggtcggctcgtcccttctgcgggcgatgcgctcctgtccttaactggccgggttgtgcctccggtgctgattctgatcctattgtgttggccttcgggatcggagtaatgattaacagggacagtcgggggcattggtatttcatagtcagagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 41527 - DNA, 724 bp, Glycine max
  Peptide Sequence Number=SeqID_133212
aggactacacgtcctcaccatcagagggctgcacgccctcacctccagaggactacacgtcctcgccttgagagggctacccgccctcgccttgggtactagttaccctcaccttcagaggactccatgtcctcactttcagagggctacacgccctcgccatcagaggactgcatgtcctcaccttcgtagggctacacagggctacacgccctcacctttagaggactacacgtcctcaccatcagaggactacacgtcctcaccttcagaggactacgcgccctcacatcagaggactacacgtcctcaccttcagaggactacgcgtcctcaccttagaggactgcacgtcctcaccttcagaggactacatgtcctcactttcagagggctacacgccctcgccatcagaggactacatgtcctcaccttcgtagggctacacgccctcacctttagaggactacacgtcctcaccaacagagggctacacgccctcaccttgagaggactacacgtcctcaccatcagagggctgcacgccctcacctctagaggactacacgtcctcgccttgagaggtctacccgccctcgccttgggtactagttaccctcaccttcagaggactacatgtcctcactttcagagggctacacgccctcgccaccagaggactgcatgtcctcaccttcgtagggctacatgccctcacctttag

SEQ ID NO: 41528 - DNA, 546 bp, Glycine max
  Peptide Sequence Number=SeqID_133213
atgacggaccctctcgatgagtcgatctcttgctttctcataagggtgaacccttgggtactagtacccttgtctctagaggactatacgtcctcaccttcaaagggctacatgtcctcaccatcagagggctacacgccctcaccttctgaggactacatgtcctcatctttagaggactacatgtcctcacctttagaggactacataggactacacgtcctcaccttcagagggctacacgccctcgccatcagaggactgcatgtcctcaccttcgtagggctacacgccctcaccttcagaggactacacgtcctcaccttcagagggctacacgccctcgccatcagaggactgcatgtcctcaccatcgtagggctacacgccctcacctttagaggactacacgtcctcgccaacagagggctgcacgccctgacctttagaggactacacgttgaaattctgatactgaggacagatgtcgtacaggatgtcacgacatcgcgcttcagaacatgcagattgtctatgaccgtatga

SEQ ID NO: 41529 - DNA, 183 bp, Glycine max
  Peptide Sequence Number=SeqID_133214
atgccaaaagatagggggacttgtcttgatttcaaggatggtcatcatcaaaaagggggagattgtagacaaaggatcaagctgaatgttttgatgatgccaaagtttcacatgcgtctcaaagctttattcaagacaaagaaattaaagatattcaagatggatgatcaagacagtctctag

SEQ ID NO: 41530 - DNA, 96 bp, Glycine max
  Peptide Sequence Number=SeqID_133215
atggctttggctcttttaagtgaagaagcaagaaaaggcaaaaacacagtcaatgatatacaaaacaaaattatgtgggctaatgaggaaccataa

SEQ ID NO: 41531 - DNA, 1156 bp, Glycine max
  Peptide Sequence Number=SeqID_133216
caagattgcagctgtggttggagattcagcaaaagagttggatcgcatgaagcaaactcggaacggcgtagtgggcctgcctcggaaatacttggaaggcaaggcaagggatatggcgagccaagagaagtggggcccgtttgcggatattttagctttgttgatttttggggttgtcctctttccgaacatggacggtttggtggacttagccgccattgacaccttcctcgcgtatcaccacagcaacgagagtccagtggtggctatcttggcagatttgtttgatacctttgatcggagatgtgagaaaaacagtgcacgaattgtctgttgtttacccgctctctgtgtgtgtcaattgggtttcctcgttggaaaggaaggcaaggaaggagttcttttctcgtgtgaggactaccctaatgttccattgatagggactagggggggaatgccaaccgaagaaactctctcgcctttccttgtgagagatctaggagcgcaaggtctcaaggttatacaaagaatccacaaggcgtggaggagtccgttgaggaaagacaaggagcttagaagcatccgaaacggcgtcatcggaggttatcatggatggctaagaattcacacgcggggcttagattggctctccaaattgaaagttatcgatgaggagaacttcgaagctccggaggaagatgaagaagtccgagatctaaagttagagctagggaaagcgagactcgccaaggagaagttcaaatcagctgctacacacatccggatggagtgcaccgagttacaagaggaaaacgcggccactgcaagagcccttgaacaagaaaccaagagggcccgcaaggaggaatatggtcgagagaaattccgaggagcattgtggggtagtaacaatgagctcaagctccgaagagaggagagagatcggtcgcgggtgcatggcatgatcttaaaagaagagttagttgcttgcgcgaggtccaaaaggagtttggctcaacacttggaagcaacggagcaaagcatgctaggtatcatagggcaatacaaggaagaattgaaccagtccatgacccatgaacaaaagttagtcgaggatttcgcacaagtgtatgccgaaaaagaagcaagagggagg

SEQ ID NO: 41532 - DNA, 120 bp, Glycine max
  Peptide Sequence Number=SeqID_133217
atggcacctacacctcgcacacacattgagatattagtccctacacccaggtctattccctatcgcctcaatgtattacctaagagggtgatatctctagaagccagtaaagttacttga

SEQ ID NO: 41533 - DNA, 528 bp, Glycine max
  Peptide Sequence Number=SeqID_133218
atggtgggttacacaccttcaagttttacagatttggtcttcgccagtgaaaggatcaaggtgggtccgaaaagaggcaagtttgatcatcctactaggacgactgagaaaactggggcaaataaagagggtgaggatgagggagaaacccatgttgtggctgccattcctgtacggccaaatttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaaccataaccctagccaaggttcatcaacctccatttctccgagaatacgactcgaacgcaacgtgtgcttgtcacggagaagccccggggcgttccattgagcatggtagggctctgaagcgtaaggtgcaaggtctaattgatgcgggctggctaaaatttgaggagaattgcgtgtaa

SEQ ID NO: 41534 - DNA, 239 bp, Glycine max
  Peptide Sequence Number=SeqID_133219
atgaaattgagatgcccgaagaaacaccatttcctagttaaccatgcattaggtactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaag

SEQ ID NO: 41535 - DNA, 324 bp, Glycine max
  Peptide Sequence Number=SeqID_133220
atggagaataacgtggccaccgctgccgctgttagttcggctgttgaagcagacccaactctcccatctaccgcgcaccatcctctcctaaacgtggtaggacgagaaagaagcacactggggcacatcaacaacccctatctgggatacaaccgagtggcttacccttatggattaccgcctaattacacgccaccagtcatgcgtgacgacgcgggacatgtcccttcccccatccttgaaggggagtttcctcgacaatcgaacgaggttcacgaggatcgtagagagcatgcccaaggagacatcgatttctaccccccg

SEQ ID NO: 41536 - DNA, 303 bp, Glycine max
  misc_feature (127)..(127): n is a, c, g, or t
  Peptide Sequence Number=SeqID_133221
atgacggtgaaacctctgacacatgcagctcccggagacggtcacagcttgtctgtaagcggatgccgggagcagacaagcccgtcagggcgcgtcagcgggtgttggcgggtgtcggggctggctnaactatgcggcatcagagcagattgtactgagagtgcaccatatgcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 41537 - DNA, 456 bp, Glycine max
  misc_feature (412)..(412): n is a, c, g, or t
  Peptide Sequence Number=SeqID_133222
atggcgttgctacttagcaacatctcgtccggcgaccacaatgccaatctctccctgcagaaggatcgtgcccacaagacacccagtggacccggagaagtccaacagggccttggggtttccagctctagttacgggcctccatcagtcctacagggtgcccgttccccccaagaagggatcgcgcccgcaagacacccagtggacccgaagaagtccaacaaggtcttggagtttccaactctgattacgggcctctgtcaattctacggagtgcctgtcgcccctagcaaggtcatcaggccccctactaatcgagctttcatcaagaagtattgcacccccaagcaggcgcagggcgaaacaccacagcagcctggggatggccgacagtgggcaacagatgcaccgncaccacctctagagttcacctcagctcatccacaaaaaggttag

SEQ ID NO: 41538 - DNA, 535 bp, Glycine max
  Peptide Sequence Number=SeqID_133223
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagttaatagtagtgaagagatgaaaaagaaaggagctgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaacccg

SEQ ID NO: 41539 - DNA, 300 bp, Glycine max
  Peptide Sequence Number=SeqID_133224
atgttgtcctttgggacaaacgtgagaggtgctaataccttcctcaaacgtaaatacaactcccgaatctggaatattcttcatgaccggtttccttcggtttttctgacattttccacaaataaacattggtggcgactccgcgcattttcctcctttggaagacgcacccgtgagcctcgcctcgctcgcccgcaaaagggtaggttgcgacacatgacattgcaaagatatgcatggcaatatcaagggaaacaacatgtagcgtgtttgctccgtgcccctatttcagaaacctaa

SEQ ID NO: 41540 - DNA, 411 bp, Glycine max
  Peptide Sequence Number=SeqID_133225
atggacaaatttcctacgctctatcaagtttctaaccaacaacagcaaactatcagacacatgggaagccacaaggaggaagggtgggaatggaattttaattggaggagaaacctatttgatagtgaagcttcaatggctgcagaattcatagaggaaacaagactgatatcagttcagcaacaaggagcagattcttggatttggaagcaacattcgagcggtatctattcgaccaatactgcttacaagtttctaatggaggaaacaaggggggatccagtggatgggagctttgtgtttctgtggaagcttaagataccacctaaggcaaagatttttaacctggagactcatcaaagaccgcttaccagctatgttcaaaatatatatgtactcacagtacctctg

SEQ ID NO: 41541 - DNA, 252 bp, Glycine max
  Peptide Sequence Number=SeqID_133226
atgacacaagggtgcatgtcacatgacctcaagtctccaccagaagatgcctacatctccggaaagggcgcagatgaccatattggcctccacttatcaaatcacactcgaggtgcggataaccgtaaggtgtctccgcgggctaccagttcttgggtcatggtaacagaaagtagtgtggtcgacaaaagcgaagcttttgctcctacgtatcctccaatgaggaactcagacctacgtagttctggataa

SEQ ID NO: 41542 - DNA, 457 bp, Glycine max
  Peptide Sequence Number=SeqID_133227
atggatctcggcgcccggccgctgaaggtcttctatcaccctgccgatgattatgccggcggtgatctccggctggctgctggcgtttaccctcagtcgctcgacgatctggtgatcgccagctttgtctccggcggtggcgagacgctgatcccggactggtcttctccagcgtacgcatggtgggtcaacccggagatcaacgccctggcctcgatcatcctcgcgcgtgcgtcggaattgtcggatttataccgcactggcatgaacaacttgccggtagtgcgttcaccgtggcgcatcgccatcctgacgatcggctttaccttcctgtatgcgccgatgctgatgctggtgatctactccttcaacagctccaagctggtgacggtgtgggccggctggtccacgcgctggtataaccgaactgttccacgactcggggatgatcagcgcg

SEQ ID NO: 41543 - DNA, 603 bp, Glycine max
  misc_feature (5)..(5): n is a, c, g, or t
  Peptide Sequence Number=SeqID_133228
atggncagaaatgtctccgcattgattggtaaatttgttccccaaatccctaaaaaatgtaaagatccagatttaggagcttctgttagtgttatacctctgtctatttttaattctctatctcttggccccttgcagtcaactgatgtgggattttctaaaggaatagttcccatcattctaggcagaccttttatgaaaactgctagaactaagatagatgtatatgcaggcacactatctatggaatttggtgatataactgttcattttaatattcttgatgctatgaaacacccatctgaagatctttctgtatttcgtgctgaaataattgaccatgttgttgatgaatacatgactgatcttcattctaatctgcatgtctgtcactcttcatgcattgaatctgaatttgtacttgatcatatgtctgaatttgatattgattacatgtttggtgatgttttacctcttgagattgattttatagagccagatagagctaaccatgtttcaggaagtacacatacctctgactttctttatgaggtacaggctgagaaccatctctttctaccactatccagccgcccacactag

SEQ ID NO: 41544 - DNA, 297 bp, Glycine max
  Peptide Sequence Number=SeqID_133229
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggttgtcggccacacaaagcctagtgttgttggaggatttgtcgatactgggttgtga

SEQ ID NO: 41545 - DNA, 110 bp, Glycine max
  Peptide Sequence Number=SeqID_133230
atgggggagatgcttgccacccagctcggccaggcaagctcagctcgcccaagcgaggaaggtgacttcctccagaagcaaccgccttctggagggcccaagtgggcctg

SEQ ID NO: 41546 - DNA, 257 bp, Glycine max
  Peptide Sequence Number=SeqID_133231
ttgtctctagaatatgtccattggatttaatgatgaaatatgtgcaatttcagttgagattagctcatcagtgggctaagcgcacatccaccgctaagtgcaactttggcatgcttaatgcgctagaagaatctggcaaagcatcaatatcaaggtcgtgcgctaagcatgagatcagtgcgctaagcgcagtagttgtcttcagccaggctcaatgcatgattggcgctaagctcaaatccacttactcgtgctaa

SEQ ID NO: 41547 - DNA, 315 bp, Glycine max
  Peptide Sequence Number=SeqID_133232
atggatgagtttgatgcacaggtggcctggacaagagcccagccttcttcttctagagggggtggggcctccgtagcccaggagcctattccagaggagccagcagcagcaacatcagaaggggaggatgagctcacccctcctgagcccttttattttgattcaggtatcccagagccatctctagcacccattcctgatgatgtcataccatctgcaccagcatctgagctagagcaacctatccctcaggattcaccggctgctcaggtgttggatcttaatgagcatgcacaggagcaaccacaggagtag

SEQ ID NO: 41548 - DNA, 225 bp, Glycine max
  Peptide Sequence Number=SeqID_133233
atgaaatctatggaagcattggtttatacattcctcttagtctcgactttaggaattatttttttcgctatcttttttagagaaccccctaaagttccgacgaaaaaagtaatgagcccccaatatggagggctcattacttcaactagtccccatgttcttcaaatggatctcttagttgttgcgagggttgcccaaaggcaatatataaggcatacccagtaa

SEQ ID NO: 41549 - DNA, 282 bp, Glycine max
  Peptide Sequence Number=SeqID_133234
atggttatggggagctatctgcttggagccaactatgtaattggatttttggatgttactattattcatcaattagttaccattgtccgcaacgttttcagtttagagtgggggcatgcggacaagcattacgtgataatggtagaggacgtagctacttgttacaatataactaccgtgtgtgggaagcgtgttaagtacacacatctctcccaacatcttccaagaggagcaggaaaagtccacggtcgtgcggaagaggtttctaaaggaacaacatga

SEQ ID NO: 41550 - DNA, 189 bp, Glycine max
  Peptide Sequence Number=SeqID_133235
atggagaagtttgaaaagaaaaatattaatgaaaagaaattgaagaaagcatgcattacatgggatgaaaacgatatggaatcttctgaagattcagaaaatgaagaaataaatctctgccttatggaaaaaagttatgaaagtgatgaagaggaaaacaaagacatgtctccaataaggctggattag

SEQ ID NO: 41551 - DNA, 213 bp, Glycine max
  Peptide Sequence Number=SeqID_133236
atgggggtgcaaatagcacccaggcccatttgggccctccagaagattcctccagaaggcggttgcttctggaggaagcaaccctgctcgttaatggtccacattgcgtttcgtgcatttttactctcgttttgtttactttttataccccctgttgacgtgcttaagccattttacttaagtcatttctcgcttaacttaaaaataaaataa

SEQ ID NO: 41552 - DNA, 668 bp, Glycine max
  Peptide Sequence Number=SeqID_133237
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaaattttggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41553 - DNA, 884 bp, Glycine max
  Peptide Sequence Number=SeqID_133238
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcccaccctcctcagcctctcaaagtgttaggattacagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41554 - DNA, 423 bp, Glycine max
  Peptide Sequence Number=SeqID_133239
atgtttctggcctgtcggctgtctatcttgatggctgccatcgcgtttgcactgagcaaaagcgccgccattatggctaatgcgatttttttcatgatatgcgctccacgactgcgtgctcagcgggctacgatccaccgtctggaagactggggccgccgtcagctggcttatccgatcaacaaactgcacaaagcacactacgttctgatgaacgttgaagcaccgcaggaagtgatcgatgagctggaaactaccttccgcttcaacgatgccgttatccgcagcatggttatgcgtaccaaaaacgcagttaccgaagcatctccgatggttaaagcgaaagacgagcgccgtgagcgtcgcgatgatttcgcaaacgaaaccgcagatgattctgatgctggggattctgaagagtaa

SEQ ID NO: 41555 - DNA, 759 bp, Glycine max
  Peptide Sequence Number=SeqID_133240
atgccctcaccttcagagaactacacatcctcacctttagaggactacacaacctcgccttcacagagctacacaccgtcaccttcagaggactacacgtcttcacctccagagggctacaggccctcaccttcagaggactacacgtcctcgccttcagagggctacacgtcattgccttcagagggctacacgccctcaccttcagaggactacacgtcctcgccttcagaggggtcacacaccctcgcctttagaggtgtacatgccctcgccttcagaggactacatgtcctcaccttcagaggactacaggtcctgaccttcagagcgcaacacgccctcaccttaaaaggcctacacgccctcgccttcagaggactacccgtccctgccttcaaaggactacacgtcctctccttcagaggactacacttcctcgccttacgagggctacacgtcctcgccttcagagggctacacgtcctctcctacagaggactacatgtcctcccctccagaggactacacgtcctcacctccagaggactacacgtcctcacctccagaggactacacgtcctcacctccagaggactacacgtcctcacctccagaggactacatgtcctcacctctagaggactacacaacctcacctctagaggactacatgccctccccttcagaggactacacgccctcgccttcagaggactacatgtccttccccttcagaagggaagggggatcctctaa

SEQ ID NO: 41556 - DNA, 396 bp, Glycine max
  Peptide Sequence Number=SeqID_133241
atggagagaagtatgatagatgctgccagtggtggagcccttggagacatgacccctgctgaagccaggaatttaattgagaagatggcttccaactaccatcagtttagcgccaaaaatgatgctatagtcattggaggagtgcatgaggtagccacagactcatttgcatcatctgaaactaagaagcttgaaggtaaactagacgccttggttaacctggtaacccaactggccatgaatcaaaaatctgtacctatcgcaagactctgtggtttatgcacatttgccgaccaccatacagacctttgcccttctgtgcaacaatctggagcaattgaacagcctgaagcttatgctgcaaacatctacaatagacctcctcaacctcagtag

SEQ ID NO: 41557 - DNA, 803 bp, Glycine max
  Peptide Sequence Number=SeqID_133242
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcaaaactctcagcatggcctcacccactaaaagtcataaaatctcaaaccagtcattttccccctgctctctcaagctacttcagaccttctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41558 - DNA, 756 bp, Glycine max
  Peptide Sequence Number=SeqID_133243
tggatcccattttatgccgacgctatcggccagctcctgggatatccgttagtgctagaagagggccaggagtacgagtatggccagaggaggaaccggtctgatgggttcgatgaggaggccatcgcccagctgctatgtataccggggcaagattttgcccggactgctgcagggaggcgagtgcgaatcatgcgcaccaacatgaccaccctgacccagatatggatgacgttgctcctcagcaacatcctgcccaccgatcataattccgacctccccatgccgaagtgtcagctggtatggcgcctaccaggcaccctttggatccagataagtccaacagggccctgggattttccctcgctgatcacaggactctaccagtcattcggagtccctgttgcacctaccaagaagtactgtacccagagacaggctcagggtgatgctccacaggccgcaggcgcgccaccaccacctcatcaggctggccaggctggggcatttgacatggagcagtatttacggcatttggttcgccagcaggcggccaaccaccgagtacatggcttcgcttctttttcatgccctactccagaccagttcagggcagaagtcgcatggcccggggattggcccgaggcccaagcaggagtggcacccccagaagctcccggcgatggagaagaggcccacgaggacgaggagatggccgatttgcttgacttcttgggagggagtggagatacatga

SEQ ID NO: 41559 - DNA, 327 bp, Glycine max
  Peptide Sequence Number=SeqID_133244
atgttgataatcattgatcagtacaaagagaaggtgaacctagatgctagtcatgggcagatgctgagagatgaacaggcgaaggtgttggccttgcaggttaaaagagaggcaagggaaaaggtgatagatttattgcatgaagaaagcatgaaatggatggataggtttgctctcactttgaatgagagtcaagagcttccgaggctgttagccagagccaagatggtggctaacacatactctgctcccgatgaagttcacaatcttttcaattacttccaacacatggtcgaactaatgacccacataattaggaaccgctga

SEQ ID NO: 41560 - DNA, 306 bp, Glycine max
  Peptide Sequence Number=SeqID_133245
atggagtcgccaactgtcgcaacctacccttcggtgggagggcgacgcggggctcacaggtgcgtcttccaagggaggaaggcgcgcggagtcgccaccaacgtttattcgaggaaaacattggaaaaatcgaacgtgtggtctacaaactttaattgcgaaaggttcaggagttgtttttacgcacgtggaaggagagaaacattaaggcgttggaccattaacgatctcttggggtggtcgacaaaagcggggcttttgctcctacgtatcctcaattgcaatgaggaaatcagacctacgtag

SEQ ID NO: 41561 - DNA, 663 bp, Glycine max
  Peptide Sequence Number=SeqID_133246
atggtgtatgacttgaacgatatttttgtttcgctgcctaataagtggacttgttttaaaaagcacgatcttcaaatgggaaagctgtcattgcatgctaaacttacattatatgctgattgcatgctgttgctttactgggtgtattgtggcagaacattatcattgactacttgttcattgctagcaaagtttgatatcgcagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggagggtattaggaaacgagcacaatcaattcaaaaacacaatgactgcccccacgtactttcacgtgggggatatgatttgcttaagaagaaattgttagaccagaaacgaaaaaggatacaagaggaagcattgttgagtgaaaatgcagcaagccttgatgaacccccatctccaataaaaagacatgttaagtggaaggttgctcggaccagggctgttggcaatatgacatctgagtccgcacaggaaattgcagataaaata

SEQ ID NO: 41562 - DNA, 207 bp, Glycine max
  Peptide Sequence Number=SeqID_133247
atgttgtcaccagcacctttcccagagatgttcgcgtctttcggccgaaactgcgaaaaggtctcatttgctatccgtaagactcaaagcccgatagcatgcagtggcttacgtcatcacttgcaccttcctaggagatgtcagcatcttccggccgagactgcgaaagagtctcatttgctatccgtaagactcaaagcccgataa

SEQ ID NO: 41563 - DNA, 225 bp, Glycine max
  Peptide Sequence Number=SeqID_133248
cttgggaggattgatggggacccggtgttgagagaaacgaggatgttggctacgtgggagtacgtgagctcagttggaggtgggcaacaggggatgagtggtaccgggagatatgtcgcaggggtcagaaggcctcgaggacttcaggcgagctcgtggcagtcagctgttaaaaggaacaaagaccacaaagcaaggaggcttgtggtggctggccagctgtga

SEQ ID NO: 41564 - DNA, 441 bp, Glycine max
  Peptide Sequence Number=SeqID_133249
atgccaatctccccctgcagatgtatcagttgggatcacgcccacaagacgcccagtggacccgaagaagtccaacagggccctggggtttccagctctggttacgagcctctggatcacgcccacaagacacctagtggacccgaagaagtccaacagggccctggggaatcgcacccacaaagacatccagtggacccggagaagtccaacaaggccctggggtttccagctctggttacgggcctctgtagtcctacagggtgcccgttccccccggcaaggtcacatcatcatgacatagggatcgcgcccgcaagacacccagtggacccgaagaagtccaacagggtcttggagttgccaagctctaattacggacctctctcagttctacggagtgcctgtcgcccccagcaaggtcatcaggccccctactaa

SEQ ID NO: 41565 - DNA, 387 bp, Glycine max
  Peptide Sequence Number=SeqID_133250
atgatgggactgccattcaaaatgataggagtactacttcacctccccagaatggaactaccattcaaaatgacaccttacttccccaaattagatttgaagtttaaacctttcgctgagaacctgaagtctgaactgctaggtggcataattgctctttttgtccttggccttacttatctttactatcgcatgaaaacccccaaagttgtgacttgtgatcgtccaaatagtaaggtagggagtgtaatgtttgaaagagatgagataaagtgttatattggcaaagctaaagggaaattccagtattcagtatttaccttgatatttaagatttggtaccttactatttttataggcgcgcgtttcctggttactaactactaa

SEQ ID NO: 41566 - DNA, 567 bp, Glycine max
  Peptide Sequence Number=SeqID_133251
atgagaggccctctcaaagagtcaacctcttgctttcttgtaaggttaaagtcctttggtacttgcacctattggctcgccttcagaggactgcatgtcctcaccttcagagggctacacgccctcgccatcagaggactgcatgtcctcaccttcagagggctacacgccctcgccatcagaggactgcatgtcctcaccttcatagggctacacgccctcacctttagaggatcacacgtcctcaccttcagagggctacacaccctcgccattagaggactgcatgtcctcaccttcagagggctacacgccctcgccatcagaggactgcatgtcctcaccttcgtagggctacacgccctcacctttggaggactacacgtcctcgccaacagagggctgcacgccctcaccttcagaggactacacgtcctcgccttcagaggactacacgtcctcgccttcaaagggtcatgtaccttcacctttgtagggctacacgccctcaccttcagaggactacatgtcccccattttcaaagagggacatgccctcacctttag

SEQ ID NO: 41567 - DNA, 165 bp, Glycine max
  Peptide Sequence Number=SeqID_133252
atggtgaaagttggaacctcttacgtgccgatcaacgtctcattttcgccaaaagttggcccagggcttcccgtgacgttgaagatgcaagcttatcgattaccgtcgacctcgagggtggggcccggtccagctttttcgttccctttcagctctgagggttaa

SEQ ID NO: 41568 - DNA, 690 bp, Glycine max
  Peptide Sequence Number=SeqID_133253
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctacggtaagatttgggacctagctagggtagaagtctccatggaaccgattgaatccctttcccagtattatgaccagcccctaaggtgcttcacattcgaggacttccagctagtgccgactgtgaaagagtttgaagaaatcctgggatgcccactgggaggaaggaagccatatcttttctttgggttctatccctccacgacaagagttgccaaggtagtgaaaatctcagcacaagagttgaaccaggaaagcccgatcgtcgccattttgtccatgtatgacacgttcgaccggggatgtgaaaagagcgatgcaagaattttttgttgtgcactggctctctttgtgtggctggtttcacatccttttctccaagaaggtaggcccgtctatccgctacaaggtcaccgctcgggcgtcgaaaaaggaaaggcgaattgggaccacctcttggctagcatggaggggcgtctgttaattggttccctcgctagaaggaaggaagaatcaggattctatcttcatgcgaaggatgtccaaatgttctcttga

SEQ ID NO: 41569 - DNA, 649 bp, Glycine max
  Peptide Sequence Number=SeqID_133254
tgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttaggtaaatatctaatgcgttccccgacaggagaagttatttttgggggagaaactatgcgtttttgggatttgcgtgctccttggttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagccatttatggcacgcgggaagagctcggcgcagctgccgcaggatttgaaaaaggaattgatcgagattttgaacca

SEQ ID NO: 41570 - DNA, 409 bp, Glycine max
  Peptide Sequence Number=SeqID_133255
gaaggatttgactactctagctcaggtgtggagtgttctctcatactccaacttggccctcacatcacatacctctgatctaatagtggacagagctaggttgatctatggcctagtctctcgcatggacatgaacatagaagctcttatttctggccaaataacttctatagcccagtctaatgcatctatacttgggtttcttgctctgatcatcgcactatgtagagccagaagggttgtctctgacagccttacttttgagcgcttgagcccggtcattaacttggcctacattaggaagaactgttggaatcccgaggatcaaacaatttctatccgaggggctaggagggcgaggccagctgagcttccttccacttttgcagctccttctgtcccagcttaa

SEQ ID NO: 41571 - DNA, 192 bp, Glycine max
  Peptide Sequence Number=SeqID_133256
gcagctggcacgacaggtttcccgactggaaagcgggcagtgagcgcaacgcaattaatgtgacggataacaatttcacacaggaaacagctatgaccatgattacgaattcggctcggtacccgatgaagttaatatgtgagactcataatcatgcattggctaagtcattcgttggacatccatatgctg

SEQ ID NO: 41572 - DNA, 402 bp, Glycine max
  Peptide Sequence Number=SeqID_133257
atgactcatgcaaaatgggaatgtgataatggacaaatgcaggaacgatatgttcattatgatgctgaagagatgtttatgcgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggggtgtggtggttacgcgcagcgtgaccgctacacttgccagcgctga

SEQ ID NO: 41573 - DNA, 543 bp, Glycine max
  Peptide Sequence Number=SeqID_133258
atgttggtgcgcatggtccgcactcttctctttgcagcggcacgggtgaaatcttgccccagtatgcatagtagctgtgtgatagcctccctctctggttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgttgcctttcgaaggcgagggaatgtagtcctatgatggcaaggacgtgcaatcctctaaaggtgaggacgtgtagccctacaaaggtgaaggcacatgaccctttgacggcgaggacgtgtagtcctctgaagttgaagttacatgaccctttgaaggcgaggacgtgtagtcctctgaacggtgaaggacgtgtagtcctctcaaggcgaggacgtgtagtcctctcaacggtgagggtaactagtacccaaggtgaggggcgtgtagtcctctcaaggcgaggacgtgtagtcctctcaacggtgagg

SEQ ID NO: 41574 - DNA, 108 bp, Glycine max
  Peptide Sequence Number=SeqID_133259
atggcttcttgccacaagtcagcatccaaagaagacaaagcttcttggaggtttgatggatcctcctctaatattttcactgctaatagcaggaaggtgactggatga

SEQ ID NO: 41575 - DNA, 162 bp, Glycine max
  Peptide Sequence Number=SeqID_133260
atggcctcggagggaagttccttgtcgtgttggaattaccggtcgggcaagtcgtgttcggagttggaacttagggagcttccctctgggcgttcccggtatgagccgagaagctcgagtgatgttgcgcgtactgatgggtaccatgaggtgtttgctggg

SEQ ID NO: 41576 - DNA, 216 bp, Glycine max
  Peptide Sequence Number=SeqID_133261
atggctttcaaactcaattcgatgtcactgcgcccccaggcagacgcagggcgaaacaccacagcagcattgggatggccggtagcgggcaatagacacaccgccaccacctttagagttcacctcaactcatccgcaaaaaggttagagcgttgcctacgacacatggccgaccagcaggcgaccaagtccaaagccaaagtaagacacacctag

SEQ ID NO: 41577 - DNA, 420 bp, Glycine max
  Peptide Sequence Number=SeqID_133262
atgaagatgctcttgataccacatgatgtaagctccattggagcttgtaggcctaggatcttcttcatcaatggattcctttgcttcttggaagatgaatggcagcagaatgaagaaaggaagagagagaggagatgccacttcaaggagaagatgagtctagaagaagctcaccaccataggaggccatggataagagcttggaggaagaaggagatgaatgaagggagaggaagagaagagcacgaaattttgattgcatcacgcaacgtcgtgcttagcgagcagatctcgcgcttagtgtgcggccttgatattgatgctctgccagattcttctgttgcgctaagtgagctgagcccaaatggtgagctgagcgcaactaccacttttagcacttcaagacttagcctcatttaa

SEQ ID NO: 41578 - DNA, 289 bp, Glycine max
  Peptide Sequence Number=SeqID_133263
atgagcagcattgataaaagcgggacgtacgcgctcggtacgcggacggttaaacgactgggatacggcgcgatgcagcttgccggaccgggcgtatttggccctccgaaagataaaaatgccgcgctggaggtgttacgcgaagccgtggcggcgggggtgaatcatattgataccagcgatttttatggtccccatgtgaccaatcagctgatccgcgaggcgcttcatccgtaccgggacgatctcaccatcgttaccaagatcggggcccgccgcaacgataaag

SEQ ID NO: 41579 - DNA, 222 bp, Glycine max
  Peptide Sequence Number=SeqID_133264
atgggggtgcaaatagcaaccaagcccacttgggccttcttgaatacggttgcttctggaggaagcaacttagctcgcctgggcgagctgggtgacaagcttctcccctattttcctataaatagggggagaagtgaagggaaaaaatgtttagccctcctgattttcaaccgttcttcgacgttcttcgttcattcttcgtcgttcttcggtcttcaaccg

SEQ ID NO: 41580 - DNA, 401 bp, Glycine max
  Peptide Sequence Number=SeqID_133265
gtggctttcaaccacaaggaaatctcatgcgacactatgaaatcgtgtttattgttcaccctgaccagagtgaacaagtgccagcaatgattgagcgctaccgcgctcaaattactggcaatggcggcaacattcaccgtctggaagactggggccgtcgtcaacttgcctatccaattcaaaaagtacacaaagctcactacgtgttgatgaacattgagtgcggccaggaagtgctggaagagttggagcacggcttcaaatttaacgatgctgtattacgtcacctgacaatcgccacgaaaacagcagtcacagcaccaagcccaatgatgaaagaggaaaaatccaaaaccatcgtgggtgacgcacctgctgctaccacagaggcagctgcttaa

SEQ ID NO: 41581 - DNA, 270 bp, Glycine max
  Peptide Sequence Number=SeqID_133266
atggtctctggtaatcgattaccaggggatatcgtgatgacggcgcagctaatccgtgatcgagtagagatggagtgcctaaagggagcttgggagaccctcgaaggcaacacgaggtgccgatttcggggcaccattcgattcacggctacttcattggtgcatccagatgaacctgcacggacgcttcagcgcacggtggagtggacaactccttggattagtttggtatactttttgagggtgggcgtatctaggactgactgttag

SEQ ID NO: 41582 - DNA, 279 bp, Glycine max
  Peptide Sequence Number=SeqID_133267
atggatgggcaatggttaaagaaggatgcacaacctccgcaagatgaacgtgctccctctcctccgcctcaacaagatgactccttagccctcatgcatgaagttctttcgaagttacgaggcctccgcacctatgttggtgagcgctttaattccttgggtggtcgtatcgatgccattgatgcttgctttgcaggcatggatacctacatcactcagcttgaggaggatataagttatgttcgtcagtgcttcgatcttcctccaccatcttcatag

SEQ ID NO: 41583 - DNA, 294 bp, Glycine max
  Peptide Sequence Number=SeqID_133268
atgcccttgcaggtaggattgcatcattccctcccccttgaaaaggattttgatgcaagctccattggagcttgtaggcctaggatcttcttcatcaatggattcctttgcttcttgaaagatgaatggcagcggaatggagaaaggaagagagagaggagacaccacttcaaggagaagatgagtctagaagaagctcaccaccataggaggccatggataagagcttggaggaagaaggagatgaatgaagggagagggagagaagagcacgaatttttgtgctctaaatga

SEQ ID NO: 41584 - DNA, 570 bp, Glycine max
  Peptide Sequence Number=SeqID_133269
atggttaggaccagaggattaggtcgtgccttaggtcaggttactggcagaggtgtgggcagaggagatcgtgatgattccgatgatgctccgcagcgtcgacggcctactgcattcgcacggaggcagcgagtcgttgtgactgcggcgcacgatgagccagtcatccctgtgcaagatgttcaggatgacccgatggaggcaccagctgctgtagaggacattgtggcagacattcatgcggacacaggcgcagaggctactgaggatgagcatgagggatttctgggtggtccgagcgacccatccgtgttgaccctgtatgcggatcacgttgcttgcagcgtatggacgggagagctatcctctcatgggaggaaggtccatagtttaggcaggtctgtccctgccattgagggacttgttgctggtacaggactaagtcctctgatcgcgtgttcggtagacaccagcgatcagggacttttgtccgtgtttgtggagcggtggcaccgggagacgtctagtttccatctaccggtgggagagctcaccatcacgttggacgat

SEQ ID NO: 41585 - DNA, 632 bp, Glycine max
  Peptide Sequence Number=SeqID_133270
atggggacaaatcaaaacggaaaaagattctatcaagtcaagattaagggcctagatgtcaccagccttaaggagttgggacggttgatgggacccctccaaaggcaagccttccgcaaagtgtacagaaagattttagatttgaccacagcggaggtatttacggaagccgttgtatccctcgcccaatactatgaccagccgttgagatgcttcacgtttggggacttccaaatagtaccgactgttgaagaatttgaggaaatattaggatgccctcttgggggaagaaaatcgtatcttttctccgggtttcttccctccttgagcaagattgcagctgtggtcggggattcggcgagaggtttggatcgtatgaagcaaactcgaaacgacatagtgggcctaccgcggaaatacatggaaggcaaggcaagggatatggcgagtcaagaagagtgggtcctatttgcagatatactagctttgctaatctttggggttgtcttttttccaaacgtggacagtttggtggacctagcctcaattgatgctttccttgcatatcaccatagcaaggagagcccggtggtagctatctgggcggacttatttgatacatttgaccgaag

SEQ ID NO: 41586 - DNA, 520 bp, Glycine max
  Peptide Sequence Number=SeqID_133271
atggctccgagaaagctttccacaaagagatccaggaaggacgtcgcggctgaaggaaccagcgccactcccgagtttgatagccatcgttttaggagcgctgagcaccagcagcgtttcgaggccatcaaaggatggtcattccaccgagagagacgcgtccagctcagggacgacgagtacgcagattttcaggaggagatagctcgccggtgttggacgtcgctggtcactcccatggctaagtttgacccagatgtagtcctagagtttttcgccaatgcttggcctacggaggagggcgtgcgggacatgcggtcatgggtgaggggccaatggattccttttgatgcaggcgccctcagccagttcctgggagactcgctagtgttagaagagggccaggagtgcgagtatagtcagagaaggaaccgggccgatggatttgacgaggaggtcattgcccagctattatgcataccgggtcaggatttttgcccggactgctgccgggagacgg

SEQ ID NO: 41587 - DNA, 237 bp, Glycine max
  Peptide Sequence Number=SeqID_133272
atgctttcttttagttgccgtccttggaacactccaactgtgagttggcagcccttggagactggcaagctgagccacgagttgttggtggagcttcgcggggatcgtacgtcagccaaggccttagaccggagtccctgcaggttctcagcttctgttctttcagaacctcctcggtgcctcttcctggctactccactcccagtcgggatgggtgccacagcttgtactggctaa

SEQ ID NO: 41588 - DNA, 198 bp, Glycine max
  Peptide Sequence Number=SeqID_133273
atgaggaccactaagggaggggctgaacgaaattcttcttcacttctccccctattttataggaaaatgggggagatgcttgccacccagctcgcccaggcgagtaaggtggcttcctccagaagaaaccgtcttctggaggaatcttctggagggcccaagtgggccttgttgctatttgccccccatttttactaa

SEQ ID NO: 41589 - DNA, 160 bp, Glycine max
  Peptide Sequence Number=SeqID_133274
atgggggtgcaaatagcacccaggcccacttgggccctccagaatattcctccagaagccgaggcgcttccgaaacgtttccgtaacgttttccgtgaggaatttcgcaaaagtttcaaccgttcttcgacgttcttcatcgttcttcgatcttcaacgg

SEQ ID NO: 41590 - DNA, 449 bp, Glycine max
  Peptide Sequence Number=SeqID_133275
gggagaggcggtttgcgtattgggcgctagcggagtgaatactggcttactatgttggcactggatgagggatattccgcttcctcgctcactgactcgctacgctcggtcgttcgactgcggcgagcggaaatggcttaaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcg

SEQ ID NO: 41591 - DNA, 456 bp, Glycine max
  Peptide Sequence Number=SeqID_133276
atgaggggagcactgacggaagagagcctctcgcctttccttgtgagagatttcggcacgcaaagtttcaagattgtacaaagagtccacaaggagtgggaaagcccgttaagaaaagataaagaacttaggggcatccgtaatggcatcatcgatggttatcatgaatggctgaaagttcatacacgagggttagattggctctccaagttgaaaattatcaacgaggagaacttcgaagctccggaagaggatgaaaaaatgtccggaaagagtgtgctgagttacgagaagaaaatgcagctaccgcaagagcccttgaacaagaaaccaagagggctcgcaaggaagagcatggccgagacaaattccgtggagctttgtggggcagcaacaaggaactcaagcttcgaagggaatagagagaccaatcacgagtatatagcatggtcttaa

SEQ ID NO: 41592 - DNA, 501 bp, Glycine max
  Peptide Sequence Number=SeqID_133277
atgacattgaccatcctaaagcttttcttgaggccttaccaggttacatgggatgccactgtgttcggggtctttaatccagacttcccgctctacataaagcacgaagacttctccgaaatcgcacacggtggtcaatgtcttagcatatcagtgttagagctgtggattctgcatctgactgaaacaagtatgcgagcggggaattccaatatctatggattcctcgagccacagtccattcagaggttttggcaattgcagtttgagactgaaagttacataaagagttggatgcatagttcaaaatgcgatgtctaccttggagcctacctgaatggcagacactggcagatggtggtcatcatgcccaaggaacacctaattgtctggttttgttcattgcataacaggccagacaactaccttaaggggatacttaacagcctaaatcaaaggctcatgctagtggattgtcgtcaaggttcgtcatttacataa

SEQ ID NO: 41593 - DNA, 320 bp, Glycine max
  Peptide Sequence Number=SeqID_133278
atgggtctaggcaacgactgcctcgggaatgccgacgtggtcgatatcaagggaaatccatacaagtatggattagggtatgaacccgggatgccggggaggaggaacgtgtcgtcaagatttcgggcggatagggtatggcccggccgtattagccagtgtttcaccagcgctggaatggtgtccgagaaggaagtggccgcaatagaagaggagttccctcaagacccaccaagttttgtgcaaccatgccaccccgtttcccaagtggggaactggcgcgtgataagccagtcagaagtctataccgctgattcaat

SEQ ID NO: 41594 - DNA, 342 bp, Glycine max
  Peptide Sequence Number=SeqID_133279
atggggacacgcttagactattttctttcgaatggtaccacattgcattttagatttgagtcaggagagtttgtcccttacttaaacaacatcgtcaaaccattacatgattggctgaagaaaaatccgccttcgtggtctgacctccatactcaaacagtcaaagatatcaaactcaaagtccaatcaataaaatgtttgtatctccttattccacaggcattcaaaattgtcgaaatggatgcatctgtcataggttatggtgacatccttaacaaagagtcaatagccaagagcatgtcattgcatacacatcaaagcattggaatccagcacaattaa

SEQ ID NO: 41595 - DNA, 969 bp, Glycine max
  Peptide Sequence Number=SeqID_133280
atgtggatgggttggtggacctggcagcgatcgacgcttttctcacctatcataaccacaaggaaagcccggttgtcactatgccagccgacctatatcacaccttcgaccgaagatgtgaaaagagcaacacaaggattgttttgttgtactccaactctttatgtatggttagtttcacacctttttcgccaagaggtgaggcatgcttgctcgctagaaagccattgttcatgcacaaagaaaggaggggcgaattgggaccaactcttagcaagcaaagaaggagcatctgtcaactggttccctcgatggaaggaaggaagaatcggagttcttatttcatgcggaggatttccaaatgttcccttgatggagacgaggggttgcatcagctacattcccgttcttgctataagacaagttggctatcctatgagaggggcaccactagaggaagagatcgtacctgtcatttcacgaggtttcaataagaccaacatggagacgcttcagaaggtccgcaaggcatgggaggtgttgcaaaggaaggacaaagaactaaggggaagtaacaatgggcccatcggtggctatcgtaagtggttgaaagcccacgtgcaaggtttggattggctcccgagtttgagaaccgctaaaagggaggaagttgaggcatcagaagaagacgaagaggtgcaggcccttagggcagaactcgagcaagcccaaacagtcaaagaaaggttcaaatcagcagctcttaagatccgaaaggagaatgccgaactaagagatataaatatagctaccaccaaggccttggaacaagaaaccaagagggctcgcaaggaaaagcatggccatgaaaaatttcgtggagctttatggggcagcaactgtgagctcaagcttcgaagggaagagagagaccaatctcgagcacttagcatggtcttgaaagagtag

SEQ ID NO: 41596 - DNA, 309 bp, Glycine max
  Peptide Sequence Number=SeqID_133281
atgtcacatggtccagcactagagcgtcaatttgcagcacaagagtttcacattcttcagtcaagtgttgaaactcagggcataggcagacgcagggaggctgttgaagcggaagaatattcccaacaaatggtggagcgtggccatgggatgcattacatgccaccaacattttctcagtatccttcacagatgtatcagtatccttttgaaggtcatcacactgatacttctacaagcgaacattcgttcggtggtgttgcagaaacacatcctcatttttcatggccgagtatgaccccttcatag

SEQ ID NO: 41597 - DNA, 936 bp, Glycine max
  Peptide Sequence Number=SeqID_133282
taccagcaatatgcgcttctcaaccagttacggcctatctactccgacatcaatacgaagtcagcgggagagggcttggcatcagttcagagcattcggccaacaggaagcgaagacgactttgcctttcgccagcagcgttaccagcaggcaatccaaaaataccagcaggtgatcggcgcacgtgagaaagatcccggtgggtggctggcgcaaaactcacccgaagtaaaggcggcttaccaggcctaccagcaggacccatcacagggcgcgctgcttgctcaggctatcctggtagacaaatctcgcctgggaattaagagtaaagacgttctgccggacgcactggctgacggcattctgcagcagattgataccagcaaagagcaaagcgtggcagcgattcagaatatcgctggtcagtttggcccttatgcagatcaggttatgcagcaggtgcagaagaaatcagggccggtgcttcaggttgtaatggctacggataaccctcgctcagcaaacactctctggcagaaccgcaacgtgaagactggcgatatcaaagacgctatcaacacggataacaaaggcgcttctgacaatgcggacagcgaatgggcaagccagtcgaaagacttcgcaaccaccatggtgaatcagcctgggggcgttggcgtatggaacaacttcaatgagcagggccgccgcctgacttatctaaatatccagaaaggcatgagtcccagcgacgcggcgaagcaggcatatcaggacgtgctcggatcgcagtaccagacgcagggttcatggcgccttcctgttaagtacgggctggacttgagtgatgttcgcgatggcgcaaaccattatctggaaaacctgaaggccgaacagattatgccgcttcagggcgatccgcgcttgggtgatgaa

SEQ ID NO: 41598 - DNA, 365 bp, Glycine max
  Peptide Sequence Number=SeqID_133283
atgactagaggcaatccatctgacttacaaccctttgatcctgagatagataggacatttcatagattagttaggcatcattttataccttttgatcattctgagcactccataactagtgaatctgtgcattctgttattggtgattttgaacatcctgatcttgagcattataattttgagcattctgattatgagcattctgattttgcacattctgagaacatggcacaacctccacctcgtgagaggactctaagggaaatggttgcacctgatttcacctatgaaagcttgtgcatccaataccctgatgaggatgtcccatatgttcttaaaactggactgattcatttgcttccaaa

SEQ ID NO: 41599 - DNA, 423 bp, Glycine max
  Peptide Sequence Number=SeqID_133284
atggtgaaagttggaacctcttacgtgccgatcaacgtctcatttcgccaaaagttggcccagggcttcccggtatcaacagggacaccaggatttatttattctaaatgcgaaggatcttgccgatcacagctgtccttcctgttcagtactgaaacggggtggttatccgcgtcacaattcgcacacaagcataccgagccggaacatcagcgtggcaagtgtagccggggtgcacaggctgagctaaccatcacacccttaattgcttgcgctcactgccgctttccagttcgaacctgtcaggctgcgcaactgcttaatgaatcggccaacgcgcgggcgatcgaggcgggcctttgcgtattacgccaggcgctaagggcggagtgtgcatactggcttactatgttgggtaactga

SEQ ID NO: 41600 - DNA, 462 bp, Glycine max
  Peptide Sequence Number=SeqID_133285
atgccgaggaggaggaatgtgccgtcaagacttcgggcggatagggtatggcccggccgtattagccagtgtttcaccagcgctggaatggtgtccgaggaggaggtggccgcaataaaaaggagttccctcaagacccaccaaatttcatgcaaccatgccaccccaattcccaagtggggaactggcgcatatgagggtcgattctttgaggatcctaacgatgagggtttgacgatcaatttcaaccgagatgtaagccaaatgatgaacgaagaggaggaagaggacgtcctttcaccagagttggagaggttgatcgctcaggaagaacgtgaaatgaagcctcaccaagaaaaaaccgaattggtaaacttggggaccacggaggaaaagaaagaagtaaaggtaggaaccggtatgaccgcgcctatccgccaaggcttgataaacccttcttaa

SEQ ID NO: 41601 - DNA, 435 bp, Glycine max
  Peptide Sequence Number=SeqID_133286
atggggtcctatggtggtcacagctcaaccggagagggtgctacgacaatttggttacattcagagcatccctatgtcgcctatgataggtggatgcattttgcggaccacgtactagctgtgggtgagctctgtctagtgcctgggcaggcaggtgaccagcctagagatgcacctgccgcagaccctgaggagtacatgcagccgcccagcccccaggttccagtggcatttgacccccctccacatgcagtggatgattacgacggctatgaggcgattgcactgaggttggagcgtgtgctcaaccttaggatggtcactgcaggcacaaagttatatgatattatgcaggattacctgacgatcgccagaaggggagccagtgctgatagaagtgtcagggctcgacagagacgacgcacagagcattga

SEQ ID NO: 41602 - DNA, 281 bp, Glycine max
  Peptide Sequence Number=SeqID_133287
gcggtgttgtccttgctgaggtgttgttggctgattcacgattcactcgaccggatatgggttttcacccaacaaaactcaatttcgtgcctagcgatgcggatgaggcgccactcgatgttttccatttgcctgcatgcctttggtattgtggggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 41603 - DNA, 747 bp, Glycine max
  Peptide Sequence Number=SeqID_133288
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgtgttctatccctccacgacaagagttgccaaggtagtgaaaatctcagcacaagagttggacaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgattctatcttcatgcgaaggatgtcccatgagaggagtgccatcagacgaaagcatcacacctttcatcgcacgaggtttcagtgaccacaacgcgagggacagagagcttaggggaagcagtaatgggatcatcgacggctatcataagtggctgagagtccgaacacaaggattggattggctcccaaatctaaagactgtgagagacgatgaggttaaagcttcggaagaaagtgatgaggtacaagccctaaaggcagagcttgaaagagcc

SEQ ID NO: 41604 - DNA, 495 bp, Glycine max
  Peptide Sequence Number=SeqID_133289
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtcccggcggtgcttttgccgttacgcaccaccccgtcagtagctgaacaggagggacagctgatagaaacagaagccactggagcacctcaaaaacaccatcatacactaaatcagtaa

SEQ ID NO: 41605 - DNA, 426 bp, Glycine max
  Peptide Sequence Number=SeqID_133290
atggtgaaagttggaacgtcttacgtgccgatcaacgtctcatttcgccaaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggttttggctttggctgtcgtgtcagctggtgtagctgttgcaactgtaacaatcaagcttatcgataccgtcgacctcgagggggggcccggtaccagcttttgttccctttag

SEQ ID NO: 41606 - DNA, 378 bp, Glycine max
  Peptide Sequence Number=SeqID_133291
atggcgcaagttactgttatgatcgacggaaaggcctatcgcatggcgtgcgaagcaggccaggaagaccacctgaccgaccttgccacccgtttcgaccggtatgtggggcatctcaagagccagttcggagaaatcggcgacctgaggctaacggtgatggctggtatcatggtgatggacgagctttccgagctcaaccgcaagatcgagaagctggaaggtgaggtcgcatccctctcccgcaatcgcgatggcatggccgagcacaaggcgaagtcggatgagatggtggcgcttgccatcggcgatctggccgaccggctgaacggcattaccgaaaaattgctggaccgcccaaaaccggcggcacactga

SEQ ID NO: 41607 - DNA, 1173 bp, Glycine max
  Peptide Sequence Number=SeqID_133292
atgcaggacaactacgcttttattgccgatgcgatcgacacgcgatgtcgcacgttaaccgacatcgccgatgcgatctgggatcatcctgaaacccgctttgaagagttctggtccgccgaacggcttgccagcgcgctggaagccgaaggtttcaccctcacgcgcgaggcgggcggcattcccaacgcctttattgccagcttcggcagcggaaaaccggttatcgccctgctgggtgaatacgatgcgctggccgggttaagccagcaggcacactgtgcgaccccacaatcccccacgccgggggctaacggccacggctgcgggcataatttgctgggcaccgcagcccttgccggggcggtcgcggtaaaaagctggctggagcagcacggcggcggcgggacagtgcgtttttacggctgtcctggtgaggaaggcggctccgggaaaacctttatggtgcgcgaagggctgtttgacgacgtcgatgccgccgtgacctggcacccggaggcctttgccgggatgtttaacgtcagcacgctggccaatattcaggccgcctggcgttttaagggggtggcggcacatgcggccaactctccgcatctggggcgcagcgcgctggatgcagtgacgctgatgactaccggcaccaacttcctcaacgaacacattattgagaaagcgcgcgtccattacgccattaccgataccggcggcatctctccgaacgtggtacaggcgcaggccgaagtgctgtacctgatccgcgccccggagatggccgacgcgcagcatatctacgcgcggattgagaagattgctcagggtgcggcgttgatgaccgagacctccgttgagtgtcgctttgataaagcctgctccagctacctgccaaaccgcacgctggaagcagcgatgtatcgcgccctgcagcattacggtacgccagcctggacggagaaagaacgcgcctttgcccgggagatccgcaccaccctgacgccaaacgatctgcaaaacagcctgaagaatattgccgcaaccgggggtgatgaaggtaaagcctttgcccgccgccaccaggagaccctgctggtggacgaggtcgcgccttacgccatcaccgccaacgtgctggcaggctcaacggacgtgggtgat

SEQ ID NO: 41608 - DNA, 396 bp, Glycine max
  Peptide Sequence Number=SeqID_133293
atggtggaactacttcggaccaattccacagatatttccagaagaagtccaacagggattccaacaattcagcaagctcttcaacaacaaggaatcaagaattccgacagacttaaaatacttttccaatatggaaaaaccgaaaatagcaagcagtatccaccattgcagagacacacctttgtaaagtggtggtcacaattcgatacctcaaaggctgctccagaacaagtcaagaactggtttcagagcaaccctgagtttctcaaacctgctgatccagagacatctttgtttctgaatcagaagtctcaacttgtagcatttttggcaagctcaaaatctaaagaaagtcttactcagaatcttaaggaagttctccaactacttcaatag

SEQ ID NO: 41609 - DNA, 887 bp, Glycine max
  Peptide Sequence Number=SeqID_133294
atgggaacaaatcaaactggcaaaaggttttatcaagtcaagattaagggcctagatatcaccagcattaaggagttggggcggttgatgggacctctccaaatgcaagccttccgcaaggcatgcttcacgtttggagacttccaattagtatcgactgttgaagaatttgaggagattctaggatgtcctcttgggggaaggaaaccgtatcttttctccggatttcttccctcattgagcaagattgcagttgtggtcagggattcggcgagaggatcggatcgtgtaaagcaaactcgaaacgacatagtgggcctaccacggaagtacttagaagaggagtggatcccgtttgtggacgtattagcattgctaatctttggggttgtcctctttccaaacgtggatggtttggtggacctagccgcgattgatgctttccttgcatatcaccatagcaaagagagcccagtggtagctatcttggcggacttatttgatacatttgaccgaaggtgcgagaagagtagcgcacagatcatctgctgcttacccgctctttgtagtagattgggaccaacacttggctgggataggaggcagaacaatcaactggtttcctcgatggaaggaaggaaaggagggagttctcttctcatgtggggactacccaaacatcccattgatagggacgaggggggagcaccgacggaagagagcctctctcctttccttgtgagagatttcggcgcgcaaagcttcaaggttatacaaagagtccacaaggcgtgggaaagcccgttaaggaaagataaagaacttaggggcatccgtaatggcatcttcggtggttatcatgaatggctgaaagttcatactcgagg

SEQ ID NO: 41610 - DNA, 215 bp, Glycine max
  Peptide Sequence Number=SeqID_133295
atgggagctggccatgcccgaagtcgttaccttaaccgcaaggagggggatgccgaaggcagggctagtgactggagtgaagtcgtaacaaggaaagagagggatggggtttctcttgcttttggcatagcgggccccggcgggaggctcgcacgacgggctattagctcagtggtagagcgcgcctctgataattgcgtcgttgtgcctggact

SEQ ID NO: 41611 - DNA, 291 bp, Glycine max
  Peptide Sequence Number=SeqID_133296
atgactgagacaagtatgcgagcagggaattccgatgtgtatggattcctcgagccacagactattcatagatctgggcaatcacaatttgaatcaaaaagttacatgaagagttggatacactggcaaatggtcgtcattctgcctaaggaaaacgttgttgtctggtttttttcgttgcataacagaccaaacaactaccttaagggaataattaacagtgctttgaaaggacttgatgatactccacaacctaaatccaaggctggtgctaggtggattgttattaag

SEQ ID NO: 41612 - DNA, 402 bp, Glycine max
  Peptide Sequence Number=SeqID_133297
atggtcacccgcgactctcgtcaaccgagaggagcgaaattagtgtcatacactgattttcggggacctttgcttgatgacatgcgaccattctttggtccttgtgaggggcaactgtcataccctaatttcgtccggggacctttgctcgatgacgtgcgaccattctttggtcctcgtgagaaggcggttgcttctggaggaagcaaccctgctcgcctgggcgagctgggcggcaacctcctcccctattttgctataaataggggaggaaggcaagaaggaagggccgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 41613 - DNA, 575 bp, Glycine max
  Peptide Sequence Number=SeqID_133298
atggctacctcaccaaaagaaacttccgcttctggttcacccgctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaagagactcctgcaccacgggcaccagaacctgctccaggtgacctcattgacttagaagaagtcgaatctgatgaagaacccattgccaacaggttggcacctggcattgctgaacgattacaaagccgaaaagcgaaaactcccatcaagag

SEQ ID NO: 41614 - DNA, 957 bp, Glycine max
  Peptide Sequence Number=SeqID_133299
atggcaagagttgcaaaagtggtcaagatcttggtgcaagagttagagcgagaagcacttggaggagaaggaaaaagctttggcagatcaagagagtggacttcattcgttgatgttttagcagtgttggtatttgggatcgtgctcttttcaaatgtagatgggctactggattgggaggagctctgggcagggttcccaaatgtccccttgatgggaacaaggggtggtgttaattataatcccatgctggccataagacaactaggctaccctatgagaggggtgccgtcggaagagattatcgcgcctttcatcacatggggtttcaatgaaggcaatattcagagagtacaaaaagcatggaatgtggtggaaagaagagatagggagcttaggggaagcagcaatggcatcatcggtggctatcataagtggttgaaggctaggacgcaagagataacttggctcccaaagctgaaaagtccaagtggggaagaagctgaagttcctaaggaaagtgaagaagtgcaagccttgaaggcagagcttgaaagagtgaaggagtgtgatgagctaaggcatgccaacatgaccacagctgaagcggctaaaagggacgagtcaagggtggaaggcatgatattagaggacaagttgaaggcttgtcaaaggtcaaagagaagtttgactgaacagctgagtaggacggaagagaatatgttgacaatcattgaccagtataaagagaagctaaacctagctgctagccatgagcaaaggctagaggacaagcatgcgaaggtatcggctctgcacgtggaaaaagaagcaagagagagagtgatagaatcattgcatggaaaagctatgaaatggctggataggttcgctcacactctgaatgggagtcaagagctttcaagcctgttagccaaagccaaggcaatggcggat

SEQ ID NO: 41615 - DNA, 993 bp, Glycine max
  Peptide Sequence Number=SeqID_133300
atgttggtgcacacgatccgcacttgtctctttgcagtggcacgggtcaaatcttgccccggtatgcatagtagctacgtgatagcctccctctctggttgtattcacaaagttggcgccctccaatatcaggggatgtggagccctctgaaagcgaggacacgtagccctctaaaggcgagggtgtgcagcactctgatgttggagacgtatcgctctttgaaggtgagggcgtgcatgcctctaaaggcgagggcgtgcagccctctgatggtgagggcatgtagccctctaaaggcgaggacatgcatccctatgaaggcgagggcgtgcaaccctatgaaggcgagggcgtgcagccctctgatggtgaaggcgtgtagccctctaaaggcgaggacctgtagtcctctgaaggcgaggacacatagtcctctaaaggtcagggcgtgtagccctctgaaggcgaggacgtgtagtcctctaaaggtgaggacatgtagtcctctgatggcgaggacgtgtagtcctctgaaggtgagggcgtgtagccctcaacaagagaggatgtgtagtcctctgaaggcaaggatgcgtagtcctctaaaggtgaaggtgtgcagccctctgatggcgaggacatgcaaccctatgaaggcaagggcgtgcaaccctatgaaggcgagggcgtgcagctctctgatggtgagggcgtgtagccctcaaaagccaaggacgtgcagtcctctgaaggcgaggacgcatagtcctttaaaggtgagggcgtgtagccctatgaaggcgaggacatgcagccctatgaaggtgagggcgtgcaaccctatgaaggcgaggacgtgcagccctttgatggtgagggcgtgtagccctctaaagacgaggacatgtagtcctccgaaggcgaggacacgtagtcctctaaaggcgagggcgtgtagccctctgaaggcgaggacgtgtagccctcggaag

SEQ ID NO: 41616 - DNA, 456 bp, Glycine max
  Peptide Sequence Number=SeqID_133301
atggaatcacaaattccaacagatcttaaatacttctcaagctttgcactgtcatggatcttctcatggcaatatcgttacagcaagactgaaaagacaaaccaatatccatcactacaaagacacgcatttgtaaaatggtggtcacaatttgactcatccaaagcagatccagaacaagtaaaactctcgttccaatcccatccagaattcctcaaagcagttgatccagaaacttctgtgtttttgaaccaaaagtctcatctggcagtatttttagcaagatcgaaatcaaaggagatccaaactaaaaatctaaaggaagttctgcaaatgttacaacaggaagaagaaggttcatcctcaaagaaggaagaaacaagttctgctgaagaagaagaagaagaccccttttaccaaaataaagatgattgttttggtatctgtttagattaa

SEQ ID NO: 41617 - DNA, 599 bp, Glycine max
  Peptide Sequence Number=SeqID_133302
ctgggttacggtgcccaactgcgcgctacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaaatgagaactttgaaggccgaagaggggaaaggttccatggaatcgggttaaaattcctgaaccgggacgtggcggctgacggcaacgttagggagtccggagacgtcggcgggggccccggaaagagttatcttttctgtttaacaacctgcccaccctggaaacggctcagccggagggtgaccctcgtgacgcggattatccttatgagaagccctgaaggtcaattcccagagagcggtggaggaaaaggattggctcgatccactgagattcaggcctccagtcctggattcgtccctcccctccaaatcaccaacaaaccctgtcccccccaaaaaaccaatcaatccggtgtgtgcccgggcggacggacgaccaagcccctcctcccccttgtgcctgcgtga

SEQ ID NO: 41618 - DNA, 860 bp, Glycine max
  Peptide Sequence Number=SeqID_133303
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctcgacgccagaatccatcgagtttgaatttcttcttcaaatctacggagatatgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41619 - DNA, 219 bp, Glycine max
  Peptide Sequence Number=SeqID_133304
atgggaaatgcttttcaatgtctgcagagccagggttttacttcttttccgtgccctactccggatcagtttagggcagagttcgcatggctcgaagattggcctgaggcccgggcaggagaggcaccagcagaggctcccgacgaggcagatgaggcccgcgaggacgaggagatgaccgatttgcttgatttcttgggagggagcggagccacatga

SEQ ID NO: 41620 - DNA, 426 bp, Glycine max
  Peptide Sequence Number=SeqID_133305
atggtggcacgggttatgctcaagcacggatttgagcccggaatgggtctaggcaaggacggcctcgggaatgccgacgtagtcgatattaagggaaatccgtacaaatatggattagggtatgaacccgggatgccggggaggagaaatgtgccgtcaagacttagggcggatagagtatggcccgaccgtattggccagtgtttcgccaatgccggattgatgtccaaggaggaagtggccgcagtaggagaggagttccctcaagacccgccaaatttcgtgcaaccatgccatcccgattcccaagtggggaactggcgcgtgataagccagtcagaggtctataccactgattcaatatatgagggtcgattctttgaggatcctaacaatgagggtttgacgatcgatttcgatcgagat

SEQ ID NO: 41621 - DNA, 441 bp, Glycine max
  Peptide Sequence Number=SeqID_133306
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgattcgacccacgcgtccgactagttctagatcgcgagcggccgctcgcgatctagaactagcggacgcgtgggtcgaatcaagcttatcgataccgtcgacctcgagggggggcccggtaccagcttttgttccctttagtgagggttaa

SEQ ID NO: 41622 - DNA, 216 bp, Glycine max
  Peptide Sequence Number=SeqID_133307
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttgaagtgtgcgattcctcaaggctctag

SEQ ID NO: 41623 - DNA, 195 bp, Glycine max
  Peptide Sequence Number=SeqID_133308
atgactctattttgcacacgacttcctatcgaatcaaagatcaaacgtggggtgggatatcgccagtcgagaacgaccttgaatggcaatctgaaaggaagagacaccaaaaatgggttttccttcgccggcagtcacttaccctgccgaaaatttatctggtctgaagatcttccgttctctctcttccattga

SEQ ID NO: 41624 - DNA, 648 bp, Glycine max
  Peptide Sequence Number=SeqID_133309
atggctacctcaccaaaagaaactgcagattctggttcacccgctgtaccatcatctccgcaccaggaacaactagagttcaacatccaacccatacaaataattcctggtcaagcttcagtccctgagaaactggttcccagaagacaacagggagtgaagatttctgaaaaccctagccttgcaacaagtcctagggaagtagacacggagatggacaagaaaatccgcagtattgtgagtagcattctgaaagatgcttctgtgcctgaagctgatgaagatgtcccaacatcgtccaccccaaatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcagaaaggttacaaggcagaaagggaaaaacccccattaagaggtctggacgaatcaagactatggcccagaagaagagcactccagtcactcctaccacatccagaagaagcaag

SEQ ID NO: 41625 - DNA, 327 bp, Glycine max
  Peptide Sequence Number=SeqID_133310
atgggggtgcaaatagcaaccaggcccacttgggccctccagaagattcctccagaaggcttttgcttctggaggaagcaaccctgctcgcctgggcaagctggaaaatccaagccgaggcgcttccgtaacgtttccgtgagtgatttcgcgaaggttttcgaccgttcttcgatgttcttcattcgttcttcatcgttcttcagtcttcaacgggagcaaaagccccgcttttgtcgaccaccccaagagatcgttaatggtccaaatgccttaacgtttctctcctttcaaaaacaagagatcgttaatggtccaacgccttaa

SEQ ID NO: 41626 - DNA, 342 bp, Glycine max
  Peptide Sequence Number=SeqID_133311
atgcattgtatgttggtctcgtcctttgtcacagagaagccggaaggtccatatcaccttcttaattgtacacatggggcactgcgcccccaaatgtgcaatattggcgatcagaattgccattccttggattatagggttgaaccaagctcaagcttttacaaaaaggttcatcaagtcaagttgaaatatggaagtaaccgtcttgcaaaattggggcaaaagatgaatcgagtcacatcactgcttcgtccactgccaaacatatttaggattattgatgtccttgttacttccagtttcaccttgacaaagatgtcatggaccatgttgaaaatctaa

SEQ ID NO: 41627 - DNA, 369 bp, Glycine max
  Peptide Sequence Number=SeqID_133312
atggttctatcagctgttccctcctgttcagtactgacggggtggtgcgtaatcggcaaaagcataccgaccggacatagcgggcaagtgcgcgtcccattcgccattcaggctgcgcaactgttcgggaagggcgatcggtgcgggcctcttcgctattatgcgccagctggcgaaagggggatgtgctgcaagtttgcgattaagttgggtaacgccagggtttcagtcacgacgttgtataaacgacggcacagtgaattgtatgactcactgatgagggtgcgaattggagctccaccgcggtggcaggcctcagaaaaagtgcccgggctgcaggaattcgattactatgtgaacaggatataa

SEQ ID NO: 41628 - DNA, 755 bp, Glycine max
  Peptide Sequence Number=SeqID_133313
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggagttttcaaagatgtttgtgcgtgaggaagtccatcaaaggggtagggagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41629 - DNA, 306 bp, Glycine max
  Peptide Sequence Number=SeqID_133314
atggaaaaatccgacaagatgaatttcaaagagaagaaagaaaagaaaggatatatcacttgggaagataatgccataaattattcaagtgattcagagaagaaaatcataagtttgggtatcatgatgaaagactatgaaaatggagaagaacaaagtcgatacattgatagcaatttctccaaacacatggcatgcatcaaagtttattcacatttctccccaagaaaagtgaatctcaagaaaagtgaatatatgatttatggagacaacaaaggccacttgatcaacaagcccaacaagtga

SEQ ID NO: 41630 - DNA, 795 bp, Glycine max
  Peptide Sequence Number=SeqID_133315
atggctaagagttcatacgcgaggaacttcgaagctccggaggaagatgaagaagtccaagctctaaaattagagctagggaaggcaagactcgccaaagaaaagttcaagtcagccgctaccaacatccggaaagagtgcaccaagttacgagaggaaaacgcagccactgcaagagcccttgaacaagaaaccaaaagggcccgcaaggaggaacatgaccgagataaattccgaggagctttgtggggtagcaacaatgagcttaagctccggagagaggaaagagaccagtcacgagtgcatggcatgatcttaaaagaagagttagctgcttgcgcaagatccaagaggagtttggctcaacacttggaagccacggagcaaagcatgctagctatcatagggcagtacaaggaagagttaaaccagtctgtgacccatgaacaaaagctagtagaggatttcgcacaagtgtacgccgaaaaggaagcaagagggagggtgattgacgcactgcatcaagaagcgactatgtggatggatagggaattcaccataactaagaaagcacaaaggcacccctataacactcgatccagaaaaatggacaatgaagagggcgtgcaagaacagatgaaggccgacctatcggccttaaaagatcaaatggcttctatcacggaggccatgctaaaactccagaaaactatagaggataatgccacggcgaccgcctccaatgcagttagggaagcggaaccggtgctacagcccgtaataaacttgggctga

SEQ ID NO: 41631 - DNA, 420 bp, Glycine max
  Peptide Sequence Number=SeqID_133316
atgacgagtgcggataactgtaaggtgtctccgcatgctactggactctcgggtcactggatagcaaagggtgtgtgcgggttaccatcgggtgtctccacatgcccatcggactcttgggtcacggtaacaaaaagtggggtggtcgacaaaagcagggcttttgctcctacgtatcctcaatttgtgatgaggaactcagacctacgtagttcttgcgaaagcggtgtcttcgcatgctaccggactctcgggtcgctggatagcaaagggtgtttgcgggttatcatcgggtgtttccgcatgccaccggactcttgggtcacggtaacaaaaggtggggtggtcgacaaaagcagggcttttgctcctacgtatcctcaatttgtgatgaggaactcagacctacgtagttcttga

SEQ ID NO: 41632 - DNA, 363 bp, Glycine max
  Peptide Sequence Number=SeqID_133317
gatcccctatatcagactgagctagatgactttgaggccgagctggagaggcataatttccataaacacctcaccaatttagccgatgggagcatagacctggctttgggagagactctacccgcctactccagatactgcaggttgcctacaaacttcagagagataaaggctgccttatgcatacctagccgagggttcattttgaactctaagggccaacctgggaagattctcaggaaggacctgactacactggctcagcctaacacctctagacttgggttccctgctctaatcaccgcattatgcagagccagaggggttgtatctgacagccttaccttcgagtgcctgagcccg

SEQ ID NO: 41633 - DNA, 213 bp, Glycine max
  Peptide Sequence Number=SeqID_133318
atgccagctgatccatattctatagtggcagatccatcttctcccaaacttgaagtagctcccccatcttcacctattattatcatctctgaagactctatagagtcagcatctggagaagtagttgctctctctaattcccctgtttttcatctgatagatgaggaggatgctcagactcgggatacccaggatcagtctcaggacttttaa

SEQ ID NO: 41634 - DNA, 677 bp, Glycine max
  Peptide Sequence Number=SeqID_133319
atgggtgaagtagaggaggtgcaagagcagatgaaggccgacatggaggccatgaaagagaaaatggccacaaagatggaggccatgatgagcatgaagaagataatggaagtcaaagcggtacaattgccgctccagcactgttctatggtaggcaagatttgggaagcacgggcggccccccattatgcgcaaagtcaaaacaggcaggccttcccaccatatggcttgcctcccaactatacaccacccaatgtagcgtacactcccagtgagaatgtcaacaactccactcccatactcattgagagcgggcaaccccaaactgatcatgcacatgtctctcaacccatgggtgagacacatgaaatgccccaccacaatctagtcgacttcgagccttgcctcgaatatgccactgaagggcaggcaattggtggtatacccctacaaaaccctttggagggccctcagtatcacccccagctacacctcttgcattacacaacaagtaaaaaccctcatgctatggcagaaatgggaaagttggatcatctagaggaaaggcttagggccattgaaggaggtgaagattatgcctttgctaacctaggagagttgttcctagtacccaatatcatcacccctcccaagttcaaggtgctggactttgacaa

SEQ ID NO: 41635 - DNA, 177 bp, Glycine max
  Peptide Sequence Number=SeqID_133320
ggcagaatcatcttaggcaacggtcagaggtcgagacaaggtcaaaggcagaaaccaatcaaggtacttagggatggacgcaaggagaggctagggtcacgaccaatgggtcgtcgtcccttgcctagctctggacaaatggaaagcgccgctgcaaggcagcctagtatcctttaa

SEQ ID NO: 41636 - DNA, 159 bp, Glycine max
  Peptide Sequence Number=SeqID_133321
atgtatggtcttccaaaccttatagagggtattactgatgcaatccaccctaggaagggaccaatcactagaaccatgagcaagaggctccaagaagattgggctagagttgctgaagaaggccctagggttctcatgaaccttagggtagatttctga

SEQ ID NO: 41637 - DNA, 420 bp, Glycine max
  Peptide Sequence Number=SeqID_133322
atgttacggaatttcacagattgtgtaacaacgcttccttttgatttccgacatgttacagaacttcacgtattgtgcaacaatggatgcaaaaatacctcgaagtggtcatacgaaagtcgcacgccaccaaacaatggtccccggacgaaattagggtatgacactttggataaagaatcaactagaaggctacaacatctctctttctcaaaagataaagtccaagaccttttgaatcaggctttgttgaagcaaaaggaagaaactcaagcattgattaaccaatctatagcgcaacaaatgaaggagacgaggaaggaattgcaagcctatgttgaacaaaaaagattggagaataagcaatataagaaatccatccagtctgctattgctactcagttcactggtctatcataa

SEQ ID NO: 41638 - DNA, 801 bp, Glycine max
  Peptide Sequence Number=SeqID_133323
atgcgggcgcaggacaaaggattgaaggtcgggcagcgcgtgggtatcggctggaccgcgaaaagctgccagcactgtgatgcctgcatcaatggcgagcaggtcaactgtgagaacggttcagtgccaaccatcatgaacaaaggcggtttcgccagccatctgcgcgccgactggcagtgggtgattccgctgccggaatccatggacatcacctctgccggtccgctgctgtgcggcgggattaccgtgtttaaaccgctgctgatgcaccatgtaacggccaccagccgcgtcggcgttatcggtattggcggcctcggccatatggcgatcaaactgctgcgcgccatgggtgctgaagttacggcgttcagctcgaatgccagcaaaaccgaatccatcaaagccatgggcgccgatcgtgtggtcaacagccgcgatccgcaggcgctgaacgcgctggccgggcaatttgatttgattatcagcactgtagctgtcgatctggactggcagccgtacttccaggcgctggctccgcacggtaagttccacaccgtgggcgcggtgatgaagccatttgaagtgccggcgttcagtctgattctgggcgatcgcgcggtaacgggttcttctaccggttcaccgggccagctgcgtaagctgatgcgtctggcgtcacgcgccgatgtggcaccgcaggtagaagagttcccgatgtcaaaaatcaatgaagcgctggatcacgtacgcgccggtaaagctaattaccgcgtggtgctgaaggccgatttctga

SEQ ID NO: 41639 - DNA, 270 bp, Glycine max
  Peptide Sequence Number=SeqID_133324
atgcgtctaccagggaaggagagtctgctgatgggatcccccataaccataaatgagatcttggatgttagcatttcgtttctaaatgaccatttagaggaaacactgggttcgacaaaaatagaagaaaatcactcaaagtgtatcaatctcgcacagtgcggggcgaaaaaaaagtcgctagcgcacgggattttggttggtaatcaaagggagaagaccattttaggtcgtggtttcctttcctccctttttttgttcatttggtga

SEQ ID NO: 41640 - DNA, 108 bp, Glycine max
  Peptide Sequence Number=SeqID_133325
gcagctgtgtctccagcaaagccttcagataaaccaaatcctgaggtcgatgatcccctgtatctgatgacattgatcatcccacaacttttcttgaagcctctctga

SEQ ID NO: 41641 - DNA, 276 bp, Glycine max
  Peptide Sequence Number=SeqID_133326
atggtgaaagttggaacctcttacgtgccgatcaacgtctcattttcgccaaaagttggcccagggcttcccggtatcaaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 41642 - DNA, 248 bp, Glycine max
  Peptide Sequence Number=SeqID_133327
atatagaagaggatgctgacattcctctcattcttggccgcccattcatgtctactgcaagctgcatggtagacatagggaaaaagatgctgcagatgggcatagaagatcagaagatcaagtttgatttgttcgatgaagacaaagatccacctagccaaaatgtctgtcttaaagtgcatgtgatggaggaaaggagactcgagaagaaggtccttgaagtaggaactttgttggatcctggataa

SEQ ID NO: 41643 - DNA, 314 bp, Glycine max
  Peptide Sequence Number=SeqID_133328
ttttccatgagcaatttcagcatataaacatcacaaacatcatcacaaaaaccctaaaacagaatggaaaactaacaaaactacccatcatatctcccaaaaccccatacccacgaaaatcaaaggagaaagaagtccacccaaacctgaaatttcgaagtcccactcgtagccacgcacttcacgactccaaaaatgccctcctttcgcgatttggagcagaaatgagcaccaaaggttggagctttgttggggtttcaatggagaatggaggagaaggaaaaagcaacgtgaggaagagggagagcttctga

SEQ ID NO: 41644 - DNA, 218 bp, Glycine max
  Peptide Sequence Number=SeqID_133329
gttagatgggatgccaccgtgttcggggtcgttaatccatatttccccctatacataaagcacgaagacctctccaaaatcgcacacggtggtcaatgtctcagcatatcaatgttacagttgtggattctgccagacaactaccttaaggggattattaatagtgctatcaagggtcttgatgatgctccacagcctaaatcaaaggctcttgctag

SEQ ID NO: 41645 - DNA, 327 bp, Glycine max
  Peptide Sequence Number=SeqID_133330
caactccagtattctcgggcaggatgtcaggacattgtatccgacatcgtggatcctgcagcttcacttctgcacttgacttttatcttgcattgtacaacaactccagtattctcgggcaggatcccgatctcattccttgacataacgttggacatcatgtgcagcaactccagctttccttcattgtctaaagcttctgttttcaattacgagcgtctcgatatattatgggactcaatcggacatccgagtaaaagagcttctgttttcaattacgagagtctcgatatattacgggactcaatcggacatccgagtaaaaag

SEQ ID NO: 41646 - DNA, 171 bp, Glycine max
  Peptide Sequence Number=SeqID_133331
atgggtagactctttcacaagaatctaactgcgctgcacacgatttgtctcataaccactacatgcaagctggtaatcgattaccagaggctccctaagtttcctgacttctttttcaagcctggtaatcgattacaccccttggtaatcgattaccagagaccatcttag

SEQ ID NO: 41647 - DNA, 216 bp, Glycine max
  Peptide Sequence Number=SeqID_133332
atggcctacaagactaagcccaacatggttcagtccaacactgatcagagtaaggaaactgattctgaaaaattaaattttgaggtggagactgaggataaacatgctgcaacacaagctgttaattggcctcttgatgaagaaaaatttgaagaagaagaacaagaagaagctgactatctgccagtgaagtttggaggaagggggatcctctag

SEQ ID NO: 41648 - DNA, 111 bp, Glycine max
  Peptide Sequence Number=SeqID_133333
atagcattgaacctgtatcaagagccgaagctctgataccagatgatgtgatcctaactaggagcggattgcttgatacagagaacaaagatttggatgatgccacttccg

SEQ ID NO: 41649 - DNA, 393 bp, Glycine max
  Peptide Sequence Number=SeqID_133334
atgtcggccttcaccttctcttgcacctcctctgctttacccattactctagctctagcacagattttcaacatggtccatgacatcttcatcaaggtgaaactggaagtaacagggacatcgacagccctaaatgtgtttggcagtagacgaagcagcgatgtaacacgagcttttcgtaagatggttacttccatacttcaacttgactcgatgaaccttttcgtaaaagcacgagcttggttcaaccccataacccagggaatggcaattttgattgtcaatacttcatcaacatttcattgggatgaaagactcgagaatacgcatgctatgcatgggaaatgtaattatgagattgagatgtccaaagaaacatcctttcttagttaa

SEQ ID NO: 41650 - DNA, 72 bp, Glycine max
  Peptide Sequence Number=SeqID_133335
gaatttcgcgaaggtttcgatcgttcttcgacgttcttcattcgttcttcatcgttcttcgatcttcaatgg

SEQ ID NO: 41651 - DNA, 243 bp, Glycine max
  Peptide Sequence Number=SeqID_133336
atggcacttggtttgcacttcgtggttcttgcagcggcgagtaaaacttacactaattgtgctgccattcgcaaaaccgttaaatttctactttcaacactgaaagaggatgggaacattgtggttgaacatgattatgctgagtgcactggatctgctattcaagctttagttttgtttaagaagctatatccaaggcatagggagacagagataaagaattccatcaatgcagtcatgtga

SEQ ID NO: 41652 - DNA, 1584 bp, Glycine max
  Peptide Sequence Number=SeqID_133337
atgagaaaattaactttaatcgctgtaacagctttatctttaacagcttgtcgtgagaatgattctttatcagattcttctaaatttgaaatgcaatctgcttctgcagaatatttaactgcttctgcacttcctgtgactacagtaagtggtgctattactaccaatactacatggagtggagtggttgaaattgatggaatcgtaactgttaaaggtggagctactttgactatccagccaggtactttcattaaagctaaacctaatacaacaaatacacctacaggagttttggttattgctaaaactgggaaaataaacgctacaggaactgcttctcagccgatcatctttacaagctacagattattggacggagatgaagatactacagcaactccaggtgatttcggaggggttatcatgttgggagatgctcctacaaacaagcctacaactactgttatcgaagggttaacaggtgctgattaccaatatggaggtacgaatgccgctcataatgggggaactattaaatatgcacgtatcgaattcggtggattcgaccttttcgctcctaactcaggaaacgaaatcaacggattaacattaggtggagtaggtaacggaactacactagaccacatccaggtatcttatggtaaagatgattcttttgaattcttcggaggtactgtaaacgcttcaaaccttgtatctttcgctccggacgatgataacttcgattttgacttcggatatacaggaacaattacttgtgcattagctttagctgattacaactcaacgcacagtcaaagtggtggagtttctgatacgaacggtattgagcttgataacgacggaacaggttctactgcttctccatttacccgtcctacaattaaaaatcttacaattgttggtgctaaaagcccattaaaaggtggattatatgaaaatgccatccacgtaagaagaaacggttatcctatcggaattttattggaaactcagagcagtgctccggtaaatcttgcagaccttagctttacaggagtacaggcacatggatttacattcgctactgcttctaagatcggtactaccactgctgctcttactattcctggagtaactacttctacaagtaatcctgctaacctttggggaatgtctcagccattctttaacgaggctacagcatggaacgtttctccaagaaactgtggagatttccaggtgtctgcacaatatcctgtatggactaattcttttaattcaacaagtgatatgcagggatggtctttccatgatctgaacggaaacggaaatggatgggtacaaggaccgaacatctaccataacggtacttctttggcttatggaggggctggttctcttcgttactcaatcagtaatgttccttccggaaatgtggccggtttcactacagaaaatgactgggccatttctccggagattgatctcacttcatcttcaggaacgattacattagcggcatacataggacgtcagagaacaacacatcaggtggtaaagagatatctgtacatctat

SEQ ID NO: 41653 - DNA, 326 bp, Glycine max
  Peptide Sequence Number=SeqID_133338
ggacgggggaagcccgtctgatagcgctctgtgcgcgtactccgaaagggaatcggcctgcccaccctggaaacggctcagccggagtcccgaacccgtcggctgtcggtggactgctcgagctgcttccgcggcgagagcgggtcgtcgcgtgccggtcgggggacggatttgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 41654 - DNA, 322 bp, Glycine max
  Peptide Sequence Number=SeqID_133339
atgtccttatcagccgagcaccagcagcgcttcgaggccatcaaaggatggtcgttccacagagagaggcgcgcccagctcaggaaggatgagtatacggactttcaggaggagatagctcgcagacgttggacttcgctggtgactcccatggctaagtttgaccttgagatagtcctagagttctacgctaatgcttggcccacagaggagggagtgcgagacatgcattcatgggtgaggggtcagtggattccctttgatgcagatgccctcagccagttcctgggtgacccgctagttttggaggaaggccagcaat

SEQ ID NO: 41655 - DNA, 84 bp, Glycine max
  Peptide Sequence Number=SeqID_133340
atggagtatgagacaccaccaagggtggtgtcatcaacacggcatgagaattcttcccagaaatctcctaccaatagaatttaa

SEQ ID NO: 41656 - DNA, 1332 bp, Glycine max
  Peptide Sequence Number=SeqID_133341
atggggaatgcaggtgttgatctgaagtggctttgtgatggagatgtgcatgaaatactgatcgagttggaaggaatgggtggtggcggaaaggttcagctggaggtaaaatataaaagctatgatgaaattgatgaagagaaaaggtggtggaagataccttttgttttagactttctaaagataaagggttttgattctgcattcagaaatgttattggttctgatacagtacaggctggccaatttgtggaatatgcgtttgggcagttaaagtcttttaacaattcatatcttctgaagggccagcagtctgatattaataatgataagtatgaccctgaaggtacacgggagctgaacgaatctgtttctatattcaatatgccttctgaggaagctggtagttcagaagcctccagtgaagatttcattgaacagaggaactcaaatgaatttcacaaacaggacaatgatactgaaaatggacatgcttctgaatcattgtcaaaagttagtgaggaagggctgtcaaatcaaattttttggaggaattttgctaatgttattaattctagtattgctcaaaagctaggtctctctgttcctgaaaagttcaagtgggatggattggagtttttaaacaaaattggttcacaatcgcaaaatattgcagaaagcatttatgttcaatctggtcttgcaattcctggaggcacagatgatacaaatgataaaataagcggccaacctgccattgctgcatttcagtcttcagttccagaggtcaaaaaagcaacacagaaattgatgaggcagactgagtcaattttaggaggtttaatgcttttgactgcaacagtttccaaaataaaagacgaagggtgttcttcagaagagaggataatcaaagaaaattctaccaaagcaggaagcaatgatatacaatattctacaagtccaaagtttcctagctcacagaatggattagtgttggatgataaaaaaactgaagagatgaaagagcttttttctactgctgaaagtgccatggaggcttgggcaatgctggccacttcactgggccaacctagtttcattaagtctgaatttgaaaaaatatgtttcttagataatgcatccacagacacacagactcaatggaaggacttaagaactgatctaatgcttgtgccagccgggctaaatcctgaaaggataggcggagatttcaagcaagagattcaagttcacagtggttttctaagtgcgtatgattcagtaaggactaggatcatttctctaattcgacttgcaattggttatgtgtaa

SEQ ID NO: 41657 - DNA, 384 bp, Glycine max
  Peptide Sequence Number=SeqID_133342
atggctagactcaaccatccttcgaaagaacctcacacagaactcaacctcattacacctcttcaaagcaagaaaaagcatgaagcaagacctagcctctaccaccaacccttttgtcatcacataatcaaacaccttaagggcatctctaaacatcctattatcaacacacaccctgaacaacatgtcatatggagtctcaacaaaatggggttcaaattcacattcatcaaccaaagaaactatgcccccaaatggggtgttcagtgtgaagaggcgatagaagaggatgaggtgggcgttgaggtcgagtttgtgggagcgaggaagagggtgggggccaagaggacacgtgagttggagatgttggagggaacgaggtga

SEQ ID NO: 41658 - DNA, 675 bp, Glycine max
  Peptide Sequence Number=SeqID_133343
aggaaaaatgccatcatgcgaccaccactgatcatgcaatttatcgctgccttcaacaatgacaagaataccatacaacttccagccttctatcatactcaatgggcaccaaactatcctgagatggttcatctcagatacaatggagccatttatgaagtacgagtcagacaacacagagataaagtgtatttagcagatggactccaaagcttccggaaagatttgaaaatttataagtcaaccagcaccaacttctttgcatgtgaccatcactctgtttttgacatacatttcataccaccactggagcggcaaacttgcggcaggcagaggcattcatccaggaagcacatatggactcttcaacttactcaggaaatgttggatcatcctgaacccctgaaactcccccattgtacaaaagttccttttagagcttgcggcaaccacatgacagtcttaaggcggcatggcccctcactacaatggaaagttgaaaccctgaatcctgctattggtggaaaaggtgttgtccaaccatggtatgattttcttgaagaaatggattttgatgatggagatgaaatctctatttattataggtattatgaaaaaatttgggatatcataatcaggaggcaggaagattgggaagatgatgacagtgactag

SEQ ID NO: 41659 - DNA, 2484 bp, Glycine max
  Peptide Sequence Number=SeqID_133344
atggctactctggcaaattttcgtcctccgtattcaataccaaatcctcctccagatgcaataccagaacttgcatgttacaattcaacaatggatctttccaacaatatctggaggggtggtaatgtcattggagaacgtgttcctcttttgtctattcaaattgcctacagtgtcctgctttccagtatttttcaccgcatcttcaagtcattccacctgcctcttatggtttcccagattcttagtggtgctattttgagttcatcgttgatgggaagagtccctggaatttttaacacgctttaccgtccagaaggaatccttgcggttgaaacctttgcgaatcttggagttatgtactatgtgttcttaaatggattggagatgaactgtgacacgattataagatcaagcaagaaggctataaccattgctctcgtttgcattctgattccaatgttggggggtgctggttttcttgctctagagcatagggtatcaggaggttcagcaaagcctactgtttccacaaaaggatatttcttttgctgtgcaattcttgctgtcacaggttttccagtcgttgctaggctcctatcagggctcaagatcctctacacaaggcttggcaaagatgccttaactgcagccatgttaattgatgcatatggctggattgtcttcacaatcttgattccttattcccatgatcgcggcggaaaaccactcctctcagcaatatgcacctttttgttcattgtgttctgcttctacgtggttcgtcccatcctgactcgcatcattaaccgcaaaatcaggttggagacatgggactcctcaggtttgctggatgttatggttggacttttcatttgttcgtccatcacagattttcttggtgcacaccatgttgttggggcctttgtgtatggactcattttgcctagtggcaaatttgctgatttgatgatggaaatcttggatgatgttgttactgctcttattgttcctatctactttgctagttttggctttagactacaccttgaggcactttgggctgttcacaattcggttttgtttcctgtcctcatggtcttgttgttaaccatcccaaaggttttaggctctatgttggctactttctactttggtatgtctgctagagatggcttgggccttggattgctcctcaacactaagggcatcatggctgtcattatgctcagcgttgcctgggacaaaaatcttttggacccctatgcattcacaattatgatgctggctatactattcatgactgtgttggtctctcccctgatcaatgtgatatacaagccaaaactccggttcatgcaaacacagcaaagaactgtacagaagctaaggaatgatgcagaacttcgagtggctgtttgtgtccacaatgctcaccaagccactggcatgatccatgtccttgaagccacaaatgccaccagaatttcgcctttacaagtctcagtccttcaccttgttgaactcactagacatggcactggccttcttgttgcccagatggacaatccaagtagtgttcaaggagaaagccattatggatcacaggaagagtttgagagcatatccaaggcgtttgaagagttttcagaggaatacaatgcagtgagatttgagacatcaagtattgtgtcaacgtatgagtcaatccatgaggacatatacactgtgacacaagaaaaacgtgcaaacctagttctccttcccttccacaaacaactaagctccgaaggcgtgttggacacaaccaacaatgcattcagtggcataaaccaaaatgtgatgcaacaaccaccttgttctgttgggatctttgtgaaccggggactcgactcattgttgaaaacaaaaatgagcatcattatgatcttcattggagggcctgacgaccgcgaagccttgtcgatcgcatggagaatggcagggcattcatgcacaatgttgcatgtggtgaggcttcttctgtcaggcactgaggttgcagaagaagaaaaggcattccattctgactctaacgggttgttatctacagtgatggacagtgtgatgcagaaagagttggatgatgagcaaatattgcacttcaggcacaagggggtgcacaataatgactccatttcttactcagaaaaggaagtgaaaatagaaactggtgaggagattcctttgatcctcaatgagatagacaagcctgggtatgacttgtacattttgggacaagggagtggcaagaactacacagctttgcagaagttgttggaatggtgtgacaatcctgaacttggggccatgggggacattgtagcttcaaccagctttggcacaagctcctcactgcttgttgtgcaacaatacagcatggagagaaagcctaaaggatatcgcaaaaaatgctctaagagaaatgatcctgccatattgtga

SEQ ID NO: 41660 - DNA, 873 bp, Glycine max
  Peptide Sequence Number=SeqID_133345
atgatcaaaacaggcgcggggtgcttgtttaaggccataaagagccttttgaagcttgcaaacatggttggggaattgagggtcagccatgccaggaggcagattcaagtggttgtattgagggaggaggcccaagctcaaggtctaactcaaggttctcatgttcaggcaataagggttcttctggttgaccaaaagatgcaattggaagttgtaaggcaagagactgcattcaaggatttgagcatggtggagtggaagcagaattatgagattaactcagagtatgatggccttggaggttttagcatggttgttgcgaatgtttcatacttgtgcccgaggcttgtaaggagatggaaaactttctctttgtctgggacaggtttcccaattgcagcaaggcatgtgcctgaatttccaaaggatatgtaccatttgaataagaaggcagtttcaattaggaagcatcttgagaggaacaagaaggacaaggactccaagttcagtagtgattcactgagcccaagaaccctaaatcctttctccaatgaaactaacaaaccttctcatcgactgtttctcctcatcgtcactagcatcaccgccttgaccagcctcaacctcgctggcaccgatgctgctattgctactctccgacacagatttcgacagcgaagagggaaacttggagcgagtcaactcggaaggcttggtcttggatcccctcttgtttctcttatcttttctagaaggttttgtgagttggtggatgggagaggagtgaggatggcgacagggaggaaggagaggtggtcggagatggttgacaaggacggtgagggaaatgggtggacggttcctttatggtag

SEQ ID NO: 41661 - DNA, 364 bp, Glycine max
  Peptide Sequence Number=SeqID_133346
ggagctccaactcctcattcgcgatgaagaggtgcatacggggttagcagtggagataatcttcgaaaatggagtttgggcaaaagaggggcaaaatgaggatttgattgattggactgtggtgggtaatgttgagtttgatggtggctacgacgacgatcgagcaacttatccttttggagtttgtgggacatcaagtttcatgtgtggtctggaaggggagataggtgggggagaaggtggcggttttggggaaggtagggctgaggttagagaggcaagcttgttgacggcttcctcgagacgcttgagtgatgtatggtgcatggtatgctccgacatggtgtcaccgagcatagagcag

SEQ ID NO: 41662 - DNA, 294 bp, Glycine max
  Peptide Sequence Number=SeqID_133347
atggtgcaacatgtgtgtttgctgatattgtggttggctggcacatgttataaagttgatgaactcaatcctgagtctagtcacttgtggcttcagttctctcggtttcctagtcccagatctggacctagaccttgtggcaagaggatgggtacaactgatgaagttgcgaagccttctaagaagggaactatttttgttgaagatcttccagaagaagaacaagtagttgttgctgttgttctacttgatcctctaaagatatacgcgatattgcagtatgtttttgcttaa

SEQ ID NO: 41663 - DNA, 363 bp, Glycine max
  Peptide Sequence Number=SeqID_133348
atggagagggagatgataacaatcatagtagacacattaccagggttctactatgagaagttggtaggttacacgccttcaagctttgtcgatttagttttcattggcgaaagaatcgaagtgggtctgaaaagaggtaaatttgattatcctgctttgatggatgggaaacctggggaaaatgaagagaataagaaggagggaggaacccatgatgtgactattgttcccacacagacaaatttcccaccatctcaacaatccgttggtttctttgctcaagtgacttgcgctcctgagttgatctccaagtctgttcaatcagatactactcgttctatacgtttggtatgggttccataa

SEQ ID NO: 41664 - DNA, 393 bp, Glycine max
  Peptide Sequence Number=SeqID_133349
atggctccaaaaaagattctctctaagagggcaaggaagggtgccgcagaagaaggatccagtgcaactccacaagcagacatagaatttgacgaacaccgtttccgaaagagatgggtccaactaagagagagggaatacatgaagttccaggaggaagttgccaggcggcaatggactcaactcacagggcccatggctgaatatgactcaaaaatagtcatggaattctacgcgaatgcatggcccacagaggaaggagtcagggataagaactcctgggtatggggccaatgggtcccctatgatgaagatgccatcaatcagttcttggggcatccgttggtcctggaggaggggcagcgttgcgagttcagtgaaagaaggagctag

SEQ ID NO: 41665 - DNA, 189 bp, Glycine max
  Peptide Sequence Number=SeqID_133350
atggatactcggatatatcagaggatcacttgggagagttttggtttatggaaatccctcgtaggatttgtgttcactgcttttggcactgcatttagttggaaagctagccttcaaaaggtagtggctttatcaaccattgaaactgagtatatggctcttacgaaagctatgaaagaatctctatga

SEQ ID NO: 41666 - DNA, 291 bp, Glycine max
  Peptide Sequence Number=SeqID_133351
atggtggacgttgcagcgcattccctcccagaagaagttctttttaagatgtcgaagggttttggcaatgcccatgtgcccccccaggggtgtagagtggaacttttccaggagcaaagggatgaaagagttgttgagtggcaaccatatcttaccctagtggaatatcaagattacgcctatcacgatgccagaagcgtttgtttccgggaaaaaaggaatggtgaagtcaggggtgtgagcattagggttgaggtcatcgcctgcttcaatttgtcaagagtgcgttga

SEQ ID NO: 41667 - DNA, 915 bp, Glycine max
  Peptide Sequence Number=SeqID_133352
atgtcattagatggtgctgatcctccccgacccccgtcacatgactcctgtgggaaaggaacaactgcgaagaaaggacgatatgtggttagaccattaccacctcaagatagtctgtcatcatctaccccatccccgtctcctgtgtctgtgccagttaggcctcccgatattgcacctacatcatctccacctccaactgaagttaaaccatcttcatctcatgttaatgcatgtggaccatccccagtacctgcatccacaccatctccatcctcggttgatgcacgtggaccatccctagtacctacatcctcaccttccccatccccgactgtagccaacatgcctacagatgaagaatctacaaatttggcgatggaagacccccctctaatgatcgtcttatggtttcatccatctaaggttgcggcaaaggctatcactttgtccattaggaaacaatttggtcagccttggctacataggaagcgattccaaaagatcatcatgaactttttttccaacattttaagaacaaagacatggagtcggtgttgggttgcagctgcgggaccaaagcgtaaacgacgcctttatggtactggagaccttgctcatacttacaaatgcggaaatgacagcttcatgcagcatacacaaggttcttctagtcgcgatgaagatgcttcagaaattaaccaactaagggtggaggtgcgtcaatcaaaggaagagatgtgtgtttttcagccaattatccttcagttcctacctcttgaagcaaaaaatattattcatcaacaacaacaacctcaccagcagcacgaccatgtagatgaccaacaggcagatgaccaacatgaacatgatgaccaacagaggcactctcctgatgactattttgattattga

SEQ ID NO: 41668 - DNA, 744 bp, Glycine max
  Peptide Sequence Number=SeqID_133353
atggtgacatactggtggtctgtggttctacacgggaaaacaattggtgttaatgtagaagatgatgattcatacatggacacttatgttagtcctttgtctacacaaatgacttctaacagcgtcggagaagaagaagctgacgacgttcatgctaatcgaccatggctactccacctgcctcgcctcctcctcctcttccctcctcctcctgcagacgcatcagcgtctccatctacgttgaagcggacacgcaaggcgacacagctacgatcattggccactagaccacctggggcagaaagacctgtggtcaacgtcgatcctactaccgacaagaccgacgatccacacaagaagaaattaagaacatatttggggattgtcgctcgtgataaggcggaatttgaaattcctgaagcttctgacagtaggacaaagaagaaaatttttcagattgtcggcaagcgcttgaggcagtttaaatctgacttgactaggaaatgggcacttgcagccaacaagaacagtgcgaacgacattgtctgtgaaaaatatggcattagcaaggataaatggacccagttttgtcagacccgcagagacccctcatgggagatgtgcgaagaagctgcccagaagcaaaacactgccccccacgtattgtcttgtgggggttatgaatatttaaaaaaaaaactcatggctgagaagacaaagaaaagacttgaagaagctgcctag

SEQ ID NO: 41669 - DNA, 408 bp, Glycine max
  Peptide Sequence Number=SeqID_133354
atgatcgaaagttttcaacaacaacaacaaatgtcagttctagaattgtacgtagaaaaggatgttgttggtggttctatgtttcatcctgcaaattctgttacgtcatgtggacataatgtatctcatcatgagtcggaactgccaagaaatataagcaatttacatgatgatgaagatgatgatgatgattatcttgcgtctaactcatacgttgaagagtctttcgatgaagatgatagagttgatgaaatatctgatacagacgatgaagtcaccgacatcgttgaaccagtttcaattgttcacccaactgaaggtgtaccaggaattcaaaatccattttggaatgatgctttgcattataataatatcaattggagtcattcggatgaggaggacatttga

SEQ ID NO: 41670 - DNA, 396 bp, Glycine max
  Peptide Sequence Number=SeqID_133355
gagggtgatgttgatttaaatgtttctcctcaagcccttgataagttgctaggttatgtccttgcatttaaagtcaaagttcaacccaagtttaacaatgttgttgttcttagatactcaaatgactcagatttgatcaatgttgtggtggacatgttgcctgatgctgaggcatgttccaaggttcatgctcctatccttgactccgatgatccttcccaacttgaatttcaatatgtgtttgtcacagcagatcatgatccacttctgggtcttccattgacacctacaaaacggattacatctgatgactgtgatgatgaaccgaaaagctctcagatttcacccgcccagctttcatctaacaaattagcaagacatgatcaaattgaatga

SEQ ID NO: 41671 - DNA, 264 bp, Glycine max
  Peptide Sequence Number=SeqID_133356
atgcacatagaaagaagaccaaaccaacacagcaaaagtgccacatggcagaaaacaaaagcaacacagcaagccaagtggcagaaaactaaacccaaagctgaagggagaaagaaaagcaaagcgttgtttggtgaaagaaaaattgacagcaacaaaaccaatgaggaagtgaaaaattcaaaaagaaacaaaagcaagaacgggcaacaaaagagacagacaacaacaattaagaacgaagaaaccaaacaaacttggtga

SEQ ID NO: 41672 - DNA, 618 bp, Glycine max
  Peptide Sequence Number=SeqID_133357
atgaatcttagtgatttcatacaaaacataaacctagaagtccagacaatagaaaaaacttttctctcccaaaaacttcttaaagcagttgaaaagtgggaagaagacaagaagtgccaaggacaaagtttcgtaaataatgaaacagattctgatgacaccgataaaggcgatgaatatatttttagacaaaagttattctcaacaatagataaggaaaattcagatacagatagtactgaagatttacttgagaagattgatttacaagaattttacgaaaaagaaatcaacttcaataatgcattagaaattaattccaagattgatgaaacaaaatcattggtttcttttcctaaatcttacaaaggtctcatggctgatgcttttggtactagttcaaattttaccccacaatttgattatagtatggaagattaccagatgaggttcgctccccgtgaaaaaattatcgctcctgaagacttagccctaggagataatataaaatccaaagggaaaaggttgcccattgaaccaacattcaatatgtcgtctctcctattaaacataggaagtgttaaccctcaactacttccaaattacatagaacaatga

SEQ ID NO: 41673 - DNA, 777 bp, Glycine max
  Peptide Sequence Number=SeqID_133358
atggaagtccttaaaaggaaaactgatgaaacaacgaccaaaaataataagttactgagatctgcagcagaagcagcgagtgatgcaattaacaaggcacaagagcttgttgaagggttgaagaaaacaaaggatccttctggtactgatttaacctcagcgttggagggtcttgatgttaccttaccacatttccccctccagaggctaatattggagaagcttttcaagaggaaaaaggaaaaaggaaacgaaaagtttccgtctctccgaatccagcagtgggcagttcctccaactccctcctcctctcctctgtgtcttctcttccctccatcgccgactccttctatttcctcctctccgcgccgtcgtcgccgtcttctcttccataatcccatagcagccgcagatatgaggagatttttggttgatagagaaaatattgagaatgtgaatgttgtgcaaccggaagctgaattagaaccaccacttaataatgtggttaatgagtttaatccaaatgagattgtgcgtgatccaggtcgtaggaaacaaattaatgagtatgctccggatattcaagaccaagtgaggagggcatatatattgaagggtccaatgcaaccagatttgtcaaactttcctcgtactcaatttggaagtgttaaaagagcatttagtaaatcatgcaacccgggagggccgagcactttggttttgaagtcttcactaaaagcggatatagagattggaagcatgcatctcaaggcttga

SEQ ID NO: 41674 - DNA, 405 bp, Glycine max
  Peptide Sequence Number=SeqID_133359
atgggcattgcggaggattatgggaagtgtccaattactggagaaccacttactatggatgacattgtaccaatcaagacaggcaagatagtgaaacccagacctgttcaggcagctagcatccctggcatgcttggaatgttccaaaatgaatgggatggattgatgctatctaattttgcattggagcaacaattgcacacagcaagacaggagctgagtcatgctctgtatcagcatgatgccgcttgccgagttattgcaagactaaaaaaggaacgagatgaagctaggtctgtacttgcacaagcagaaaggcagttccctgcttctgcaccaaatgccataacagcaaatgaccctgtcctgagcaacgggaaaagaggttttcacgttatcatatag

SEQ ID NO: 41675 - DNA, 648 bp, Glycine max
  Peptide Sequence Number=SeqID_133360
atgattgcacatataggtaaagctcgagcggtagtggaagagttaaaaaggtttcttgtggctgattctttggaggaagtaaatgggaagctggacaagctttacatggttcttattttgagaggcctacattcagattttgatcatgtacgtgatcaagtccttgctggtgatcaagttccgtcaatggactctctagttactaaacttcttcctgtgccccatgtgttgaaagatgaaaacttagctgaagtcgtagaaacatcagccatggttgcacctcgtagaagaggaggaagtcgtaacaacagaggaggtcgcggtggaaggagtggatgtcctcaatgcacctattgcaagaggatggaaaaatcagagtctaagttttctaatgaggagtacctagaatatttgaagcttaaatctgaaaaatccaacaaccaagctcaatcctcctcggtaccatgtgtttcaacaacatgtatctctcaatctatggaaggttctagttcttggatacttgactcaagtgcctctgatcatatctctggtaacaaatcatctttttcgtctatctcttttccaaaaactccttactttgttactgtggccagtgggtccaaagttgcatctcaaggaattggtcaa

SEQ ID NO: 41676 - DNA, 387 bp, Glycine max
  Peptide Sequence Number=SeqID_133361
atggaattagacattttttttgtgagggaaaaggttctgaacaagtctttggttgtttcctacattcctgcacaactccaagttgctgacatacttaccaaatcactcagcaagcatttgttctacaacttccgctccaaactcagagtacttagtactgctgagcttgtggggggagtgttagagagaagtcttaaattcagctatgaaacacggacactccagccccttgccgtgtccggtgtccgacacgacaccgacgtccgtgtccgggttgagtttgatgtgtttgacaggtgttcacatgtccgtgtccggtgtccatgtcagtattggtgcttcatagggtttaggccctttagggaacttgggggagtgaaaaattag

SEQ ID NO: 41677 - DNA, 514 bp, Glycine max
  Peptide Sequence Number=SeqID_133362
atggcatcagaacatgctgtatccactttgagaatagtttctcccttatgttgtgttaagcttgtggaactcaattaccgccaaaaccattatgcactctgtctgtttcagcctgtgcaagctgtcactgtccatgcaaccaataattactttgtgactgcttcacttgacggctcttggtgcttttatgaactttcttcagggacatgtctgactcaggtttatgacacttcaggttcttctgaagggtacacttctgcagcttttcatcctgatggtcttattcttggaaccggcaccacagaatctcttgtcaagatttgggacgtaaaaagtcaggcaaatgttgctaggtttgatggacatgctgggccagtaactgccatatctttctctgagaatggatacttccttgcgactgctgctcatgatggtgttaagctttgggatctacgtaaattgaagaacttcaggaattttgctccatatgattcagaaacaccgacgagctccg

SEQ ID NO: 41678 - DNA, 276 bp, Glycine max
  Peptide Sequence Number=SeqID_133363
atggtggaatggcgtcatggaattttggaaaaatgccaccaaatagtggtggcgttgcgagttgcttatggcggcgctatggcggccgccatagccatggcgccaaccatacccgagtttctcctccggcgtgaccagcagcagtctctagcgcgacgaacggtggcgcgggcgcgggcgactcccacgacaaccgcagacgacgttctcgagcacgacggcagcagatcagcagaccagcagacgacgcacggcgacgacaaactggcctcttaa

SEQ ID NO: 41679 - DNA, 855 bp, Glycine max
  Peptide Sequence Number=SeqID_133364
atggttagaatcagacgttttggttggactttagacagcattataggaagagccttagggagagaacctgaagaaatagctgttgatgatgtggttcctgatgtcgagggttttctaggcggatcctatgacacattagttctgattgactatgttcatcatgttgcagaacgtcctgagttgaagttatcctcccatggaaggaagggacttatatcaacttttgcggagaggtggcataagaaaactagtattttccatcttactgtacaagaggtgactatcaccttcaatgatgtggcatcattgcttcatctgcccatgacaagcgccttctatagctttgaggctctacatatggacaaagttgtgttgctgttagttgaattgcttgaagttagtgtagatgaaacatttatcgtagcaaatgtgatgtcgcatagtggattggagcaactcgagtgtatctgttgcatctgtggaagctacgcatggggagttgcctccctagtccatatgtataacaatttgaatgatgcatctaagagtagcgctagacaacttgcaggatatatcacacttttacaatctattgctgctaaagattatgatgagaggaaaccacgtgcttgttgctggaattctgggaaggcattatcagtgtcgacatatcgaaagcgtatagatagattgacgtctgatgttaccattcctccacaccctattgtgtcaacattatgcatagaagatattgacgatagatggattcagttttctgaataccttgcaccgcacccgctggcagcatcagttatggacgaagcacctgtagatgcacctactcatgtagagtag

SEQ ID NO: 41680 - DNA, 360 bp, Glycine max
  Peptide Sequence Number=SeqID_133365
atgaaggcattaaagatcaagattaaatgttggagtagggagacttttggtggcttggatgcgaaaattgaagagttggttagtgaaatggatgtgcttgatacaaacatgattgaggggcagatccaatgctctgataaaagaagattactctatgaagaatctggagatgaattagacaggaagaaagcatgttatttcagaaatccagggtcagatggattaaactgggagactctaatatcagaatttgtctatggttctggtcaattacaaccaattagtgtgagccctggtttggcctatgatgatgcagactatggttatatctatttcttatgccatgatggttacaaatga

SEQ ID NO: 41681 - DNA, 210 bp, Glycine max
  Peptide Sequence Number=SeqID_133366
atgagagaaggaaaccctaactacgctggcatagctccaaagagactcacaaccaaaatgaacaaaaacaaccttgggggactagaccaaaacccaagggagaagctaacaaaacttggaggaagaaagagaaactccattcctaaagaggcctgtcctagcaaaaagaggaacaaaataccactagggaagaggtcccgaaaacaataa

SEQ ID NO: 41682 - DNA, 381 bp, Glycine max
  Peptide Sequence Number=SeqID_133367
atgaggaagaaaaacaaaaatgaaagtttgccaaggacaaaggatactcgaagcaaaaagctcatgttactaagaccttgtagggagataagaagggagataaggaagtttcaagttctgcaaattcaaattccacaacccttcttggtaagtttgctggtttattggggaactccaagcttccttctcatgaaagtattgaaggaccttgtcaccaaaaagacgattggtaaaatattcttcttacaaggtctctaccaaatctcaagaaattttctaaacaccaagcgttctgcaattgctaccttctattcttccttgacaagccacactctctggcatcaacgtctagcatatccatcaaaaaatattctaatataa

SEQ ID NO: 41683 - DNA, 981 bp, Glycine max
  Peptide Sequence Number=SeqID_133368
atgtcggaggtacaggcccagcaggtggagcccaaggcccgtgaaagcccaacccgcaaaatcccaaccctcaaaaccttccaaatctatcgctggaaccccaaaaacccttcaaagcacaaggtcaaggactaccagatcaacctaaaggagggtgggccgatggtcctcgatgcgctcaacaacatccagaataagattgacccgagcctcacgttccgccgctcatgccgcgaggggatctgcggctcctgcgcaatgaacatcgacgactacaacaacattgcgtgcctcaccaagatccccttggaaaaaaactccgccgccatgacgatcactcctctgccacacatgttcgtgatcaaggacctggtcctccataaaattaatcactcaaatatcataaagttgaaagaggttgttagagaaaataatgaactatttttcatttttgaatacatgttaagtttgatcgatcatacgcttctttgcagtcttaacacaaccacattgcactactttattccttatgttgtgggagcctttgcaagcactcgggtttcaaatgaactaggggcagggaatccaaagagagcaaaaggtgttgtacgtgtggtagtgattctcaaggtggcagaggcagttattgtgaaacagaattacactacaaattgctcagcgttatattggataatgaatctactacaggtccctatcactataggaacaactttttatgaagtcgtgcttctatacaaaggtcagagtgtgatagcatcaaagggtgatcaacaaacacgttggcatgtacaacaattgattctatattgcatgtgtggcataatttctggcataattggtggcttgcttggccttggtggaggattcatcttggggccacttttcattggactaggaattcatcctcaggtttgtcttttccttttctatcttcctacactttttgtattggctcaataa

SEQ ID NO: 41684 - DNA, 219 bp, Glycine max
  Peptide Sequence Number=SeqID_133369
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggtctactttgaagagagagattgagtgtgcgaatgtacagtggtgccctaaggacgatctaggtggatga

SEQ ID NO: 41685 - DNA, 696 bp, Glycine max
  Peptide Sequence Number=SeqID_133370
atgtttgtaaacattatccaatcacaaaatagtaatgttttcccagagcatttgttcttcctacttgttcatggacactacaagattccaaagcttatggcaagtgcagatgagatgtatcttcgttgctgcctcgaatctgtacacaatagtgcattgaaagcttcccaacacaacaaacctgtgagcttgaatacagttaaatttgttggtgaagcagaatgtgattctggtcagttagtcttgggacattctgtagctgtaagtaataatgcttctgataattggactctaggcacagtaatggggactaagagtatgataaatatattgaatagtcctttgcttcagcactttggtgcttcagaaggaaatgataatttgaacagcatgaacttcactgatgctaaaaacatgacatgctatgattttaaggactctcctagttcatcatataaactagaaatggaaacaccaatggtgcaaagtcatgagtatgatgatcagaaggaggtctatgtagccaaattgagcaaggtagacacaacacatgatgaggatttggactatgtgtacctatttcacttgaacaagggctgcgagattcctgaccgtgatttgcaacttgttggtaagatgaatttatcaacatattaccgttacaccctctcccctcccctgacaattacagagtaa

SEQ ID NO: 41686 - DNA, 105 bp, Glycine max
  Peptide Sequence Number=SeqID_133371
atgacgatgtttacagcagttggactagacatgagtgaagagcagtgtcctggcaagcctgtgtgcatgacacttcctctcctgtctgagaaaaggcgaatctga

SEQ ID NO: 41687 - DNA, 255 bp, Glycine max
  Peptide Sequence Number=SeqID_133372
atgtcaatcatgcaagctttgatggtgtcgagaagaaatcacatgtttgtcatcatcaaaaagggggagaatgtgaatgtatgtatacatgattttgatgatgccaaagaagaatcaaacaaagttgcttcaaaggataaacatggcttcaagattaatacaagatttcttcaacaaacaaaaccttgcttaaagattaactcaagatcaagccttgccttaaaacaaagtgctgtcaagacattcaaggctctg

SEQ ID NO: 41688 - DNA, 1815 bp, Glycine max
  Peptide Sequence Number=SeqID_133373
atggaagggagatggagtgacactgaaaaaacgagggggagtgacagaaccttaaccgaggttcgtaaacactacaaggaggttggtgggaatagtctacgtaaagatgaaggggaatggtctacggtggtcagaagaaaggtagttaaggaaaacaagaaggcatcagtagaggagagacaaacacccattcgcgaggcatgggataactcaactcatcatcacttcgactggaggaataagggagatattacttcttattacttcacccacttcccggaagaagcaaatgaagagctgctctggaaacatttcaaacgttggggtgacgtgcgggaagtcttcatcgccaaacgctgtaataaagagggtagaaggtatggatttgtgcggtttaagggagtctcggacgctagagaactggaggtgaagctggacaacatattcattaatgattataagctgtttgttaacttgcctcggtttgcaagaacaacaaggactcaacagctgaaacaaaaaggtagcctcagggggaagccaaatgaggagttatacaaacctcgagtagaaaccactacaccaccccggagaacatacgctgaagcgacggccaagggagctgctccaggtgtcaacatgagaggatggaggttgaagaaggttatggcggtggagagtatagaggatcgagtagcatgggatttaggatataatatctgcaccaaattcctcggtgatgatatgatcctctttatggggttgtcggaggaaaaggcgcatcacatcatccaaacggagaagaacaatggtagttcattgttctattctctggagaggtggaggccgggatgtaggccacataacagggtcgtttggctgcaagtatggggattcccgatagaggtgtggtgcgcggaccacttcaggaaagtcgcttccttcatcggcgacgttatcgaactagatgacgatactgaggatcgacgcagactggaccgagcccgtctactcgtccgaactcctctcccgccgtcgatattaaaggagatcaccgttcgcgcaggtgagcttgactaccaggtctggtttgtggaggagacatggagtggtgaagcggtgaaccagaagaccaactctctgtccgacgtctggtcagatgaggtcacgtcggaggacggaggtatcgccagagaagacgacgatgacatcgacggtgcttcctcatactcgctggagctcccaccgccgaacccggaatcccctcgaaaccaccaggtagaaggcgaatccaatggtcactgcgatgaacacagactgatgggtaaaacccattttgatgaagatcacagagatgagacagtgatcagaaaggaaggaacccagggcccttttacggcaaacgttgaccctggaatcagagaagcagaaacgaaagtagggattgccttacctaaagagtcaattgagcacaggtctcaagctgactctcgaaagaaggggaatcattctaaaggcaaaaattttgaatggtggagtaaaggtgtttggagatcagcccccttacggggtatacgtgcaagatacaatgctaatgaaaccccacacacacttgcaccccctgcagacccaatcagtaacaaggaaggccacacttttgtagcccaaacccccattgacaagcctgaaaaatactctaaagtctacagaagacatagagtttctcatcccaaagccccccagcttgaacccgtggcagaagaatctcaagtgctagaaggagtcaaagacatgcccatcaccactgatacttag

SEQ ID NO: 41689 - DNA, 611 bp, Glycine max
  Peptide Sequence Number=SeqID_133374
ataatgtcttggggaggaatattttgccagaaagaaaggttgagatataccacacggagttcgacgacttcaagacagagttggagaggcataatcttcacaaacgcctcaccaacttggctgatgggacatttatcttgctttgctctgagggtccttcaccaaagcaagccagagttaaaggccacttggtgaagatagatgcagacagcctcaacacatttttagagactcttgtagtcctaaaggagggggagacattacccacctactttaggtactgcaggttgcccacagactacagagagattgaggctgctctttgcataccagggagggggttcatcctaaacgctgagggccatcctgggaggattctcaggaaagatttgactacattagcccaggtgtggagtgttccctcatactccaacctagcccccacatctcacacctctgacctgacagtggacagagctaggctaatctttggcttagtctctcgcatggacatgaacataggagcactcatttctggccagatgacttctatagcccagtctaactcttctagacttgggtttcctgctctgatcaccgccctatgttga

SEQ ID NO: 41690 - DNA, 480 bp, Glycine max
  Peptide Sequence Number=SeqID_133375
atggggggtctttgttcaatgtatgtgaaaggtgacaaggtgtttgctaaatcagatggacattctgataaccataaatctaatggtaagaaccacaactccaccaacatgcctagtgatttgacaagtgcaagggatcatggactggacaagaaaaaacaagaagctgctgctactacagggaatggttctgatgatttctatgatggacatgggtgttgtcatgtttgggtgactgttgcgctaagcggtctcagtgggcttagtgtgtatccatcgctaagcgccttcagcatgcttagcgtgaagaaagcatcttgcaaagcatatgaatcaaggcagcgcgctaagcgagtcttctgtctctggccaggctcagcgcaagactggcaccaagcccaactccacttacttgtgctaagcgcgataatggcactaagcgcgacgtcgcgatttcagagcctattaaagcctgaatag

SEQ ID NO: 41691 - DNA, 1221 bp, Glycine max
  Peptide Sequence Number=SeqID_133376
tctgatttgacgtcaaaatgggcacttgcagccaacaaggacagtgtgaatgacactgtttatgaaaatacgacattagcaaggaaaaataggcccagttttgttagagtcgcagagacccctcatgggaggatgtgcggaaaaagacataggtcatccagaagcaaaacactgccccacgtgttgtctcatgggggttatgaatatttagaacagaagttgatggctgagaatacaaagaaaaaactaaaggaagctgctcaatccaaaagcactgaggtcgtgatggaccctccatctcccatcagacgacacgtgaagtggaagatggcccgcgccaagaaaactggccagatgacgtttgaggcagcaaaggaaattgctgagaagattgatgtcctgactgctgccattgggcgaccagaacaccctggtcgtgtgcgtactgctggagctagtggacttgcactgcctccagagcctaaggttggtccctcagctgctcgtgtcagcacaaaggagagttgtgttgatcccttagggaacgatccaaacacgggtgactcgaacaaatgcgggttgtacatcgaagaaaatcctccccgcccggttgccctaggaagagtttataagggatccacaaatgttcataacatccctttgttgcatgatcaagtgaaggtcggtgttgaggaggttaaagatgcagatgctcctgttcctgtacccactgacgaggttaacttagtggggcagacacttaacaccttccttgcttggccgacacatctcgtaaagcatttatcagaaaaggttatgtcggatgctaccatgttcggggtgtttaatccagacttccccttgtacataaagcatgaagatctgtctgaaatagcacacggtggacttgacgatactccaaaacctaaatccagggctggtgctaggtggattgttgttaaatgtaatagacaaaaaggaagcactgagtgtggctattacatgatgcactggatgtccactataatcttaggaactttcaggaataattgggaaacgtattttaataatgttagaccattggaagcagagagattgaaggcgcttcacatccagtgtggaagcaatgccttccaagattattttgatgatgccaaagaatcaagagtcaagcaagttccaaaaaatcaagagtcaaacaagtttcaagaatcaagatga

SEQ ID NO: 41692 - DNA, 180 bp, Glycine max
  Peptide Sequence Number=SeqID_133377
atgtattatcctggtcatcaccaacatcaatcatatgcggaacctaatgtacctccaatgcatattgacatgatgtctgtcttattagaagctattgggtatatcagattccttcagagtcaaattgagcttgctgtgggaatccctaacaggaatagagcacctactcttttacgctag

SEQ ID NO: 41693 - DNA, 721 bp, Glycine max
  Peptide Sequence Number=SeqID_133378
cactgaggtcgtgattgatcctctatctcccatcaaacggcacgtgaagtggaagatggcccgcaccaagaaaactggcaagatgacgtttgaggtagcaaaggaaattgttgagaaggttgtaaaacaccttggtcatgtgcgtattgctggagtcggtgtgaccatcaagcaatactttggaccagctccacggacctcccgcacttcttcctccacggctcccgaagaactagagcagctgactcaacagatcagggaccagctggaggagtcgatcacagaaaaatcacaaatgcaatcacagggacttgcactgcctccagagcctgaggttggtccttcagctgcttgtgtcagcactaaggagagttgtgttgatccctcagggaatgatccagacacggtgaaggtcaatgttgagaaggttagagatgcagatgctctcattcctatacccactaaagaggttatgtgggatgctaccgtgttcggggtgtttaatgaagacttccccttgtacataaagcatgaagatttgtctaaaatagcacacggtggtcaatgtcttagcatctctgtcatacagttgtggattctgcatctgactgagacaagtatgcgagtggggaattctgatgtgtatggactcctcgagccacatgctttgaaaggacttgacaatactccagaacctaaatccaaggctggtgctaggtga

SEQ ID NO: 41694 - DNA, 201 bp, Glycine max
  Peptide Sequence Number=SeqID_133379
atggagaaatctgaaaagaaaaattttagtgaaaagaaaatgaagaaagcgtacatcacatgggatgacaatgatatggaatcttctgaagattcagagaatgaagagataaacctctgtctaatggctaaaagttatgaaagcaatgaagagatgcatttgctgatttgcataaagagtcaatcaaacttgcaaagttag

SEQ ID NO: 41695 - DNA, 378 bp, Glycine max
  Peptide Sequence Number=SeqID_133380
atgactggtagattgctggccggaattttgcttccccgatcttcaaatttggctcaagcctctgaggaggacttgattttgatgtgggcttttcttaccggtcgtcagatcgactgggctcacttggttcagtaccgaatgcataaggcattacgggccaatgcacctcttccttaccctcaattagtcactctgtttctctgtcattttcaaattccgcttgatgatgaaccatatgttcaagtcaagcgttcatttgctattggtgctggtgcagtcacttcttttggatatcgtaaggatcggaatggtcaatggttgaagaaaaatgcatttcctccacaagatgagcatactccttctcctcctcctcagtga

SEQ ID NO: 41696 - DNA, 468 bp, Glycine max
  Peptide Sequence Number=SeqID_133381
atgtaccctccactagaaccgatccacaagagatgcaccctctcttgttctcaatcaacaacccaagtagatgtaccctctacttgtaccacaaaggatgtatcctccaatgtgttaagacaaagttctcaggtgggagaagggagacacaaaagaattcaggtggttagtccttcgttcttttggaaaagggagaagagagacacaaaaagaattcaggtggaacttaaggagaaaaatgggcaaggcttggtctttggaggtaaaatggaggtctcatcaatgggctggcacaagaggcttctaggtgggcctgggtcattgccgccatggtgcacctccaagtgtggcaaatgtacaccctgcagaccggttcatgtgccggtgctgctagggacgctggttactgccgagtactacccggaggcatggagatgcaagtgtggcaacaagttgtacatgccatga

SEQ ID NO: 41697 - DNA, 264 bp, Glycine max
  Peptide Sequence Number=SeqID_133382
atgactaatgcaaactgtccgcaagaatcattgcattcagtctcaaacgggaatctaagttcgtttgagccttttttggaggaggtggtggtggagagtggtaatagtatggttttttctttggtgggggtggtggtgagtggtagacatagggagggtgcgggtgtgggcagaaaaatgaagctttggaaatggaaattgaaatggtggagtgaggagctaaaactagtgagtgtgtctgaggcattcagagatggggattga

SEQ ID NO: 41698 - DNA, 705 bp, Glycine max
  Peptide Sequence Number=SeqID_133383
atgggtaaggactggggttctggcgctactgatgcagggtatactgataaaagctctcattcaattgcacctggcccctatgattggccacctattggtcagccaaatgttgcatgtagagttccatcctctgcatgtgagcagagatggactctagagatggtggctgctgtagaggtggcggtggtgcatctgtggctggctgctgctggtcctgccttggctgctaggcctaccttggggaagatcagaattatgatcgctgggaaagatgttgctgaggagcaatgtcatccagatctgtgtcaaggtggtcatgctagcgaacatgatctacacctgccttcccttcacgcttcgtgcgaagtcctatcccggaatgcacaacagttggcctatggcctcctcatcaaatctcgaagcctgactcttcctttcactgaactcgcaacattgcccttcttccaggaccaatggatgccccaagaactgattgatggcatcttcaacaaaggggacccattggccctgcacccaggagcacttatccctgactccttcctcggtgggccatgcattcatgtagaattccatgactatttccaggtcaaatttagccatgggccctatgagctaagtccattgcctcctgtcaacttcctcctggaactcaatgtattccccttctctcagttggaccggtaa

SEQ ID NO: 41699 - DNA, 425 bp, Glycine max
  Peptide Sequence Number=SeqID_133384
atggccacaatgatgaaggccatgatgagcatgaaaaagataatggaggtcaatacagttgcagttgccgctaccagtattgttgctgaggtggacctgactcccacatttggcctcaaccaaataaatcatgccatctcggatatggtagggcagagaggcagagaattgggaagtacgggtggcccccattttgtgcaagttcaaaacaagcattccttcccacaatatggcttggctctcaaccatacaccgcccaatgttgcacacactcccaatgaggatgtcgacaactctgcacccatacccattaagagcccacaaccccaagctgatcatgcacatgtccctcaacccatgggggagacacgtgaaatatcccaccgtaatctaaccgacttcgagcctcgcctcggatatgccac

SEQ ID NO: 41700 - DNA, 342 bp, Glycine max
  Peptide Sequence Number=SeqID_133385
atgcgctcctgggtgaggggccagtggattccttttgatggagatgcccttagtctattcccgggacacccactgatcttgggagaaggccagcaatgcgagtatagccagaggaggattcaggcctttggctttgatgaggaggctatcgcccaactgctatgcatactggggcaagacttcacccagaccgccgcagtttgcaaggattgcacctacgagacaccctatggacctggagaagtccaacagggccctaaggtttcccgctttgattacaggcctttgtcagttctgcagagtgcccggcgcccccagcaaggtcatccgaccgcctattaa

SEQ ID NO: 41701 - DNA, 811 bp, Glycine max
  Peptide Sequence Number=SeqID_133386
tgatcttccgtcacaggtatttattccgcgcacaagtgcgtcgggtgatgctgcccaacttactgatttagtgtatgatggtgtttttgaggtgctccagtggcttctgtttctatcagctgtccctcctgttcagctactgacggggtggtgcgtaacggcaaaagccccgccggacatcagcgctggcaagtgtagcggtcccgctgcgcggcgcgtcccattcgccattcaggctgcgcaactgttgggaagggcgatcggtgcgggcctcttcgctattaccccagctggcgaaagggggatgtgctgcaaggcgattaagttgggtaaccccagggttttcccaggtcacattcagtcacccacactaggatgcagtagggcaatctcagctcactgcaacctctgttccccaggcttgagcaatctttccacatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 41702 - DNA, 213 bp, Glycine max
  Peptide Sequence Number=SeqID_133387
atgggggtgcaaatagcaaccaggcccgcttgggccttccaggatgttcctccagaaggcggttgcttctggaggaatcaacctagctcgcctgggcgagctggaaaatccgagccgaggtgcttccgtaacgttttcgtaacgtttccgtgggtgattttgcgaatatttttaaccgttcttcgtcgttcgtcgttcttcggtcttcaaccg

SEQ ID NO: 41703 - DNA, 225 bp, Glycine max
  Peptide Sequence Number=SeqID_133388
atgctgacatctccggaaagggtgcagatgaacacattactctctgcttgtcaatcggacttggggtctccgaatgacgaggtgcggataaccgtaaggtgtcttcgcatgctaacggactctcgggtcgcggttacaaaaggtggggtggtcgacaaaagcagggcttttgctcctacgtatcctcaatttgtgacgaagaactcagacctacgtagttcttga

SEQ ID NO: 41704 - DNA, 177 bp, Glycine max
  Peptide Sequence Number=SeqID_133389
atgtcgcggaactccattgattgcctaacgatgggtgttaagtacctcaaagtagtcaagcgagggtcgcatgctatcaagcaatggtccccagacgaaattagggatattctctacttaacaatgcttatgtgttctatggtgtctcctgaaatgctaaaccccgattccttatga

SEQ ID NO: 41705 - DNA, 183 bp, Glycine max
  Peptide Sequence Number=SeqID_133390
atggcttcggagcggacatggacgccttatgtcttgttggaacaggcccactacgtcgtttcgagtttgctttacatgatccaactctcttgccaaatccctgaccacaactgcaatcttgctcaaggagggaagaaacccggagaaaagatacagttttcttcccccaagaagacatcctag

SEQ ID NO: 41706 - DNA, 303 bp, Glycine max
  Peptide Sequence Number=SeqID_133391
atggctgcaagtgacattgctattttgagagatagagcccacattccaacaaagagaagtctgctagaactcacatcacaagatgctctattggcacagaacaagttgttgtctaagcaacttgaggcattgacagaaaccttaaggtgtgccatctatggtggagctcacaattctggctgctgcattcccaatgaagaaccagctcatgaagtcaattatatggggaaccaaccaagaaacaattttaatgcaagtggattctttggcttccagcatggccagcaatataaccaacaatag

SEQ ID NO: 41707 - DNA, 621 bp, Glycine max
  Peptide Sequence Number=SeqID_133392
atgagtaggagggcgcggcggtcgctgcaaacccagggcgcgagcccgggcggagcggtcgtcggtgcagatcttggtggtagtagcaaatattcaaatgagaactttgaaggcgaagagggaaaagggttccatgtgaacggcacttgcacatgggttagtcgattcctaagggaccgggggaagcccgtcttgatagcgctctgtgcgcgtactccgaaagggaatcggccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 41708 - DNA, 198 bp, Glycine max
  Peptide Sequence Number=SeqID_133393
atgtggcggaagtcgaaaagaggtgtttttgcgcaatcccaaccaggcccacatgggccctccagaagattcctccagaaggctgttgcttctggaggaagcaaccttgctcgcctgggcgagctgggcggcaagcttctcccctattttgctataaatagggggagaagtgaagaagaaaagggttcagccccttag

SEQ ID NO: 41709 - DNA, 372 bp, Glycine max
  Peptide Sequence Number=SeqID_133394
atgaagggaataaggcataaatatgggtttaacaacaataaatgtgagaaggcagagaagatcatgggttctccacctgcctcccctcttcctcctcctcctcttccttctcctcctcctcctcttcctcctcctcctcctccttcagacgcatcagcttcgctgagaagcggacacgcaaagcctcacgtctatgatcgttgtccactagaccacctggtggacgtcacctacgagaactggaaggaggtccctactgctcagaaggacctgatttgggaggatattcaggcggaatttgatatcccagaggcttctgacaataggacgaaaaagaagttacttcagaccgtgggggagagatggaggtag

SEQ ID NO: 41710 - DNA, 433 bp, Glycine max
  Peptide Sequence Number=SeqID_133395
aggactacaagtactccccttcagagagctacatgtcgtcgcctttagaagactacacgttctcaccatcagaggactacacgcactcgccttcagaggactacacgttctccccttcagagagatacacgccctcgccttcagaggactacacgtcctccccttcagaggactacacgtcctcctcttaagtggactacacgtcttcaccttcaaagggctacatgtcctccccttcagagtgctacacgcccttgcctttagaggactaaacgtcctcaccttcggaggactacacgtcctcaccttcagagaattacatgtcctccccttaagacgactacacgtcctcctcttcagtggactacacaacctcgccttcagaggacaacatatcctcccctttagaggactacacaacctcaccttctga

SEQ ID NO: 41711 - DNA, 600 bp, Glycine max
  Peptide Sequence Number=SeqID_133396
atgggggatcccatcagcagactctccttccctgaaaacaacgagactttttcaagtctcacaagttatccagaactacgtaggtctgaattcctcattggaggatacgtaggagcaagagcctcgcttttgtcgaccataccgccttttgttgccatgactcaagagctgaccaagtttggtcattctgcacccatgatacgcggagataccttatggttattcgcacccttttgtcatccagaggcggcgggcccgatgacaagcagagaccaaaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccaaaggcggcgggcccgatgacaagcagagaccaagtttggtcattctgcacccttgtatcatcccagaggcggcgggcccgatgatacgcggaaatacccgagtggttatccgtataaacattcttttgctatctgtaagacagaacgcttga

SEQ ID NO: 41712 - DNA, 570 bp, Glycine max
  Peptide Sequence Number=SeqID_133397
atggcgtcgggcgcgccggtgtgccagttggccaggtcgccgttggccgcgacctgcatgaaggccgcccatgacgcagatgtccaggtggccgccgcgcatcatggcgaaggaatcggcgtggtggaaataggcgccgccttcgagcagcgtcaccggctgcttgccggcgttgatcaggtccaggtcgatgtcgtcctcggccggcggcgggcccatgccgagaatgccgttttcactgtgcagcacgatttcgcggccggcgggcaaatgggcggccaccagcaccggcatgccgatgcccaggttgacgtagctgccgtcgggaatgtcctgggccaggcgtcgcgccatggcttcgcgggtaaggggagtgggcatgggaatccttcagctggagaacgcggagtgggccacctgggtgacgcgcttgacgaagatgcccggcgtcaccacggcctcgggcgacagctcgcccaacgccaccttggcgcgcacctgcacgatggtggtcttcgcggccatgcacatgatggggccgaagttgcgggcgctcttgcgataggtcag

SEQ ID NO: 41713 - DNA, 279 bp, Glycine max
  Peptide Sequence Number=SeqID_133398
atgcatattgttgtggtaaaacaggggcaggatcatcttgagctaccttctggggtggggacaaaacatgaacagcagaaaccagtcaaggtaagacaacaacgcggtcaagattggccaaacctggttgtttattacatgcaggttagctcgcctgggcgagctacccctgcaccaaaatataaaagtgacgaaaggggggacatttttgcattcaaaaacttcttttcccccctttcaaaagccatacccacgggatttacgagtttgcagccctag

SEQ ID NO: 41714 - DNA, 288 bp, Glycine max
  Peptide Sequence Number=SeqID_133399
atgtcataccctaatttcgtccggggacctttgcttgatgacatgcgaccattctttggtccttgtgagaaggcgattgcttctggaggaagcaaccctactcgcctgggcgagctgggcggcaaccacctcccctattttgctataaataggggaggaaatgaagaaggaagggccgaggcgcttccgaaacgtttccgtaacgttttccgtgaggaatttcgcaaaggtttcaaccgttcttcgacgttcttcattcgttcttcatcgttcttcgatctacaacgg

SEQ ID NO: 41715 - DNA, 204 bp, Glycine max
  Peptide Sequence Number=SeqID_133400
atgggtgaagtagagggaggtacaagagtagatggaggccgacatggaggccatgaaagagcaaatggccgcaatgatgagaccatgatgagcgtgaagaagataatggaagccaatgcggttgcaattgccgctaccagtgttgttgctaaggtgaacccgacgtccccattcggcatcaaccaaatgaatcatccaacctga

SEQ ID NO: 41716 - DNA, 300 bp, Glycine max
  Peptide Sequence Number=SeqID_133401
atgttgctaaatagcaacgtcatccatatccatgtaagagtggtcatgttggtgtgcatgatccgcactcgtctttttgcagcgacacgggtgaaatcttgccccgatatgcatagtagatgcgtgacagcctccctctctggatgtgctcgcacagttggtcgccctctaatatccggggtggcccaggaaccattaaaaggaaactactggccccttaaccggagcgcaagtctcggtgaagcatctaagggcaaaggaccttatattctcttaaggtgtggatatggagcacactga

SEQ ID NO: 41717 - DNA, 465 bp, Glycine max
  Peptide Sequence Number=SeqID_133402
atgtcagccagtgatcatgccattctacgagatagaacccaccaacccacgaagaaaagcttgatagagctatcatcacatgatgctttattggcacagaacaagttgctttctaagcaacttgagattttaacagaaacgcttggttgtaccatctgtggtgaggctcatgaaacaggccaatgtattcccattgaagaaaacactcaagaatttcattatatgggaaatcaacaacgacaagggtatactcaaggaggattttcaggcttccagcagggtccctataatcaacaaggacagtggaggacacaccctgacaaccagtttaacaaagaccagagtgggcctgcaaacaggccaatccaacaaggacctaacatattccagagaaatactaatctggaggagaccttgactcagtttatgaagaacagaatcccaaggaggaatgcaaagctgtga

SEQ ID NO: 41718 - DNA, 135 bp, Glycine max
  Peptide Sequence Number=SeqID_133403
atgccggtgtcagccgtatatacaacttcgcttgagctagcatgcgacaccaactacaaaacttcctttggcgtaaagaaatattatcggccagcgtttgtaaaaaagacttgcacaatgtcggctgaaaagtag

SEQ ID NO: 41719 - DNA, 766 bp, Glycine max
  Peptide Sequence Number=SeqID_133404
agaggatccccgcctcagaggactacacgtcctcgccttcagagggctgcatgccctcgccttcagaggactacacgtcctcgccttcaaagggctacatgccctcgccatcagaggactacacatcctcgccttcagaggactgcacgtcctcgccttcagagggctaaacatcctcgccttcaaagggctacacatcctcaccttcagagggctgcacgccctcgcctttaaagggctacatatcctcgccttaagacggctgcacactctcgcctttagaggactgcacgtcctcgccttgaaagggctgcatgtcctcgccttcagagggctgcacgccctcaccctcagagagctgcacgccctcgccttcgtagggctacatgccctcacattcagaggactacacgtcctcgccttcagagggctacacgccttcgccttcagaggactacacgtcctcgccttcaaagggcgacacaccctcgccttcataggactccatatctgcgccttcagagaactcaaggagggccaactgtgcgagcacaaccagagggaggctatcgtgcagccactatgcatattggggcaagatttctctcgtgctgctacaaagagacgagtgcggatcatgcgcaccaacatgaccactcttacacagatatggatgacattgctacttagcaacattctgcctagtgaccataatgccgatctccccctgcggaagtttcagttggtctatgccgtcatgacatag

SEQ ID NO: 41720 - DNA, 542 bp, Glycine max
  Peptide Sequence Number=SeqID_133405
atgctgcctacggcaacaagttccttcggtagaggaggaaggtctagcaaaggaacagtactggctccaccagagccaaacaccaaaaaggcatcctcaacatcttctgggtcatctacccaggctgggtcatctacccagaaatcaaaacttgaagagtcatcaacccaactaaccaccaccaaacctgagtcatcaactcaggactccctaaaaccaatcaccaccaaacagactgtggaagattatgcctggtcaatccaaaccctccaagctcttgaagaaatgtgcctcaccaaagtaccaaggttagccaaaaagacctgggaagaaatggcttcagaatcaaatgatgattatgaaacagaactccaaaaacaaatccaaattgccaagcaaaccaaaacgattagcaaccccaaaggcaaacaaacaatgatggagtcggagtattgggacaagaatccctttaaggcaactgcaaaagctttcccgcaggaattccattacaagccaacgaccctcaacaaaaccaagattca

SEQ ID NO: 41721 - DNA, 124 bp, Glycine max
  Peptide Sequence Number=SeqID_133406
aatatccttctcgcctgggtgccctggggaagagtttatgagggatctacaacaattcacaacattcctttgctgcatgatcaagttaaagggagctgtgagacccgcgaaacctgcagattag

SEQ ID NO: 41722 - DNA, 226 bp, Glycine max
  Peptide Sequence Number=SeqID_133407
cccaccaaaccagtctcagaaaaacgacgatctcgaacccgttcaccgttggatcgtcgtgaaatttgagtatcatgttcgcaacacaattccgagcattctcaccgttgggaatttcgatatcattacaagtggaggtttcaatcccttctacgtttctttgacgtttgggaactctatcggagcagtcggaggagaaactggaggaatcttagggaaccgctag

SEQ ID NO: 41723 - DNA, 207 bp, Glycine max
  Peptide Sequence Number=SeqID_133408
atgatattgcacgagattagaaggcctagctctctaaaaatagtccccagtggagtcgccaactgtcgcaacctacccttcggcgggagggcgacgtgggggctcacgggtgcatcttccaagaaaggaaaatgcacggagtcgccaccaacgtttattcgagaaaaatgtcggaaaaaccgaaaaggtgtggtctacgaactttaa

SEQ ID NO: 41724 - DNA, 261 bp, Glycine max
  Peptide Sequence Number=SeqID_133409
atgtggagacacttcagaaggtccgcaaggcatgggaggtgttgcaaaaaaaaagacaaggaattcagaggcagtaacaatgggcccatcggtggctaccgtgagtggttgaaagcccacgtgcagggtttggattggctcccaagtctgagagccactaaaagggaggaagatgaggcaccggaggaagacgaaggggtgcaggacagaactcaagcaagctcaaacagtcaaagaaagattcaaatttgcagctcttaa

SEQ ID NO: 41725 - DNA, 303 bp, Glycine max
  Peptide Sequence Number=SeqID_133410
atggcattagcgcgtgatttttgtagggaaacaacccatggggcaatttggtttagaataggtagcaagatacctttggcaatttgcactttgggtatgaatagaaaaatacttgaatgtattagaaatgccaagatgtgcacatgtgcaatttttggtgccccaaaatgcttgagtatgcatgtatgtgagtttagccaaggagatgtgtgtgatgtaagtaacaaatacaccttggaggaatggccccgaggaagcttgcctcaagaggtccaggaaggacaaggtggccgaaggaactag

SEQ ID NO: 41726 - DNA, 571 bp, Glycine max
  Peptide Sequence Number=SeqID_133411
atggataatgaagagggtgtgaaggaacagatgaaggccgatctatcggccttaaaagatcaaatggcttccatctcggagggaagcgacgccggtgctgcaacccgccttgaatccgagctagacagaaacacggtcgtgttcggtcgaaggtatagtccacaagcttatccttatggcctgcctccggacttcaccccccgtaccaccccggaagatttaagccaagcccctactttcgaggggcaactcccaccttatgaagactatcccgggcaagacgatggggaaggagatacccatcttggccccttgctccacctcaaagatccatccccgcatgaactaccccaaccgaacatagtccgccatatcccggcctcacccacacccgtaaaagaatctgttcccttcgcggaagataagggaaagattgaggcgcttgaagagaggttaagagcagtcgaaggcctcggcaattacccattctcggatttagcggatttatgtcttgtgcccaacatcgtcatccctcccaagttcaaagtaccggactttgataagtacaaag

SEQ ID NO: 41727 - DNA, 525 bp, Glycine max
  Peptide Sequence Number=SeqID_133412
atgacactgggccttcagcaacaattaatagtcttgatagtgtctctgcctctgggccttcatccttctccacttaggccttcatcattctccactcgggggctttatccttctccacttgggccttcgcccttctccacttgggcctttagcctgtatttggccaatttcaggattctcatcattccctccttcttggaaaacatttgccctcaaatgtccaggatcatcaccaggttcaagtaccactacttgatgattctgcgcttaggtcactggtttgtggccttaggggagctttgttggtttgttttctccctcctaacattccctggcccattaaaaacaccttgtcctcaaggtgttaggtcacaatggctttcaaaagtagtaccaggatcccaaattaaagtcggtgtaggaatgagtgaatgcagattactgtggcagagacagagccattggcagtgtcgagagtggtgtagagggtggggaggaaggggtggtcgagctccttgttcttga

SEQ ID NO: 41728 - DNA, 198 bp, Glycine max
  Peptide Sequence Number=SeqID_133413
atggaaggagagaagaagggtgtgtcttcaaagaaggaaaattggagtttaacattaaggaacgtgcagtttcaagaagatgacgattcttcctttttgctataccattttgttgtggtgtatgaggacatgtggactgatgtaaaataccttttgaagataaaaaagatgatagatcatgagagaaatactctttag

SEQ ID NO: 41729 - DNA, 297 bp, Glycine max
  Peptide Sequence Number=SeqID_133414
atggcaagcagagaccaagtctggtcattctgcgcacatgatacgcggagataccttacggttatccgcacccctttgccattcaggcacagttgtgtccgatggcaagcagagaccaagtttggtcattctgcacccatgatacgcggagataccttatggttattcgcacccattcttttgctatctacaagtaaagaggggcaactgtcataccctaatttcgtccggggacctttgcttgatgacgtgcgaccattctttggtcctcgtgaggtgcttggcacccatcattag

SEQ ID NO: 41730 - DNA, 336 bp, Glycine max
  Peptide Sequence Number=SeqID_133415
gtgctccagtggcttctgtttttatcagctgtccctccctgttcagctactgacggggtggtgcgtaacggcaaaagcaccgcccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 41731 - DNA, 252 bp, Glycine max
  Peptide Sequence Number=SeqID_133416
atgggtgccaagcacctcacgaggaccaaagaatggtcgcacgtcatcgagcaaaggtccccggacgaaattagggaacaaaaggtgcagaagactgtgtcagcccctgcatgctatcaagcgttctgtcttacagatagcaaaagaatgggtgcgaataaccataagggtgcggataaccgtaagggtgcggataaccgtaagggtgcggataaccgtaaggtatctccgcgtatcatgggtgcagaatga

SEQ ID NO: 41732 - DNA, 49 bp, Glycine max
  Peptide Sequence Number=SeqID_133417
ggtgaatgctatgaaaatttccccggacgcccaaaatggactcggatga

SEQ ID NO: 41733 - DNA, 237 bp, Glycine max
  Peptide Sequence Number=SeqID_133418
atggtttacaataatggatttacacgcgattctcctcaaattatagccagcccgcatcaattagaccttgcaccttacgcttcagagccctataatgctcaatggaacgccccggggcttctccgtgacaagcacacattgcgttcgaatcgtattctcgaaaaaatggaggttgatgaaccttggctggggttatggctaccattgaattatcaagtagatatgggagcaagttag

SEQ ID NO: 41734 - DNA, 221 bp, Glycine max
  Peptide Sequence Number=SeqID_133419
gtggccttgttggtgcttgcgcgcttagcgcaactttggctcgcttagcgtgcattagtgaatttcggcttagcgcttgtcttttcgctcagcggatggactcaagcggtgcgcttagcgtgattagccctcactcagtgaacatgcacaactcatccttcttccatattcttcctcgcgctcagccaaaggagtgttgcgctcagcggatggctcgctaa

SEQ ID NO: 41735 - DNA, 279 bp, Glycine max
  Peptide Sequence Number=SeqID_133420
atgtcgggactcatatgcgattctcctcaaatttcagccagcccgcatcaattggactttgcaccttatgcttcaaggtcatacagtgctcaatggaatgccccagggctcctccatgatatgcacatgttgcgttcaagtcgtatcctcagaaaatggaggtggaggaaacctagcagagggatggcctttgtggataactgggtggtaggtaagaagaagggttgttattggctaagtaatgacattgttgggttgatgggaaacttggtcgtatag

SEQ ID NO: 41736 - DNA, 381 bp, Glycine max
  Peptide Sequence Number=SeqID_133421
atgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggccatgatacgcggagataccttacggttattcgcacccttttgtcatccagaggcggcgggcccgatgacaagcagagaccaagtttggtcattctgcacgttccaggatgatacgcggagataccttatg

SEQ ID NO: 41737 - DNA, 258 bp, Glycine max
  Peptide Sequence Number=SeqID_133422
atgactagagaagttgtcatcatcaaaaggggggagattgtagaagcaaagcttcatggtgaatcaaagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaatgtttttctcaaaaattgagtag

SEQ ID NO: 41738 - DNA, 261 bp, Glycine max
  Peptide Sequence Number=SeqID_133423
atggctacaccaatgagtactgcttgctatttggataaagatgaaaccggatattctgattctgactttgccggttctaaaacagatggaaagagcaccagtgaaacttgtcatttcattgattctgctctagtttcttggcatagtaagaaaatagaacattgttgctttatctactgtaaaagcagaatacatttctgctggcagttgttgtgctcaaattctttggatgaagcaacaaactttctgattatggaataa

SEQ ID NO: 41739 - DNA, 252 bp, Glycine max
  Peptide Sequence Number=SeqID_133424
atggctaatttcaaggcagcaggtgtcatacctaaagaccttaattggcagcaaaggttgaaactgtaccatggtgaagaattcacaagggcacatagcattgtacacatgatatcgcccattatgcacaagcctcgcgctaagctcatctttggtcatgcactaagccgagagtctctagcgcttagagctcaacccttgcatcttatgctgatttggtccgctaagctggccaaggctgagctaagctga

SEQ ID NO: 41740 - DNA, 498 bp, Glycine max
  Peptide Sequence Number=SeqID_133425
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccgcttcctcgctcactgactcgctacgctcggtcgttcgactgcggcgagcggaaatggcttacgaacggggcggagatttcctggaagatgccaggaagatacttaacagggaagtga

SEQ ID NO: 41741 - DNA, 616 bp, Glycine max
  Peptide Sequence Number=SeqID_133426
atggtctctcgtggtggagacaaaagcaacgaatttctgtttcatcttggggaattacacgacatggaaacctgccccgcggtggaagagctacttcaacggctcatggactggaggcagctcgaagtgtctgagagaggtagggaaaaaccgcagatttgcatgcagttggcagaaaggaaggctcctccaactcccaaagccctagtaatatgtttcactaggaatatgaccagccccaggtccaagtatcccccgacagtgcccaagccgacaccattttcctatcaaagcaataaggccgtcccatggaaatatacccctcccgcttttggagaaggggctgcaaccgaggttgactccttgtcagccaaggtgaccaacattatcggccttagtggcgtaacccgcggtggccgggtgttcgctccccctcactcggcggaattgccctccaaggggaaagcacccatgacccaagtgtccacaggcacgaccaccccctcaaaagaagtggatcccccgatagtaaagggagctgaaaagaaggaaggtctccaaggaaaggcggagaccttggaagaggctcatgaattccttcgtctcatccaacaaa

SEQ ID NO: 41742 - DNA, 165 bp, Glycine max
  Peptide Sequence Number=SeqID_133427
atgagggttcactgttatcaagcaagtcggagacctagcatgaccacagattcacctccactccttatgttcccatggacccagggtgttttcctcgctcctacgtatcctcaattgtgttggaccatttatgatctcttgtttttgaaaggagagaaacgttaa

SEQ ID NO: 41743 - DNA, 132 bp, Glycine max
  Peptide Sequence Number=SeqID_133428
atgatgagaatcatgaatctagccaaatacaggttaaaggcccaagtggagaaggacgaaggcgtaagtggagaaggacaaagcccccgagtggagaaggatgaaggctcaattttggcccaacctatttag

SEQ ID NO: 41744 - DNA, 633 bp, Glycine max
  Peptide Sequence Number=SeqID_133429
gcgcacatgaagggaatcacaggagcaccctacagggcacattgtgatggtttgaccatcacagatgtgtcctggttgccgtacacagagcatcgggggtttagggcgtttaaagagatttcatctttccagggtcagctgagatggggtcatatggttgtcacagttcgaccgaagagggtggtacgccagtttggttacatccagagcatccctccgccgcctgttagtgcacgattgtcacacgatcagatagatgacaggtggatgcagtttgcggatcacttactacctgcaggtcagctttgtctagtgcctggacaggtatctgcagattacatggagtggtttttccgcatatctcacccattcatgacaccgacccaggcaggtgaccagcggagggatgcaccagctgtagaccctgaggactacatacagccgccagcccccaggttccagttgcatttgaccccccctccacatgtggatgattacgagggatatgaggcgattgcacaaaggttggagcgtgtgctcaaccttaggatagtcactacaggcacaaagttatatgacattatgcaggactgcctaacgatcgcgagagggggacccagtgctgatgggacg

SEQ ID NO: 41745 - DNA, 759 bp, Glycine max
  Peptide Sequence Number=SeqID_133430
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgagcaaaatattatacgcaagccgacaaggtgtgatgccgctggcgattcaggttcatcatgccgtttgtgatggcttccatgtcggcagaatgcttaatgaattacaacagtactgcgatgagtggcaggggcggggcgtaatttttttaaggcagttattggtgcctagaaatattttatctgattataagatgatcttcttgagatcgttttggtctgcgcgtaatctcttgctctga

SEQ ID NO: 41746 - DNA, 363 bp, Glycine max
  Peptide Sequence Number=SeqID_133431
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaacccccccgttcagtccgaccgctgcgccttatccggtaactatcgtcttgagtccaacccggaaagacatgcaaaagcaccactggcagcagccactgagcaagagattacgcgcagaccaaaacgatctcaagaagatcatcttataa

SEQ ID NO: 41747 - DNA, 510 bp, Glycine max
  Peptide Sequence Number=SeqID_133432
gcgtcacaagattcgtttgtcccccatggtcgtcatgatgtcctgactgttgccattgggcgaccagaacaccctggctgtgtgcatgctgctggagccggtgcgccatcaagcaatactttggctctgctccacaaagctcccatgcaatcacagggacttgcactgcctctggagcctgaggttggtccctcagctgctcgtgttagcacaaatgggagttgtgttgatccctcaccgaccgatccagagacgggtgactcagacaaatatgggctgtacatcgaagaaaatccttcccgcctggttgccctaggaagagtttatgagggatccgcagctgttcacaacatccctttgttgcatggccaggtggaggttggtgttgaggaggttaaacatgtagaggctcccgttcctgtacccactaacgaagttcaactagtggggcaaaccctgaacactttccttgcttggccgacacatctcgtgaagcgagtatcagaacag

SEQ ID NO: 41748 - DNA, 504 bp, Glycine max
  Peptide Sequence Number=SeqID_133433
atgggacaattggctacacagttaaatcaacaacagtcccagaattatgacagattaccttctcaatctgtccagaatcccaaaaatgtgagtgccattacattaagatcgggaaagcagtgtgactctaaagagaagcagcatatccctcttccattccctccaagagcaatttccaccaaaaaaatggaagacacagagaaggagatcttggaaacatttagaaaagtagaagagctgtgcactaataagtggaagcttaaaggaagtgaaagaattagtatgggcagaaatgtctccgcattgattggtaaatctgttccccaaatccctgaaaaatgtaaagatccaggtcctttgcagtcaactaatgtggtaattcatttagctaatagaagagttgcctaccctgctggtttcatagaggatgtcttagttagagttggtgaactgattttccttgttgatttttatatttttgaatatggaggagggattttctaa

SEQ ID NO: 41749 - DNA, 672 bp, Glycine max
  Peptide Sequence Number=SeqID_133434
atgaaagttacggctctcaagcaaaccagccacaacatgattgcacatataggtaaagctcgggcagtagtggaagagctgaaaagatttcttgtggctgattcgttggaggaagtgaataggaagttggacaagttttacatggttcttatcttgaggagcctacagtcaaattttgatcatgtgcacgatcaagttcttgctggagaccaagttccatcaatggactccctcatcactagatttcttcgtgtgcctcatgtattgaaggatgaaaaccttgctgatgttatggaaacatcagccatggttgcacctcgtgggagaggaggaggccgtaacaatagaggaggccgcagtgaaaggggtggacgtcctcattgcacctattgcaagagaatgggccacactcaagaaaactgttactcattgcatggctttcctgacaaagtagcactggtatctaagtcagaaaaatcagagtcttggttctctgatgaggagtaccaagagtatttgaagctcaaatccgagaaacccaacaaccaaaaacaatcttcctttgtaccatgttttttaaccgcatgtatctctcaatccattgaaggtcccagtccttggatacttgattcaggaacatggcacgggtcgactgattggagaaggacgtga

SEQ ID NO: 41750 - DNA, 408 bp, Glycine max
  Peptide Sequence Number=SeqID_133435
atgaaaagagaaaaacatgtctcctataatagtcatgactcttgcaacaatttaagtgaagaacttagcgactattatagagggcaccatagttcatatactaaacatcattcccaaagaagagaaaaggatagaaggcctcaagaggttaacattagcctctcatatttccatggaaaagataatgttgagacctacttagattgggaaataaagagtgcccttaggaagaggcacattccctcctgtcataccctaatttcgtccggggacaattgtttgatggcatgcaacctttgcttgaccgcttcgaggtacttggcccccatttttgcacaatacgtgaagttccgtaacatgccggaaatcaaaaggaagcattgttacacaatccgtgaggttatgtaa

SEQ ID NO: 41751 - DNA, 401 bp, Glycine max
  Peptide Sequence Number=SeqID_133436
ggttccgtcttaatcccctctcttgggcaaaccaacggagggtccgtgtctccttcttagatacaacgtcttggggtagcacgatgcccgacgcacaacacggggatgtgcatagtacgacaatattcgcaaacatcaagcttatcgataccgtcgacctcgagggggggcccggtaccagcttttgggtccctttaaagagggttaatttcgagcgtggcgtattcatgctaactcacattaattgcgttgcgctcactgcccgctttccaatcgggaaacctgtcgtgccaactgcattaatgaatcggacaacgcgcggggagaggcggtttgcgtattgggccctagcagagtgtatactggcttactatgttggaactgatgacggtgtccgtgaa

SEQ ID NO: 41752 - DNA, 421 bp, Glycine max
  Peptide Sequence Number=SeqID_133437
atggtgaaagttggaacctcttacgtgccgatcaacgtctcattttcgccaaaagttggcccagggcttcccggtatcaacagggacaccaggatgttgtttcttcagcttttgttccctcctgttcagctactgaggggtgggggtcgaatgcttcatgtggaaaagctccaccgcggtggcgccgctctagaactagtggatacccccgggctgcaggaatattcgatgcttcctctattcactgattctcgtaccgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 41753 - DNA, 438 bp, Glycine max
  Peptide Sequence Number=SeqID_133438
atgcccttgcggggtaggattgcatcagctattctaatcattgactccatagcagctagtgattatcaaagtcatcatgatagagctctgactcaaagaaaaggtataatggagctggacactcagagtgtaattctagctcaaaacaaactcttgacacaaaaaattgaggcattaacaaagcagatatgccaacttcctcggcattatcaccaaggtggaccacagaaaacacatcaagctcaccaaattcaacaaattttgagatgtgatttctgtggtggtaaccatcagaatggccactgttcatcacctggtgatggacaacaagaagaggaggcccattatctgcaaaaccaagccagacctcaacaaaactttcaaggaagctaccaaggttatagaggtggctcgggttcaaatcagccttatggctag

SEQ ID NO: 41754 - DNA, 187 bp, Glycine max
  Peptide Sequence Number=SeqID_133439
gtacttacccgttgaagatcgaaggaaacgatgaagaacgaatgaagaacgtcgaagaacggttgaaaccttttgcgaaattccttcacggaaaacgggagatgcttgccgcccagctcgcccaggcgagcagggttgcttcctccagaagcaacaaccttctggaggaatcttctggagggcccaa

SEQ ID NO: 41755 - DNA, 240 bp, Glycine max
  Peptide Sequence Number=SeqID_133440
atggtagcaataatcccaccaaaggttcctcaaccttcattttcccaaggatacaactcgaatgcaacatgtgcttatcatggaggcattctggggcattccattgagcattatacctcagagccctacactggggcaatgagaggcacaatgcatgagcctcaagcaaacctaggggcagataagaagttctcacctgttaggttgaaaatccaaaagggcagcctaagcaaaaattaa

SEQ ID NO: 41756 - DNA, 123 bp, Glycine max
  Peptide Sequence Number=SeqID_133441
atggcttcctatggtgatgatgacaaaggtgatgacaaaaagctcaaaggtcaatcaaagaatgagttcaagatgttcaagatagaatcaagaacacttcaagactcaagaggaaagttatag

SEQ ID NO: 41757 - DNA, 830 bp, Glycine max
  Peptide Sequence Number=SeqID_133442
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgatgatggcgacttcattggcgtggttgaaggccatggccgtcgcgcgcgcgtcctggatcgccaccccgcctaggctggccttggcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41758 - DNA, 126 bp, Glycine max
  Peptide Sequence Number=SeqID_133443
atggcggccacttcgcactttgagtgcgatgttccaatacttgtgaccactgcagttttggcagagtttccaaaacgtagtgttccaatagttgtgatcaatgtacttggtctcattttgattgag

SEQ ID NO: 41759 - DNA, 183 bp, Glycine max
  Peptide Sequence Number=SeqID_133444
atggctactactagtactattagtattgctcaagttgatgttatggatgagtttatacaatttgaagatgaagatatgtcgcaagtgggtaaatctcaactagatacatatttggaaaaggcaaatctttcaaataaatatcatcccaatcttgatgttttgcaatattggaaggacaattaa

SEQ ID NO: 41760 - DNA, 306 bp, Glycine max
  Peptide Sequence Number=SeqID_133445
atggaccctgagagaataaaggtcattcccgagtggcctactccaccaacaccactcattgagttaatgaggaactatattctctcatgggaagatggtcaggaaaggggttttccgtccataccgtactctaacatacccaacatcactaatacatatggggagggaatgatgcaatcctaccccccaagggcattggatagaagactccaagaagattgggccaaagatgcaagagaaggccctagggttctcatgagccttagggtagatttcgggttcatgggctatggctccataatgtag

SEQ ID NO: 41761 - DNA, 646 bp, Glycine max
  Peptide Sequence Number=SeqID_133446
aggaggaacagggccgacgggttcgacgaggagaccattgcctagctgttatgcacccggggcaggatttcgcccggaccgctgcagggaggcgggtgcggatcatgcacaccaacatgaccactttgacccagacatggatgacactgctgctcatcaatgtcttgcctatcgatcataactctgatctccctctgcctaagtgccagttggtgtatgccatccagacacggttgagcgtccacgtggcccaggtgattgctgatgccatctatttgtttgcaggtatggcacccgccaggcaccctctggacctggataagtccaacaaggccttggggtttccggcgctgatcacgggcctctgccggtcctttggagttcccgtcaccctcagtaaagtaatccgaccgccgatcacccgggtcttcatcgagaagtactgcacgcctaggcatggagcgttatctacagcatttggttcgccagcaggcggccaaccaccatgggtagtcgcatggcctggagactggcccgatgcccaggcaggagaggagcctgtaggatccctcggtgaagcagaggagacccgtatggatgaagatatgactaacttgctcagtttcttgggaggaagcggagccac

SEQ ID NO: 41762 - DNA, 221 bp, Glycine max
  Peptide Sequence Number=SeqID_133447
gtggccttgttggtgcttgcacacttagcgcaactctggctcgcttagcgcgcattagtgaatttcggcttagcgcgcgtcttctcgctcagcggatggactcaagcagtgcgcttaacgggattagccctcgctcagcaaacatgcacagctcatccttcttccagattcttcctcacgctcagccgcaagagtggtgtgctcagcgggtggctcgctga

SEQ ID NO: 41763 - DNA, 378 bp, Glycine max
  Peptide Sequence Number=SeqID_133448
ggatcgcacccacagagacacccagtggacctgaagaagtccaacaagggccctggggtttccagctctgggatcgcacccacagagacacccagtggacctgaagaagtccaacagggccctggggtttccagctctggttacgggcctctggattgtgcccacaagacacctagtggacccgaagaaggccaacagggtcttggagttgccagctctaaatacgggtctctgtcagttctagggagtgcctgtcgcccccagcaaggtcatcaggcccccgtaccaatcgagctttcatcaagaagtactgtgcccccaggcaggcgcagggcgaaacaccacagcagcattgggatggccggtagcgggcaatag

SEQ ID NO: 41764 - DNA, 127 bp, Glycine max
  Peptide Sequence Number=SeqID_133449
atgactaaatacgcagatcaagcttatcgataccgtcgacctcgagggggggcccggtaccagcttttgttccctttagtgagggttaatttcgagcttggcgtaatcatggtcatagctgtttcct

SEQ ID NO: 41765 - DNA, 1080 bp, Glycine max
  Peptide Sequence Number=SeqID_133450
atgccttcagaggatagcacgtcctcgccttcagaggactgcatgtccacgactttagagggctacacgccctcgccttcgaagcactacatgccctcgccttcagaagactactcatcctcacctttagaggactacaggtcctcgccaatagagggctacacaccctcgctttcagagggctacacgtcctcgccttcagaggacttgcacgccctcgccttcagaagactacacgtcctcgccttcagaggactgcaccacgtcctcatctttagagggctacattccctcaccttcataggactacacgtcctcggcttcgcaggactacatgtccttgccttcaaaggacagcacatcctagccttcagaggactgcacgtcctcgtctttagagggctacacgccctcgccttcagaggactacaagtccttgccttcagagggcttcacgtcctctccatcagaggactacaagttcttgctttcagagggcttcacgccctcgccttaagaggactgcatgtccatgtctttatagggctacacgcccacgccttcagaggactacacgccctccccttcagaggactacacatccttacatttagaggactacaggtcctcgccatcagagggctacacgcctacgctttcagagggctacacgccttcgctttcagagggctacacgccctcgctttccgagggctacacgccatcgccttcacaggactacacggcctcaccttcagaaggctgcacgccctcgccttcagacgactacacgtcctcgccatcggaggactatatgtcctcgccattagagggctgcatggcctcaccatcagaggactacacgtcctcgcctttagagggctacacgccctcgcctttagaggacttcacgtcctcgccttcatagtactacatgttcttgccttcagtggaaagcacgccctcgcattcataggactgcacgtcctcatctttagagagctacgcgccctagccttcagaggattacgcgtcctcgccttaagagggctgcacggcctggccttgagaaggctgtaa

SEQ ID NO: 41766 - DNA, 930 bp, Glycine max
  Peptide Sequence Number=SeqID_133451
atggaaggaaggaaaagaaggagtccttttctcatgtggaagatacccaaacattccgctgggatttcggcgcacaaaattccccccactatacaaagaatccataaggcgtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctagacacgttcggaaggagtatgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattgtcagcatatgatagacttaatggcccacataattagaaatcgttag

SEQ ID NO: 41767 - DNA, 84 bp, Glycine max
  Peptide Sequence Number=SeqID_133452
atggcaaaaatcaaccaaggtaagacgatgaccactcacgatcggtcgcatatcgttcggctcttacttgcaggtacagcatag

SEQ ID NO: 41768 - DNA, 546 bp, Glycine max
  Peptide Sequence Number=SeqID_133453
atggctaccagcaaggctttggaacaagagaccaaaagggcccgtaggaaagaacatggccggaacaagttccgaggggctttgtggggcagtaacagcgaacttaaactccgaaaagaagaaagggaccaatcgcgagtagacggtttgatcttgaaagatgaattgaaggcttgctcgaggtccaagagaagtttgtctcagcggttgtgcgagacagagaccaacatgttagctatcatcaccaagtatcaagaagaactaagcctagccacagcccacgagcatagggtggcggatgagtatgcccaagtgtacgcagagaaggaggctagaggaagggtgatcgactcgttacaccaagaggcaaccatgtggatggaccgatttgctcttaccttgaacgggagtcaagaacttccccgattgctagccaaggccaaagcaatggcggacatctactccgcccccgaggaaatccatggacttctcagctattgtcatcatatgatagacttaatggcccatataattaggaaccgctag

SEQ ID NO: 41769 - DNA, 252 bp, Glycine max
  Peptide Sequence Number=SeqID_133454
atggaatgccccgggacacccccatggtacttgcaagttgcgttagggtcataccactttgggaaagggggttggaggacctttccgggagttaccacggccaaatggttggcgatgagggacggcaagaggtcttcgtacgtcattgggagtgggaggcgttcccgctatgagccgagaagctcgggtgatgttgcgcgtactgatgggtaccatgaggtgtctgcggggtttcacccaagcgggcgttga

SEQ ID NO: 41770 - DNA, 240 bp, Glycine max
  Peptide Sequence Number=SeqID_133455
atggtaaagaatctcttggaaaatttgatgccaaagccgatgaggctatttttcttggttactcattgcaaagtaaagcatatagagtataactctttgaaagatgaagatgcaggatttcaggataaggattctgctcctaaaaatgaaaccaaagttgaagaactagaacaaagcaaagaaatctcaaccacacctcccaaggacctccctagagaatggagaactcaaaaagtgtaa

SEQ ID NO: 41771 - DNA, 366 bp, Glycine max
  Peptide Sequence Number=SeqID_133456
atgattatgagaggccaagacatttatagtagccaagatgaggttactacttcaccttcctctagtgaaagtgaagaagcaaaaggggaagaatctagtgaagaaatctacccccaagaagaaggacaacctttaatggttaaggaggagtgtaaggaggtattattaggcaccgaatcccctatgataggtggtatgatgaatgtgttgagtggtgcaaccctcttttgtaaaatcactcatgcatccaacatcttcatgattcgcatacatagggactcattaggtagtgatcaagaggttcccacagaccctaagagaataaaggtgttgagggaagaatcccagagtttcaagaatctctag

SEQ ID NO: 41772 - DNA, 480 bp, Glycine max
  Peptide Sequence Number=SeqID_133457
atggaaccaattgcctccctcgcccagtattatgatcagccgttgaggtgcttcatctttggggacttccagctatcaccaatggtggaagaatttgaagagatcctaggatgtcctctaaggggaaggaaaccatacctcttctcagggttctacccctcattggccagaatttctaaaaaagtccaaatctcggcgcaggaattagaccgccaaaggcaagtcgaaaatggggtggtcggaataccgagaaaatattttggagctctctatggggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 41773 - DNA, 708 bp, Glycine max
  Peptide Sequence Number=SeqID_133458
atggatcaattacgtaataatgtgaatgctaggtcgttgcccggaagcaacgcgctgtatggctcgagtacagtgtcaaaagagcaagggccgctgcatcgccgcccggatgtactgaaaagtcagcaagggttcccacattttcgtgaacgggtgtgggtaaagaagctagttcgtgacaggaggattcgctttggtacatggaatataggcatacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtagatgatataccccaaggagagaaagttttcctaggaggggatctcaatggacatgtaggtagcgtggatagaggttttgagggggtgcatgggggttttggcctaggggagatgaatggggagggtaaatccatcttggagttttcggaggctttggatctttctatagccaatacatggtttaagaaaagagaggaacatcttatcacttacaaaagtggagggacatgttctcagatagatttcttccttatcaggaagtctgataggaaagtattgcttgaactgtaa

SEQ ID NO: 41774 - DNA, 162 bp, Glycine max
  Peptide Sequence Number=SeqID_133459
atggaacaatttcttgcttcaagattgagggaaattatgaaggcaaactcctgcgacttttttatgcccaagggttttggaggggaagaggggagaatgggggtggaggaggaatgcggagttgagggtggtggtggcaccgggaagaagatgaagagatga

SEQ ID NO: 41775 - DNA, 468 bp, Glycine max
  Peptide Sequence Number=SeqID_133460
atgaccatgattacgccaagctcgaaattaaccctcactaaagggaacaaaagctgtttctgggctgctcttctacctaatctggacgcgcagactaaaggacaagttgctcgtgccatgtggtatcctgattgttacaacaccggtaccgttgccaaccctaaacctattgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41776 - DNA, 452 bp, Glycine max
  Peptide Sequence Number=SeqID_133461
atggctctgaagaaactctccacgaagaggtctagaagggacgccactggagaaggctccagtgccgcctcagagtttgatagtcaccgtttccggagtgccgagcaccaggagaggcgtgtccagctcagggaagatgagtactcggacttccaggaggagatagctcgcaggcattggactcctctagtgactcccatggccaagggtcagtggattcccttcgacgcagatgccctcagccagttcttgggcgacccgctgattttggaagaagaccaggaggcgggtgcggatcatgcgcaccagaactctgacctccctctacctatgtgccagttggtgtatgtcatcctgacacggatgagcattcacgtgggcccagggcctggggttttcggctctatcacaggcttctgccagtcctacggagttcctatcacccctagcag

SEQ ID NO: 41777 - DNA, 381 bp, Glycine max
  Peptide Sequence Number=SeqID_133462
atggcgatgacatcggcgatggcggtgacaatccagcagaaccagtacgtccataccgcagaagaagccggcccagggcccgagcagatcggtggaaaaatcgatgaaggacttgtactccaggttggacagcaacagttcgcccatcgcgcgcatcacgaagaacagcatcgcgccgatgatcaggtagacgaagacgatggacgggccggccaggctgatggtcttgcccgaccccatgaacaggccggtgccgatggcaccgccaatggcgatcaactgcaggtggcggttggacaggctgcggcgcaggtgctctgggggcgttgcgggctcggtcatgggcgcgggcaaaagggcgggcgaagcgttcgacggtag

SEQ ID NO: 41778 - DNA, 234 bp, Glycine max
  Peptide Sequence Number=SeqID_133463
atggacacattgctagtgttctattatgaaaagatgatggaatatatgcctgcgagctttgtggatttggtgtttacgggggaaaggattgaagttggtttgaagaaggaaaagtttgattatgctgcttcaacgaattctggtagtaggaggcctaggatgaatggagtgaagaagaaagaggcagaagctcatgtcgtggatgtggttcccacatggccaaacttcgcataa

SEQ ID NO: 41779 - DNA, 756 bp, Glycine max
  Peptide Sequence Number=SeqID_133464
atgagtcttcattcttcatctagtgttaatggtgagggttctactcctaaggaccccttgtataagatattagatgagttgagatcccttaagttgtggaaagaaaaacaagagagaaaagataaaggtaaaaaaagagtggaagaaataagccaagatgaaagagagaaaataagagaggaagaaagaagaaaaataatgaaagaaatgaaaagagaaaaacatgtctcctatagtagtcataactcttgcaagagcctaagtgaagaacttcgtgactattatgaaggaaggcataggtcacatcttagacctcactcccataggagagaaaaggaaagaaagcctcaagaggctaacattaacttcccatacttccatgggaaggacaatgtagaggctaacttagattgggaaataaaggtagagcaacaacttaaaaggaagtctacttcaaaatgttatggctctcactcttatccaaagagagaccaaggtcaaggcatcttaggggtgacaccttctaagccaaaagatgataaagggaagacaatagaaaaaggacacattacttctcaatgccccaccaagaaaaccatgattatgaggggccaagaaatttataatagccaagatgaggctactacttcaccttgctctagtaaaagtgaagaagcaaaaggggaagaatctagtgaagagatctacccccaagaagaaggacaacctttaatggttaaggaggagtgtaaggag

SEQ ID NO: 41780 - DNA, 495 bp, Glycine max
  Peptide Sequence Number=SeqID_133465
caaccgcaaaagcccttgaacaagaaaccaagagggctcacaaggaagagcacgaccgtgacaaattccgtggagcattgtggggcagcaacagtgagctcaagcttcgaagggaagagagagaccgatcacgagcacatagcatggtcttgaaagaagagttagccacttgctcaaggtccaaaaggaacttgactcagcgtttgtccgagacagagaccaacatgttagctatcatcaccaagtatcaagaagaactaagccttgccacagcccacgtgcatagggtggcggacgagtatgcccaagtgtacgcagaaaaggaggctagaggaagggtgatcgactcgttacaccaagaggcaaccatgtggatggaccgatttgctcttaccttgaacgggagtcaagaacttccccgattgctagccaaggccaaagcaatggcggacacctactccgcccccgaggagatccatgaacttctcgactatt

SEQ ID NO: 41781 - DNA, 645 bp, Glycine max
  Peptide Sequence Number=SeqID_133466
atgggtgaagtagaggaggtgcaagagcagatgaaggccgacatggaggccatgaaagagcaaatggccacaatgatggaggccatgatgagcatgaagaagataatggaagccaatgcggttgcagttgtcgctaccagtgctgttgctaaggtgaactcgatgcccctatctggcctcaaccaaatgaatcatccaacctcagctatggtaggcaaagatttgggaagtacgagcggcccctattatgtgaaaattcaaaacaagcacgccttcccaccatatggcttgcctcccaactatacacacccaatgtggcatacactcccaacacgtgaaatgccccaccacaatctagcaaactttgagccttgcctcagatatgccactaaaggccaagcagttggtggtatacccctgcaaaacactttggagggccctcagtatcacccacaaccacactcctcacattccacagcggttaaaaaccctcatgctatggcagaaatgggaaagttggatcatctagaggaaaggctcagggccattggaggaggcgaagattatgcctttgttaacctagaagagttgttcctagtacccaatatcatcacccctcccaagttcaaaggtgttggactttga

SEQ ID NO: 41782 - DNA, 351 bp, Glycine max
  Peptide Sequence Number=SeqID_133467
atggtggggtacgcaccttcaagctttgcggatttggtcttcgccggcaaaagaatcgaagcaggtctgaaaagaggcaaatttgatcatcctgctttgatgaatgagaaaactggagcaaatcaagatgatgagaatgaggaaggaacccatgttgaggttgccattcctacatggccaaatttcccatcagcccaacaatgtcattactcagccaatatcagctcttctcattacccaccacctagtcatccacaaaggtcatccctaaatcaaccacaaagcctacccgccacgcatccgatgccaaaacaccaaccaaaaaggaatttggtagcaaaaagcctatag

SEQ ID NO: 41783 - DNA, 421 bp, Glycine max
  Peptide Sequence Number=SeqID_133468
atggctaaaccaagcagccccgcaaacttggcatcagccatcatttgtttctttgcctcaaagaagttcccccatagactaaaagcatcaccgggaaggtttgcaaggaaaacccttcaccacacccttccgtcatggtccatgttcatggatttttcaaagtatgccttgccgttggttgtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccac

SEQ ID NO: 41784 - DNA, 178 bp, Glycine max
  Peptide Sequence Number=SeqID_133469
atgcatatgacacagatgcaacttaggaatgcgggggctcgaggaatcgtctccttcttagatacaacgtctaggggtagcaaagtgccccaacgtatcatcctcttcgaagaacatattgcagcagtagggactactggcaacaataagttttcaaagagaaaagctctagatgagg

SEQ ID NO: 41785 - DNA, 252 bp, Glycine max
  Peptide Sequence Number=SeqID_133470
atgatcttcccgggagttattacgaccatttggttggcgataagggacggcaagaggtcttcatacgtcattgggagtggggtgaattctggaattggcttcgggggaaagttcctcattgtgttggaattgccggccgggcgagtcgtggttggggccggaacttggggggcctccctctggatgggtgccttaggctgcacgggtgctgaattggaggagttcccggcgcgagctgaaaagctcggatga

SEQ ID NO: 41786 - DNA, 423 bp, Glycine max
  Peptide Sequence Number=SeqID_133471
atgcagtcccagcttcagtcacagatgcaatcacagggacttgcaatgcctccggagcctaaggttggtccctcagctgctcatgttagcacaaatgggagttgtgttgatccctcactgaccgatccagagacgggtgacttagacaaatgtgggctgtacatcgaacaaaatccttcccgcctagttgccctaggaagagtttatgagggatccatagttgttcacaacatccctttgttgcatggccaggtgaaggttggtgttgaggaggttaaagatgcagaggttcccgttcctgtacccaatgacgaggttcaactaatagggcaggcactaaacaccttccttgcttggctgacacatcttgtgaagcatgcagctgtgtctccagcaaagcctccagataggccaaatcctgag

SEQ ID NO: 41787 - DNA, 438 bp, Glycine max
  Peptide Sequence Number=SeqID_133472
atgaccggccctctcgatgagtcaatctattgctttctcataagggtggacccttgggtactagtacctattgcatatagaagactacacatcctcaactttagagggctacatgtcctctccttcaaagggctacacgtcctcgccttcaaaggactacaggtcctcgccttcagaggactaaaaatccttgactttagagggctattcatcctcgccttcagagggctgcacaccctcgctattagaggactgcacgtcctcgccttcagagggcttcacatcctcgccgtcagaggactgcacgtcctcgccttcagaggactacacgtcctagcctttagagggctgcacatcctccccttcagaggactgcatgtcctcgtgtttagaggactacatgtcctcgactttagaggactacacatcctcgcctga

SEQ ID NO: 41788 - DNA, 251 bp, Glycine max
  Peptide Sequence Number=SeqID_133473
gcccacttgggccctccagaatattcctccagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaggaatttcgcaaaggtttcaactgttcttcgacgttcttcattcgttcttcatcgttcttcgatcttcaacgg

SEQ ID NO: 41789 - DNA, 45 bp, Glycine max
  Peptide Sequence Number=SeqID_133474
atgtatagcaaggcaaggttgaggagggcagattgcaatgccaag

SEQ ID NO: 41790 - DNA, 390 bp, Glycine max
  Peptide Sequence Number=SeqID_133475
atgaacgaaaacgcaattcatggggcttcgaaaaagattgagaatggagaattgcaccaagcaatcactgcgcatggctccaaactcgaaggtggaggacacatgaacgaaaacgcaattcatggggctccgaaaaaggggttgagaatggggaattgcactaagcaatcactaagcatggctccaaactcgaaggtatcaagcttatcgataccgtcgacctcgagggggggcccggtaccagcttttttccgaaaaaaagattgggaatggagaattgcactaagcaatcactacgcatggctccaaactcgagggtggaggacacatgaacgaaaacgcaattcagggggctccgaaaaaagattgagaatgggagaattgcactaa

SEQ ID NO: 41791 - DNA, 351 bp, Glycine max
  Peptide Sequence Number=SeqID_133476
atgcgacttagaactgcatctggagacgttgtccctattaacttggaaattgaagctacttgtcggcgtaacaacgctgcaagaagaagaaggaaacaagacacagaaggaagcagttacatctcacctcctctttctccaaatcatactgaaatggacgcgaaaccagcacgaagagtcacactagaggacttctctaagaccgccactcctcagttcttcacaactaatccaagggaacctcttccatggtcttccaagcgaagatccatatgctcatctagcctcatacatagaaatatgcaacaccgtcaaaatcgccggagtcccagaagatgcgatatgccttaa

SEQ ID NO: 41792 - DNA, 269 bp, Glycine max
  Peptide Sequence Number=SeqID_133477
aggaacccgcgcgcacgcttcagcacactgtggagtggatattacccacgcctacaccataccgtctagtggagccagtccaagtgatcgaggaccctgaggagctacctcccgagcctgctgtggatgctcttgactttctagagggtgatgaggacccactcattgaggtggattctcccaaggacgtcatgtcggcatctgaggcagactctacggaggatagtggccctggagagatggcgattagtggaggctcttcatcatag

SEQ ID NO: 41793 - DNA, 309 bp, Glycine max
  Peptide Sequence Number=SeqID_133478
atacttggcaccctttgttgcacaatatgtgaagtcccgagacgtgccgaaaatcaaaaggaagcaggcttacgcgatccgtcaaccatccgtaatgtgacggaaatcgaaaggagattcttcctccagaaggttgttgcttctggaggaagcaaccttgctcgcctgggcgagctgagctcgcctgggcgagctgggagtgaagagggaaggggttcagccttcttggcacttcttattctctcgaaattgctgaggaaaattgttttcgtgaagaaaatccaagccgaggcgcttcctcttcaactg

SEQ ID NO: 41794 - DNA, 2418 bp, Glycine max
  Peptide Sequence Number=SeqID_133479
atggcgctgccgtttgtgtctaagctgattccgcgcggtccgggcaacccgattgagccaccgcagggcgcagaaggcggttccggtaccgaaaccggcattcagccgcagtacggtgtgccgtttggcgtcgagctgaacccgttcctgtcgccgtttggtctgccgtgtaaacagccggcctggggttacgtttcagcgatcgacctgaagaccaacgaaaccgtgtggaagaaacatatcggtaccgttcgcgatagcgcaccggttccgctgccgttcaaaatgggtatgccaatgctgggtggcccaatcaccaccgccggtaacgtgttcttcatcggcgcgaccgcagataactacttgcgcgcgttcgataccaacaccggtgagatgctgtggcaggcgcgtctgccagcgggtggccaggctacgccgatgacctatgaagtgaatggcaagcagtacgttgtcatcgcggccggtggtcacggtggcgagaaacaccgggcgcataccaaacgcgccgccgataaagccaccgaacagcgggccactcacctggccgacatactgagccgaggtcgcatagcccagcattttcccgacctgccgctgcggcacattatgacgaatcaacgccgtcacgcagggcatcaggccgcccagcgccatccccatcaggaaacgcagcagcaccagctgccacgccgcgctaataaatgcctgcggaatcagcagcagcgcgcagaccagcaggccataaatcagcacgcgcgcatgtccgatgcgatcggccagccggccaaggcgcggcgcggagagaatgctgcccagcgcagcggccgccatcaccagtccggccgttaccgtcaccgcgtgattccccgtgaacaaacttgcgcgatatatagcgtgataatcggctcaatcgacatattggcaaaaatcagcagcatgcccgacagccacatcagccgcaccactggccggttgatcgacgcctccggctcatcaccctccccggctgcggctttcttcgccgcacgtggcgcttctttcagcagaaaagtggtggcgagaaacgcgagaaaaatcaccgcgccggtgagccagaaagtgtggcggataccgatcagcggtggcagcacgccgcccagcagcgggccgaccacattcccggccatgatgccggaggacagcacgcccagcgcccagccggcgcagcgctaccagctgccacggcgcggtggccataccaatcagcgacatggcgacggccattccgaggctggcgcggatcagcatcagcttgcggccatagcgatccgccagtttgccccacagcggtgccgtcagcgccgcgctaagaaaggtggcaccaaagggcagcaacagggtcatggcgacgatagtgctgaacgagcccagcacgcaaacccacaaattgcgccgccagctatcagcggtagcacacagaaaacagggagaagcggatatttgccagccagcgcgttattgttgccagaaaacaacaatcacggcgcacccagcgtagtgatcagcgcgtcgcagagcaaggtgaccggccggcagatacgccacgccggttccggccagggccgcattgagcagcgccatgctgttattcgcgcgaaagcggctgtgcacatccagcgccaggcgctgcttatcacggcgaaacggcaacgccgccgtgtgtgccgggccgtgaaacagcagcagatcgtggcgcatcagacgttcgggatgatcgatggccggatgcgcagccagatacgctggcgacgcatacagtccccagtcaatgctgctcagctcgcggtagttcgccacctccggcgcacgcgcgcggatcacaatcgccacgtccgcactgggctgcggatcgtcgctggtggtcagttcgagatcgacgttgatgtgaatatgacggcggataaaggtgttcagcgtcggcaccacgcactgacagccgaaggtgatcggcgcctgcaatcgcacgttgccggcaggctgctgatgcacctgctgcacaaacgcgtcggcgcgatgcatctcttccagcatgcgggtgcagaacggatagtaagcctggcccagctcggtcagcgccactttgcgcgtggtgcgctgcagcagtttgatacccagccgcacctccagccgggcgatttcgcggctgaccgtacgggccgcttcgctgaagctttgccgctcaacgacgcgtgcaaacagcatcatggcggtgagattatcgctgttgtccatgttctctggctgattcgaaagagtgagaaccgcagcttaaaagtaaacacgcgaatgcgcacccgatttcccgttacgcagcggccacgggaaatcgggcgagggatgtcacaccgccaccgctaa

SEQ ID NO: 41795 - DNA, 345 bp, Glycine max
  Peptide Sequence Number=SeqID_133480
atgacgtttggtgatatgccggagcagggcgaacaggtgggcgatcagtcggcgccgccgctgccgccggaaaagattatgcatgcgcatctgcgcattggtcagggcgagctaatgctgagtgatggcaataccgcccagccaccggcgtccgaacatgccggttatgcggtgagcctggccacgccagatgaagcggagggtaaagcctggtttgataagctctctgcgggcggcaaagtgaccactgaatggcagaaaactttctggtcgaacggcttcgggatgtttatcgataagttcggcatcccatggcgcatcaacgtggtgaagccacaggcgtaa

SEQ ID NO: 41796 - DNA, 1414 bp, Glycine max
  Peptide Sequence Number=SeqID_133481
atgagccagttttttatgcatgaaaaaaacgatctggtgaacgaagcgatcgaaggcgtgttactcagcacaccgtggcacaacctgacccgtctcgatctgggcgatgagattcgcgtggtggtgcgttcggactgggataaaagcaaagtcgcactgatttccggcggtggctccggccacgaaccggcgcacgcgggctttgtcggcaaagggatgctgaccgctgcggtgtgcggcgatatcttcgcctcgccgagcgttgatgcggtgctgaacgccattgttaacgtcaccgcggagaaggcgaaaaatctcggttacaaggtggagctggtgatggtgcaggacgatatcgcgctgccggaaaatcccgcaacaccgcgcggcattgccggcaccgtgctggtgcacaaaatcgccggctttgccgcggagcaggggcactcgctcgacgaggtcaaaaccctggcgcagcgcaccatcgacgccacgtcctccatcggcctggcgtttgccacctgtcacattccgggtgaaaagcgcgacgatcgcgtggcagctggtcatagcgagctggggatgggcattcacggcgctgcccgacggcaaacaggcgctgttgatgatcaacaatctcggcggcttttcccagctggagctggcgctgctcacgcgcgaggtactgcagtcgccgctggcggcacgcatcacccatttaattggcccggcaaccctggtcagcgcgctggatatgaaagggttttcgctgacgctgctggcgctggaagaggcgtttttcgaggcgctgcatgcgccggtgcgggtgctgggctggacgccgatcacgctgaacgcatcggcagcgtgctggatttcgatccttccgataacgctgaagtggcgcaggtggttgagcgcgtgacgcatacgctgatcgatctggagagcgagctgaatgcactggacgccaaagtcggcgatggcgataccggctcgacctttgccgccggcgcgaagaaaatccagcgcggcctgcgtgaacagcagctaccgctggatgagctgcctacgctgctggcgctgcggcgtgctgatgtcgattctgtttacttcggccggacagcagctggaggagggcagcatgctgccgcaggcgctgatgcacgggctggaacggatgaagcactacggcggcgcgcagccgggacatcgcaccctggtggatgcgctacagccggcactggaggcgttagcggccggagagtcgctggctgcggcggcggccgctgcgcaacagggtgccgacgcgacggcgcagatgcagagtgcgaaggcggggccgttcggcttatctcaatcatcagagtctgtatggcgtgtagcgatcccggcgcgtacgccatcgatgagg

SEQ ID NO: 41797 - DNA, 1687 bp, Glycine max
  Peptide Sequence Number=SeqID_133482
atgccccatgtagggtcgccgttcacggcgaccgcatcctgcacatcccgcaacatgcccattctcgtggtcgccgttcacggcgccgcgtcatttgcacatactgtcagagacgcagcagattcgagccgatgtagcgcaggaacatctcaccgccgttacccgccgggcgcgtctgctcgtgacgcagttcgccgagacgcttgtgcagctgtcgctgtcctcgcacacgtagtagtttgccagccggtaatcccagtaattgttgccgctgccgctcagcaggcgctgagccggatcgctactgcccggcgcgaagctgtacagccggtactgccacggtccggcaccgagatagccatccctgagcgcaaagctgttctggccggcgttgccgcccacctgcgccagcgaaatgccttcgttgccctcaatgccgccgttgcggttgcgatcggtgagcgccgcgctgcttgccgcatcgagcctgacgttgagcagcgtggtgccgctggcgttaccgctgacgttgatgtggtcggtgaactggttgctcagcgcgccgccgtcattcaggcgcgtcaccagattcgcctgaccgcccagcgacgccagcgagccgttgatgtccagcgtattgcccggcgaaccgccgccattggtgagatccagcgtgccgctgttattcacctgcagcgaatccgctgtgccgcccgccagcgtgggatgcacgttgtcaccggcatacagcgtcgaacgcccatcaatgttgatggtgctgtgcgccaactgcagattgtcagtcagcgtccagcggctatccgcgaagttaatgatgctccagccgctgccgaggttaacgcctttgctcaggtcatccgcgctgaagctgccgccgcgcgccgtaatctggtcaaaggtcaggctgttaccggtgccgttgccgctggtgagatggtaagtggtgctgagatcgacgccgctgacctcggcaatattgttgttgtctgcgcccatggtcaggctgccgttgagcgtgccgccggtccagcggaacgtgtcgctgccgccgccaggattgatgtcgcccagcacgtcaccctgcgtcagcaaaatcacatcgtcagcgttactgcccgccaccgccacgctttgcgccgtggacgtcacgatagtaccgaggttctcgaataccgttttgccgccgcgcagatcgaccaccggtgccgtcaggctgctggagcgcaacgtgccgcggttgacgatggtgccggcggtgctggagaccagcgccgaaccgcctgccgcattagtgatattgacgctggcggcggtgaagatatttcccgtggtgttggcgcgaatcccggtgccgccggcgccggtgacattgaaaacgtaacccgaacccagcgtcagatcgccgccggtggtcgatccatcggcgttggcgatagtcaggccgttaccgctgccggatacattggtggtcacggtggaggcgggatcgaacgcgacggcagtgcggatgccgttgccatcgccgacgttaagcgtcaggttgctcaggctaacgttgtccagctccgcgcggttttcgatgccgttgccgctgcccagtacgttgatggtggcgtcgcgcgcgctgagcgccgccgcgccggtgtcgagcaatatgccatgcgcc

SEQ ID NO: 41798 - DNA, 89 bp, Glycine max
  Peptide Sequence Number=SeqID_133483
atggccgctttggagagagaaggtagcgacgaacttggttccacagatgcgcagctgtcgcaacctgcccttcggcgggagggcgacgc

SEQ ID NO: 41799 - DNA, 363 bp, Glycine max
  Peptide Sequence Number=SeqID_133484
atgcatctccacaaaatcctcgatacccctcggtacttaaacctgttcctttcccataccaaaacagccacgcagtcccgtggagcggtcacgtgtttgcacccccccgacctgctgactcaacccacaaacgttaaggggaaggcaaaggtggtggaagaacaaaatgacaaaatgaccctcactccgaacgaggatattccagtgaaaggtctttcggagaaaagggatggttgtggcaagaaggaagtgtcgctagaggaagcaagtgagtttctccgcattattcagcaaagcgagttcaaggtcattgagcagctcaacaaaaccccagccagggtctctcttttggactactcatga

SEQ ID NO: 41800 - DNA, 297 bp, Glycine max
  Peptide Sequence Number=SeqID_133485
atggaggagtttgatgctcaggtggcctggccaggagaccaaccctcttcttctggaaggggtggagcctctgtagcccaggagcctgtgactgaggagccaccagcaccagcagaggaggagactatactcttgaggagacctagccatctacaccagttacggagccagagcagcctatataggattcatcagcagctccagcactggatcttaatgaagaccagccacaggaggagcaggacgcttaaatttttgcattctgaacactttagtttatttttggttattttatga

SEQ ID NO: 41801 - DNA, 510 bp, Glycine max
  Peptide Sequence Number=SeqID_133486
atgggtgatcaagaggagacacaggaacagatgaaagccgacatgtcggctctgaaagaacaaatggcctccatgatggaggccatgttaggtatgaggcagctcatggagaagaacacggccactgctgccgctgtcagttcggctgccgaagcagacccaactctcttggcaactgcgcaccatcctccctcaaacgtttttgtgggggggggggaaggacggggaagggacacactggggcacgatggcagccctcacctgggatacaaccgagcggcttaccctttatggattgccgcccaactactcaccacccgtctttgcaagaagatgcgggccatattgctttctcccgtccttgaaagagagcctcctcaacagcccgacgaaggcacaaaagaccctcaagactacgctcgaagggatgtcgagttctatccccccgatccccgaaggtccgggcacccagtacgttgcctcagcccaacatcgcgacacaaccaatag

SEQ ID NO: 41802 - DNA, 375 bp, Glycine max
  Peptide Sequence Number=SeqID_133487
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgcttga

SEQ ID NO: 41803 - DNA, 141 bp, Glycine max
  Peptide Sequence Number=SeqID_133488
atggggtgtaataaatgggcacggaatggagaaggaagagagagaggagacgccactttcaaggagaagatgagtctagaagaagctcaccaccatagtgaggccatggataagagcttggaggaagaaggagatgaatga

SEQ ID NO: 41804 - DNA, 450 bp, Glycine max
  Peptide Sequence Number=SeqID_133489
atgcctaaatcatctcccaacatgcatgtgaagcaagaagtatcgacaagagtcaagccaaggctattgttcaaccaatcaatggggcaaaacacaccgaataaaatagatgatgatggctcaaattctcaccaaggcaaactgaaacgttttcatcgctctggagtgaataccacgacggatttccggcagtttctacacatatattcgcaagatgtggcgtgttacggtgaaaacctggcctatttccctaaagggtttattgaggatatgtttttcgtctcagccaatccctgggtgagtttcaccacttttgatttaaacgtggccaatatgtacaacttcttcgcccccgttttccccatgggcaaatattatacgcaaggcgacaaggtgctgatgccgctggcgattcaggttcatcatgccgtttgtgatggctttccatga

SEQ ID NO: 41805 - DNA, 492 bp, Glycine max
  Peptide Sequence Number=SeqID_133490
atggggatcgcacccacaaagacacccattggacctgaagaagtccaacaaggccctggggtttccagctctggttacggggcctctgtcggcactacagggcgcccgtttcccccagcaagttcatgtcgtcgtggcatagggatcgtgcccgcaaaacactctgtggacccggagaagtccaacagggtcttggggttttctagctctgattacggacctttttcagttctacggagtgcctgtcgcccccagcaaggcgtagggcgaaacaccacagcagcattgggagggccggcagcgggcaatagacgcaccgccaccacctctagagttcacctctgctcatccacaaaaaggtttgagcgttgcctacgacacatggccgaccagcaggcgaccaagtccaaagccaaaggtaagcaaagtactaggtccatgaccgacaaatcattaggcgtccagctcaagacgttaaagaagcgctactag

SEQ ID NO: 41806 - DNA, 639 bp, Glycine max
  Peptide Sequence Number=SeqID_133491
atggcgaggattcctaacaagattaggtctagtgatggatcaaaagaagcgcttaagcttgctgttaggatcaccgatctttggttcgttgggactcctgacaagtctgagcaagcggaaatggtttttgttgattctgagggtgatcaaattcatgctatttgtaaatcggatcacctcaagtcttggaaagctgatttgaaagagaattgcacttatgttatgcataatttcaaagttgttaagaatgatggtcaatttagagtgtgcgaacatgagtacaagttattttttattggagtgacggttgttagagaagctgatttgcatgaactgccttttaaggaatttagatttgttgaatttgcaaatgttgttgctggtaattttgtgtctggcctgttggttgatattattggggtcgttgatcaggtggtctttcggcatgtttcatcgaaaaataccagggttgtttttagaatgaaggatttgagtggtgaaattttgtcttgcacactttgggagaattactgtgctcagttcctatcctatttgaatgaacgtggggatgatgggccgatggttattatattgacgcatgccagaataaaagatgcacagggaagttatccagcttca

SEQ ID NO: 41807 - DNA, 414 bp, Glycine max
  Peptide Sequence Number=SeqID_133492
atgaggatacatttattcggcgtggatattacggtgggcataccgacgcatacttaccatacggaattctcaatgcctgggggtacaccagtctggcattctgatttagaatatatgacattagataacatgtttgggttcattgaagcatatgtagaatgcccaaaaagtataaataaaccatttcttccctatggggataataaggatggcactcttatctttcctacaggcacctttgttggggtttactatagtgaggagctcaagtatgctagagacataggctacactataataccaatttgtggatacctcttcgaggagatggaaagtccattcaaggactacattaattctctctttgaaagcagatccaatgctaaaaagaagggaaataacgccctatctttt

SEQ ID NO: 41808 - DNA, 387 bp, Glycine max
  Peptide Sequence Number=SeqID_133493
atgggagatcacttagaggaaatgattcgtgatcttggacaagagtcatttaagcaagcacatgcccctatgtatgatacattggaaagtgattccaagaagcctttgtatcttaggggaaaacatgatgccaaaaagttactatcaagcgaagaagatactatgttcgatgggtgtgcggtatcacagtacaaagtgaaggatgatgacgagtgtagcagtgatgaaagctcaaagaccttacatggcatgcagatgggagaaattgcgatggaatgcttcgccatccgaccgattcctcctagggaaagaagattaatggtctatatccgaattttggtaaagaggcaagaaatcttaggcttggacttgccactaatggaatga

SEQ ID NO: 41809 - DNA, 246 bp, Glycine max
  Peptide Sequence Number=SeqID_133494
atggaggagtttgacgcacaggtggcctggccaggagaccagccttcttcctctggagggggtggggcctccacagcccaggagcctgtggctaaggagccaccagcaccaccaccagcaccatcaccaatagcaacagaagaggagacaactccagctcagaccccacagccatctccaccatctgcacctgctcctgaggagactcatccatcagcactggatcttaatgaagaccagccataa

SEQ ID NO: 41810 - DNA, 609 bp, Glycine max
  Peptide Sequence Number=SeqID_133495
atggcttccatgatggatgccatgctaggaatgaggcaactaatggagaagaacatggccaccgctgtcgttgttagttcggctgccgaagcagacccaactctaccagctatcgcgcaccctatcccagacgtggtaggacaagaaagaagcacactggggcacatcagcaacccccatctgggatacaaccgggtggcttacccttatggatttccacctaattacacaccaccagtcatacgcgatgacgcgggtcgtgtccctccccccatccttgaaggggaacctccccgacagtcggacgaggtccacgaggatcttcgggggcatgcccaaggagacatcgattcccactccccgttccccgccgaggggccgacgcccaacgcactacctcagcccaacctcatgggagaacctcgaaacccctcagcacaaccgatattcttttccgcagacgggccacccctggtagccgaagaaaggaggaagctcgatctcatcgaagagagattgagagttgttgaaggttttggcgactatccgtttgcagacatgactgatctttgcttagtaccggacgtcatcatccccccgaaatttaag

SEQ ID NO: 41811 - DNA, 50 bp, Glycine max
  Peptide Sequence Number=SeqID_133496
cgtgactcaaatgtcagtatgacagatcttgtgagcgcggaagatgacca

SEQ ID NO: 41812 - DNA, 264 bp, Glycine max
  Peptide Sequence Number=SeqID_133497
gatcgtaatggtcaatggctgaagaaagatgcactccctccacaagatgagcgtactccttctcctcctcctcagcgagatgattctgcccttataaatgaagttctttcagagttatggggtcttcgcacttatgttggtgaacgatttgattctttggataattgttttgtaggaatggatatccatctcacgcagcttgaaaaggatgtgggttatatttgtcagagcttcgatcttccaccaccaccaccaccttcttag

SEQ ID NO: 41813 - DNA, 600 bp, Glycine max
  Peptide Sequence Number=SeqID_133498
atggcgatatcagccatcgcggcgtctctttcaacaactcaggcacgatgcgctccacgtccggcgcggtcaccaacaacggccgcgacatcaacaagcccgcgaatagctggggttggggatacggtggtttcggctggccttacggttggtcttattggatgtgacaaacgtttcccccacccaagggtgggggaatggatgagagagcatgaaaagggaatctgttgcagccgcgctgaagccacgccggcgccggccaaacaacgcgttagccaggaaagcctcatcggcgatacgcaacgcaaactgttaccgtccacccctcctgttttgtcgccgcagccggagcaaaatgcgcaagcggacatatttatcagcgaatctccgtgttggatgatcgataaagtcgaaacggcgacggcgccgctacgcctcacggctttcaaacagttggcgcatacggcccgtggccgctgtatgggggataaagggttggcgaggttgcgcaaaaagctgcaaaacgcgctgatagcgcaaggttatatcacttcgcgggtgcagctcgacgttcaagaggtaccgacagggatactgaag

SEQ ID NO: 41814 - DNA, 459 bp, Glycine max
  Peptide Sequence Number=SeqID_133499
atggctggtacattcttccttttgaaacaacaaattagtttagagattatgagcggtaagaaagaaatgactccgaatagagttgtgaactggccattcaggactctatatcattattttggggacgccacaattacggaagccacggaagccctggaagccatttttcaaaaacgtggaggagcttgccgcccagttgcttcctccttaagcaacccaactttcaaaatgttttggaagggcctagattcgaaatgctatttacactctgtcgcaacctacccttcggtgggagggcgacgcgtgactcgcgggaagcgtgttccacgaaaggaatacgcgcggagtcgccaccaacgtttatttgaggaaaacgtcggaaaaaccgggaaagacgcgatctacgaactttttagtgaaaggttcgggagttgtatttacgcacggggaaggtattag

SEQ ID NO: 41815 - DNA, 303 bp, Glycine max
  Peptide Sequence Number=SeqID_133500
gatggaccctcgggtactagtaccctggtcttcagaggactacacgtcctcaccatcagagggctgcacgcccttacctccagaggactacatgtcctcgccttgagagggctacacgccctcaccttggagggctgcacgccctcaccttgggtactagttaccctcaccgttgagaggactacacgtcctcgccttgaggggactacacgtcctcaccatcagagggctgcacgccctcacctccagaggactacatgtcctcgccttgagagggctacacgccctcaccttgggtactag

SEQ ID NO: 41816 - DNA, 411 bp, Glycine max
  Peptide Sequence Number=SeqID_133501
atggcattagcgcgtgattgttgtagggaaacaacccatggggcaatttgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41817 - DNA, 126 bp, Glycine max
  Peptide Sequence Number=SeqID_133502
atgaaaggtttgggagttgtatttacgcacgggggagatcgatggagaaggaggaaaggtgatcggagatgccacttcaaggagaagatgagtgaagaacaagctcaccaccataggaagccatag

SEQ ID NO: 41818 - DNA, 546 bp, Glycine max
  Peptide Sequence Number=SeqID_133503
atgaccgaccttctcgatgagtcgatctcttgctttctcataagggtgaacccttgggtactagtaccctcaccttcagaggaatacatgtcctcgcctttagagggtcatgtaccttcaccttcagaggacttcacgtcctcgcctccagaggactacatgtcctcgccttcagaggactacacgtcctcaccttcagagggctacacgtcctcgccttcaaagggtcatgtaccttcaccttcagaggactacacgtccttgccatcaaagggtcatggctacacgccctcaccttcagaggactacatgtcctcgcctttagaggactacacgtcctcgccatcagaggactacatgtcccccattttcaaagggcgacatgccctcacctttagaggactgcacgtcctcgccatcataggactacactgcctcgccttcaaaaggcgacacgttcagaacttcagagggctgcacaccctcgcctttagagggctatgcgtcctcactttcaatgggctccatatccacaccttaagataa

SEQ ID NO: 41819 - DNA, 269 bp, Glycine max
  Peptide Sequence Number=SeqID_133504
tcgggaaacctgtcgtgccagctgcattaatgaatcggccaacgcgcggggagaggcggtttgcgtattgggcgctagcggagtgtatactggcttactatgttggcactgatgagggatatattccgcttcctcgctcactgactcgctacgctcgggcgttcgactgcggcgagcgggaatggcttacgaacgggggcggagatttcctggaagatgcccagggaagatactttaacagggaagtgagagggccgcgggcaaagccg

SEQ ID NO: 41820 - DNA, 354 bp, Glycine max
  Peptide Sequence Number=SeqID_133505
atgttggaagtgtgggaaacctggtcatttaaagagggattgccgagtgttcaaaggatcgccccccctctaggactagtggatctaatgatcctgaaaagcaacaaggatgatgacgttgcttggtggtttgattcgggagcaataagccatgtgtgcaaagatcgtcgttggttcaaggaatttagaccaatcgatgatggctctattgtgaagatgggcaatgttgcaactgaaccaatcctaggattaggttgtgtgaatttagtttttacttccggaaaaagttgtatttggataatgtcttatttgtacctggtattcgtaagaacttattgtctggtatggttttaa

SEQ ID NO: 41821 - DNA, 255 bp, Glycine max
  Peptide Sequence Number=SeqID_133506
atggggaaaagaatgaccataatttatctccgcatgtcatcgggctcgccacctctggatgacaaaagggcgcagaatgaccataatttgtctctgcgtgccatcagacacgatcgagcctggatggaaaggtgcagaatgaccacaatttgtcactacgcaccatcggacacgattgcctctggatggcgaaagggtgtgcggaatgaccataatttgtctccgcatgtcatcgggctcgccgcctctggatga

SEQ ID NO: 41822 - DNA, 288 bp, Glycine max
  Peptide Sequence Number=SeqID_133507
atgattaggaggggtcaagacatttatagtagtcaagaggagactacttcttccccttcctctagtggaagtgaagatgaagtaaggggtgaagagtctagtgaggaagtctacccccatgaagaaggtgacttcctaatggaagatcatttaaaatggcctaataatgggattaccctcacccatcttggcactaaatttgtgttgcatcctcaaacaccttcacaggtggacaaagatctactaactatgaaagataagagggatgaggaagaaaaagaaggatag

SEQ ID NO: 41823 - DNA, 267 bp, Glycine max
  Peptide Sequence Number=SeqID_133508
atgagttgtacaagttcgctgagcgcactgcttcatctcatcaagcgcaccgcttcagcccatctgctgagcaagaacagatcactaagcgaaaattcactaataaggcttcctggttatggaaagctaaatcctctgttggatcttcctagtaggtcattcaacagtggaaactggtctgattctaaagtccttgatagtacagagctaagttgtcttaatgcggtcctggttgagtttagtccaacaagaggaatctacggatga

SEQ ID NO: 41824 - DNA, 180 bp, Glycine max
  Peptide Sequence Number=SeqID_133509
atgaacgttggtggcgactccacgcatatttctcctttggaaagcgcacccgtgagcctcgcccgcaaaaaggcacgttgcgacagttggcgactccactggggacctttttcacccacgggtttgagtaaaaaaggggccctatacccgggttcatgggaatttaaggagtggaggtga

SEQ ID NO: 41825 - DNA, 342 bp, Glycine max
  Peptide Sequence Number=SeqID_133510
atggtgggagcaggtttgaaaaaggatcttagagtgtctagggttgtgccaggaggtgcgatgatttacttcacgggcgaggtctctgctcagttggtagagctccgctcttgcaattgggtcgttgcgattacgggttggatgtctaattgtccaggcggtaatgatagtatcttacgggctgtcaagaacgtagaggagggtttcctcatttgggatcctggggaagaggatcaagctggcccttgcgaacagcttgatgcactatctcccttcaaccctttgagcgaaatgtggcaaaacgaaaaagaatccatggaccgaccccatcgtctccacccc

SEQ ID NO: 41826 - DNA, 219 bp, Glycine max
  Peptide Sequence Number=SeqID_133511
atgcatattgttgtggtaagacaggggcaggatcatcttgagctaccttctggggtgaggacaaaatgtggacggcagaaaccaatcaaggtacttagggacggatgcaagtggggatggggtcacgaccgaccgatcgttgccccttctctgcgcgaagcaagcagagaatgtcgctgttggattgggggtttgtatgggatggccctaggcctataa

SEQ ID NO: 41827 - DNA, 504 bp, Glycine max
  Peptide Sequence Number=SeqID_133512
atgacatgcgctgacaaaatttggtcattctgcacccttttgtcatccagaggcggcgggcccgatgacatgcggagacaaaatttggtcattccgcacccctttgccattcagacacagtcgtgtccgatggctcgcagagacaaaatttggtcattctgcacccttttgtcatccagaggcggcgggcccgatgacatgcggagacaaaatttggtcattccgcacccctttgccattcagacacagtcgtgtccgatggctcgcagagacaaaatttggtcattctgcacccttttgtcatccagaggcggcgggcccgatgacatgcggagacaaaatttggtcattccgcacccctttgccattcagacacagtcgtgtccgatggcacgcagagacaaaatttggtcattctgcacccttcgccaatcgcggccgacaagcccgttgacacgcggagatttacatcatcttccgcactcacaagatctgtcatactga

SEQ ID NO: 41828 - DNA, 424 bp, Glycine max
  Peptide Sequence Number=SeqID_133513
gttacaggttgtaccatttagggtgaggctcatgaatcatgtcattgcattcccattgaagagcacactcaggaagttcattacatgggaaatcaacagagacaaggatacaccaaggaggattttcggggttccatcaaggccacctcaacaagggccaaatatttttcagaggaccaccaaactggaggagacaatagcccagtttatgcaagtggccatgtccaaccataagagtactgaatcagccctgaaaaaccttgaaatccagaagaatcccaaagaagagtgcaaagctgttatgacaagaagcaagaagcttatgtcggctgaggatgaggatgttgttgctttgaatgagcaagttgttttgaacgacactactgataaaaagaagaatggggtaaaagatgagaggatttag

SEQ ID NO: 41829 - DNA, 540 bp, Glycine max
  Peptide Sequence Number=SeqID_133514
atgagtcatcattcatctagtgttaatggtgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatccctcctatggtagtcataactcttgcaagagcctaagtgaggaacttcgtgaccattacgaaggaagacataggtcacatcttagacctcactcccatagaaaagaaaaggaaagaaagcctcaagaggctaacattaacctcccatacttccatgggaaggacaatgtagaggctaacttagtttgggaaataagggtagagcaacaacttaaaaagaagtctacgtcaaaatcttatggctctcactcttatccaaagaaagaccaaggtcaaggcatcttaggggtgacaccttctaagcccaaagatgtttag

SEQ ID NO: 41830 - DNA, 428 bp, Glycine max
  Peptide Sequence Number=SeqID_133515
ggatcgtgcccacaagacacccagtggacccgaaggagcccaacaaggccctggggtttccgactttggttatgggcctctgtcagtcctacagggtgccagtccccccagcaaggtcatgccatcgtgacataggtaaggatcgcgcccacaagacacccagtagacccggaggagcccaacagggccctggggtttccggctctggttacgggcctctgtcagtctacgaagggtgcccgtcccctaagcaaggtcatgccatcgtgactatgagggatcgcgcccataagacacgcagtggacccggaggagcccaacagggccttggggtttccagctctggttacgggcctctgttagtcctacagggtgcccgtttccccccagcaagggatcgtgctcgcaagacacccagtggaccttga

SEQ ID NO: 41831 - DNA, 498 bp, Glycine max
  Peptide Sequence Number=SeqID_133516
atgagaggccctctcgatgagtcaatctcttgctttctcataagggtggacccttgggttactagtaccgtcaccttcaaagggctacacaccctcgccatcagaggactacacgtccccgccttcagaggactgcacatcctcgccttcagagggctacacgccctccccttcagaggactccacatcctcgccatcagaagactgcacgtcctcgccatcaaaggactgcacgtccacgccttcagaggactgcacgtcctcgccttcagagggctacacgccctcgccttcagagggctacacgccctcaccttcaggggactacatgttctcgccttcagagggctgcacgccctcgacttcagaggattgcacgtcctcgcctttagagggcggcacgccctcgccttcagagggctacacgccctcatgtttaaaggactatacgccctcgcctttagaggactacacgtcctccatttcaaaggactacac

SEQ ID NO: 41832 - DNA, 216 bp, Glycine max
  Peptide Sequence Number=SeqID_133517
atggaattattgagattacaccaacatgaagaaaatgacaagaaaaagaagggaattgctcttaaagcctcatcttcaatccaagtagaaagtgataaggaaaatgatctagatgaagatgatgatctaagcctttttgtaaaaagattcaacaagtttcttaaagtaagaggaaatcaaaggcgagcggattttaaatctaaaagaaggacataa

SEQ ID NO: 41833 - DNA, 1176 bp, Glycine max
  Peptide Sequence Number=SeqID_133518
atgtcgaccttcagcacgccgatcgactgggcaacgtgcagcgccgaacgccaggccgagctgctgatgcgcccggcaatcgccgcttccgacagcatcacccgcacggtgagcgagatcctcgacaacgtgaaggccaacggcgatcgggcgctgcgcgactatagcgcccgcttcgacaaggcggaagtcgccgcgctgcgcgtcagcgccgagcagatcgccgccgcctgcgcgcgactgggcgatgacatcaaacaggcgatggcggtggccgtcgccaacgtggacaccttccacaacgcgcagcgactgccggcggtggacgtcgaaacccagccgggcgtgcgctgccagcaggtgacccgcccaatcgactcggtgggcctgtatattcccggcgggtcggcgccgctgttctccaccgtgctgatgctggcgacgccggcgcgcatcgccggctgccgccgggtggtgctgtgctcgccgccgccgatcgccgatgagatcctgtatgcggcgcagctgtgcggcgtgcaggaagtgtttcaggtcgggggcgcacaggcgatcgccgccctggcgttcggcaccgaaagcgtgccgcgcgtggcgaaaatcttcgggccgggcaacgccttcgtgaccgaagccaagcggcaggtcagccagcgtctcgacggcgcggccattgacatgccggccgggccttcggaggtgctggtgatcgccgatgccggcgccaccccggcgttcgtcgcttccgatctgctgtcgcaggccgaacacggcccggattcgcaggtgatcctgctgacgccggacgcggcgatggcgcgggcagtggccgaagcggtggaaagccagctggccgagctgccgcgcgccgagaccgcccgccaggcgctggcgagcagccgcctgatcgtggcgcgcgatctgcctgagtgcgtggccatcagcaaccgctacggcccggagcacctgatcattcagacccgcaatgcgcgcgagctggtggacggcatcaccagcgccggctcagtgttcctcggcgactggtcgccggagtccgccggcgattacgcctccggcaccaaccacgtgctgccgacctacggttacaccgccacctgctccagcctggggctggccgattttcaaaaacgcatgacg

SEQ ID NO: 41834 - DNA, 348 bp, Glycine max
  Peptide Sequence Number=SeqID_133519
atgtctagccattctacaagccttgagccaaaatcccgactcaccataaaccttgacccaggaagaagaagaagaaaaagaagaagagaaaagaaggaaaattccccaatcaaagagtgggagaaagcaaaaagaaaagaaaggaaattcccaatcaaagaatgggagaaagtaaaaaaggaagaagaagaaggaaagaaagctcctgatcggggatctaaggaaaaacagaagggaatgcagagaggtctttggaccggacaatatctgaacaatacagaattgtcaccaaatgaacaaaaaaagaaggaaaggaaaccacgacctaaaatggtcttctccctttga

SEQ ID NO: 41835 - DNA, 500 bp, Glycine max
  Peptide Sequence Number=SeqID_133520
atggtgaaagttggaacctcttacgtgccgatcaacgtctcattttcgccaaaagttggcccagggcttcccggtatcaacagggacaccaggatttattgctcctggcgtatcatggttctatcagctgttccctcctgttcagctatgacggggaatggtgttatccgctcaatcggcacacaagcataccgaccggaacatcagcgggcaagtgtaaagccgggtcgggaaacgctgtcgccattcgctgcattcaaggctgcgcaactgtgcgcgaagggcgatcggtgcgggcctttcgctattacgccagcggcgctaaagggcggatgtgtgcatactggcgattactatgttggcactgataacgccaggggcgaattcctcgtgagctccaccgtcggtgtcatgcggcacgctctagaactagtggcttatccccacggggcggaattcgatcgttcctgggactgctcaggaagatacttaacagggaa

SEQ ID NO: 41836 - DNA, 984 bp, Glycine max
  Peptide Sequence Number=SeqID_133521
atgcaatttcagggacttacactgcctctggagcctctggttggtccctcagaaaaccatcctgagacgggtgactcagataggtgctgcttgtacatcgaagcaaatcatgcccgcctggttgccttggggagagtttatgaggggttcactgttgttcataacactcctttgtttcctggccaagtaaaggtgggtgtggaggaggttaaagatccagatgctcccgtacctgtacccactgatgaggtttccttagtggggcaggcaattcacaccttccttgcttggctgacacatctggtcaagtctttatcacaacatgtactttactcttactatatgtttcttctttttgaattaattcatttagcgtgcctcaaattaggccatttaactttgtttcatgaacaacatgttgtgtctccggcaaaatcacctcaaaagctggatccggaggttgatgatccgttttatctgatgacattgaccatcccagagcttttcttgaggccttaccaggttacatgggatgctaccatgttcggggtctttaatccaaacttcccactctacataaagcataaagacctctccgaaatcacacacggtgatcaatgtctcagcatatcagtgttacaattgtggattcttagacattggcagatgatggtcatcgtgcccaaggaatacctagttgtctggttttgttcattgcatagcaggccagacaacaaccttaaggggataattaacattgctttaaaaggtcttgatgatgctccacaacctaaatcaaaggctcctgctaggtggattgtcatcaagtgtaatagacaaaaaggaaatactgagtgcggctattatgtcatgcattggatgtccaccatcattttagggaatttcaggaataactgggaagcgtattttaacgatcctagaccattggagtcagagagattaaaggcgttgcagatccaatga

SEQ ID NO: 41837 - DNA, 135 bp, Glycine max
  Peptide Sequence Number=SeqID_133522
atgaacagcagaaaccaatcaatgtacatagggacggatgcgagtgggggtggggtcacgaccgaccgatcgttgccccttctctgcgctaaacaagcagagaacgtcgctgcaagacagcccagtatcctttga

SEQ ID NO: 41838 - DNA, 348 bp, Glycine max
  Peptide Sequence Number=SeqID_133523
ttggaactcttacgtgccgatcaacgtctcatttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 41839 - DNA, 968 bp, Glycine max
  Peptide Sequence Number=SeqID_133524
ctagggaaggcaagactcgccaaggagaagttcaaatcagctgctacacacattcggaaagagtgcaccgagttacaagaggaaaacgcggccactacaagagcccttgaacaagaaaccaaaagggctcgcaaggaggaatatggtcgagagaaattccgaggagcattgtggggtagcaacaatgagctcaagctccgaagagaggaaagagatcggtcacgggtgcatggcatgatcttaaaagaagagttagttgcttgcgcgaggtccaaaaggagtttggctcaacacttggaagccacggagcaaagcatgctagctatcatagggcaatacaaggaagagttgaaccagtctgtggcccatgaacaaaagctagtggaggatttcgcacaagtatacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaagtggtgagctgcgcctcggtggaaccaagtccgtcactaccttctctctccaacgcggccataatggtggcgcgtgttatgctcaggaacggatttgagcccagaatgggtctaggcaaggactgcctcgggaatgccgacatggtcgatatcaagggaaatccatacaagtatggattagggtatgaacccgggatgccagggaggaggaacgtgccgtcaagatttcgggcggatagggtatggcccggccgtattagccagtgtttcaccagcgctggaatggtgtccgaggaggaggtggtcgcaatagaagaggagttccctcaagacccaccaatttttgtgcaaccatgccaccccggttcccaagtgggggactggcgtgtgataagccagtcagaagtctataccgctgattcaat

SEQ ID NO: 41840 - DNA, 414 bp, Glycine max
  Peptide Sequence Number=SeqID_133525
atgccaatctccccctgcagatgtatcggttgggatcgcgcccacaagacgcccagtgggcctgaagaagtccaacagggccctggggtttccagctctggttacgggcctctgtcagtcctacagggtgtccgttcccccaacgaggaatcgcacccacaaagacacccagtggacccggagaagtccaacagggccctggggtttccagctctgggatcgcgcctgcaaaacacccagtggacccgaagaagtccaacagggtcttggaattgtcaagctctaattaggggtctctgtcagttctatagagtacctgtcacctccagcaagggcatcaggccccctactaatcgagctttcatcaagaagtactgcggctctaggcaggcacagggcaaaacaccacagtag

SEQ ID NO: 41841 - DNA, 186 bp, Glycine max
  Peptide Sequence Number=SeqID_133526
atggaggttgatgaaccttgcctggggttatggctaccattgaattatcaagtggattttgtggttgatttaggtatgacttatatggataactgggtggaatggcagtcacaacatgggtttctccctcatcctcaccctcttcatttgccccagttttctgattcgttcaagcaggatgattaa

SEQ ID NO: 41842 - DNA, 201 bp, Glycine max
  Peptide Sequence Number=SeqID_133527
atgggaggaaaatgcgcggagtcgccaccaacgtttattcgaggaaaacgtaggaaaaaactgaaaaaggtgtggtctacgaactttaagtgtgaaaggttcgggagttgtttttacgcatggggaaggtgtttccctcgctcctacgtatcctcaattgcgatgatggaaagtcagacctatgtagttcttcagaactaa

SEQ ID NO: 41843 - DNA, 665 bp, Glycine max
  Peptide Sequence Number=SeqID_133528
tagaaaaacaaaagaaaaagaaggatagtaaggccttgtgttcaaaggccaaggggaagaaaaaggaggaaaaggattcctccaagaagattgttaacaaggaaaatcattttgcaacaaaatgtgatattaaaatagcactccttcttaaacaatctttctaccttctcctatcaagggaaacatcccttagcaccgccatacctcttgagcttgaggttattcctcaagtaaaggagttgttggatgagggtttggttcgcaagagcttaaatcctcgtgctttgttggtgcctaaaataggtattattaggcaccaaatccctatgataggtggtataatgaatgtgttgagtggtgcaacactcttttgtaaaatcactcatgcacccaacatcttcatgatttgtgtacatagggactcattaggtagtgatcaagggcttcccatggaccctaagagaataaaggtcattcctgattggcctactccaccaacaccactcattgagttggtgaggaactatattctctcatgggaagatgaccaggaaagaggtgttgaggaaagaatccatgagtttcaagaacctctggatttgaggtcaaatccttttcaagggggagggaatgatgcaatcctaccccccaagggcattggatag

SEQ ID NO: 41844 - DNA, 726 bp, Glycine max
  Peptide Sequence Number=SeqID_133529
atggtgaaagttggaacctcttacgtgccgatcaacgtctcattttcgccaaaagttggcccagggcttcccggtatcaacagggacaccaggatttatttattctgcgaagtgatcttcgcgggtcacggtatttattcggcgcaatgctgggcctgggccgcgcgctccaagcttatcgattaccgtcgacctcgagggggggcccggtaccagcttttgttccctttagtgagggttaatttccagcttggcgttcatgtttctatcagctgtcctcctgttcagctactgaaattgtatccgctaacggcaaaagctaccagccggaagcatcagcgggcaagtgtaaagcgggcgcgtccgctttcgccattcaggaacctgtcggcaactgcatttgaggcaaccggggatcgaggcgggcctttgctattacgccagctggcgaaagggggatgtgctcaacggcttatatgttgggtaactgatgccagggtttcccagtcgaagcgttgtaaggcaggaattgtaataatcaatagggcgaattggagctccaccgcggtggcggccgctctagaactagtggatcccccggggcaggaatatgtgcttccttcactgaccaagctacgctcggcgttcgactgcggcgcagcggaaatggcttacgaacggggcggagatttcctggaagatgccaggaagatacttaacagggaa

SEQ ID NO: 41845 - DNA, 303 bp, Glycine max
  Peptide Sequence Number=SeqID_133530
atggcagctgactttgtagaggagattcattctgacccaaagaaccactttttgcaattcactcaatggaacaacaaagctagtataaacaacagatggaaatttctgtggttagctctatccttcttcgtctggcatcatagaaatgctatgattttcaagaaccagccgtttgatcctgaaaagagaaggactacaccagggactacaccatccatatgtagcagttgcatgtggaggtcaacaccaggttgtctcatgaacgacaactccattagccatcttccagcggtcaatgacatg

SEQ ID NO: 41846 - DNA, 255 bp, Glycine max
  Peptide Sequence Number=SeqID_133531
atggatcaagctggcgaggaaaggaagttgcaactgagtgagttagatgaaatccgcctagaagcctacgagaatgccaagttctacaaagaaaagaccaagaagttccatgatattgagatcaaaagcgactccacaaacaagagcttcaaggtcaacggacatcgacttaagccattcctcacgaacccttctttagtggacgtagtggtggaagagacttccttactccaccctactcttcctccaccatga

SEQ ID NO: 41847 - DNA, 300 bp, Glycine max
  Peptide Sequence Number=SeqID_133532
atgaagcccggtattgttatttattgtcactacctccccgtgtcaggattgggtaatttgcgcgcctgctgccttcccttggatgtggtagccgtttctcaggctccctctccggaatcgaaccctaattctccgtcacccgtcaccaccatgcaagcgccagggcaagcgtcatccgagacaaccgattttaaggaacaatgtgggggcactagaccacccacgttcactgcatgcaccgcatccgagagaacaatcaccacacgtgtgccacaggaagccgttatgatggacgactaa

SEQ ID NO: 41848 - DNA, 450 bp, Glycine max
  Peptide Sequence Number=SeqID_133533
atggtgaaagttggaacctcttacgtgccgatcaacgtctcattttcgccaaaagttggcccagggcttcccggtatgcatgtgttttgggcaagcttatcgataccgtcgacctcgagggggggccggtaccagcttttgttccctttagtgagggttaatttcgagctcctggcgttcatggtctatcagctgtcttcctctacaccacaccccttaattgcgttgcgctacactgcccttcgccattctgccaactgtcgggaagggcctgatcggtgcgggcctcttgctattaagacgccagctggcgaaaggggagatgaatattcgcttccattgctcgaactgactcgctacgctccggtcgttcgactgcggcgagcggaaatggcttacgaacggggcggagatttcctggaagatgccaggaagatacttaacagggaa

SEQ ID NO: 41849 - DNA, 794 bp, Glycine max
  Peptide Sequence Number=SeqID_133534
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctgagatgggaaagactgtaggagcaacagatatggaagggttaggagtttggttttgggcatttggagatcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41850 - DNA, 815 bp, Glycine max
  Peptide Sequence Number=SeqID_133535
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgctgtgtttgttgctccttactattaaaaaggttttaccactcagaacaatgttagttacttgtgaacaccagagagctagtctcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41851 - DNA, 954 bp, Glycine max
  Peptide Sequence Number=SeqID_133536
atgccggtattcgtaatccggtattcgcgctgcgcaacggcaccattggctggacgctggccggtcatgcgctggagcatgggcagagccgccgctatggcaacgccagcgaaaccgcgcaacgtcaggccgcgagccaggcacgcgccattgccgatcgcgctgcaggaagcacgcaccacctacctgttcgacgtgcgtgatgccgaagagtacgccgccggtcatctgccgggcagccgccacgtggcaggcggccagctggtacaggagaccgatcattacgccagcgtgcgcggtgcgcgtatcgtgctggtggatgatgatggtgtccgcgccaatatgaccggctcctggctggcgcagcttggctggcaggtggcggtgcctgacgcattgcaggccagcgatttcagcgctgtcggcagctggcagccgcaggtcgcgccggttgctgcgccggaatcgatctcccccgcgcagctggccgagtggctggcggctggcgacacgcaggtgctggatttcaccacgctcgccaattaccgcaacagccatattcccggtgcggcctggctgctgcgttccaccctgcagcagcagggcaaggcactactgcccgatgctggccgctatgtgctgacctgcggcagcagtctgctggccagctatgccgtggagcaaattgccacgctgagcggcaaaccggtgcgggtgctggcgggaggcaatgcagcctggcgcgccgccggtctgcccaccgaacagggcgagcagcgcctgctctcgccgcccatcgatcgttatcgccgcccgtacgaaggcaccgatattgaaccggacgtgatgcacggcctatctcgactgggatatggtctggtggcgcaactggatcgcgacggtacccacggttttcgcgtgctgcagctgcagccacaggccgtgacggtttaa

SEQ ID NO: 41852 - DNA, 213 bp, Glycine max
  Peptide Sequence Number=SeqID_133537
atggaggatgcacgaacagcgctaggcaatcaattcgtggcgctccggactcaatggtggaggatgcatgaacgacaatcaattcatggggctctgaataagatggtggaggatgcacgaacagcgctaggatatcaatttgtggggctccggcctcaatggtggaggatgtatgaacgacaatcaattcatggggcttcgaataagatttga

SEQ ID NO: 41853 - DNA, 253 bp, Glycine max
  Peptide Sequence Number=SeqID_133538
aatggatgcaagataactttaatattgcaccatggaggaagattcactccacgtgccagtgatggaaaggttgaatatataggcggagaatttgacgcttgggaggatatatttgcagattacatgaacacatttatcctatatccaattccagaagaagtcccactgatgttggacttcaaatgtcatccaattccagaagctagtaatgaggatgatttagatgatgtacctgttgttggccatgaggaag

SEQ ID NO: 41854 - DNA, 66 bp, Glycine max
  Peptide Sequence Number=SeqID_133539
atggcccgcacgaagaaaacaggggagatgacaactgaggccgtaaaggaaatcattgcgaaaatc

SEQ ID NO: 41855 - DNA, 324 bp, Glycine max
  Peptide Sequence Number=SeqID_133540
atgatcagtccaccaaacctgtctcagaaaaatgacgatctcagactcattcaccgtgagatcgtcgtgaaatttgagcaccatgtttgcaacccaattacgagcattttcgccgttggggatttcgatatcatgtttgagctgagagaaatacctttcgcatcagagacaaaggaatcgcaccaagacagtacaagtggaggcttcaatcccttatctgtctctctgacgtttgagaactctatcggagcggttagaggaaaaaactggaagaatctcaggaaaccgttagagatgctactatcgcggtctgaagacacgtga

SEQ ID NO: 41856 - DNA, 315 bp, Glycine max
  Peptide Sequence Number=SeqID_133541
atggtggctgtgggtgatggagaaagtgcttggaactttagaaatggctttggaagaaagaaagaagaagaaatgacatttttcctaagctacatgaaagcaaaggctgaacttcgagcacactccagatatcttctaaaagatcccaacggtcagatcatggacaagtgtcttgttaagttgcagaccaaatgtcaagaagagccaacggttaacgaaggttgggcagcgtttttaccgaggcagcttcatgtagctttctctagaagcttcattaagaaggttcctccagaagcttcctcgtggcttctttga

SEQ ID NO: 41857 - DNA, 225 bp, Glycine max
  Peptide Sequence Number=SeqID_133542
aggaaaatgcaaggatcatgcatgaatgaacataacatgcgaacgatgaaaatagaatgtatgcagtatggaagcaaagcttccaagcttattttgatgatgccaaaaactcaagtcaagaatcaagattcaagcaagattcaagaatcaaagagtcattcaatcaagaatcaagattcaagtgaagaatcaagaaaagactcaagatatgcaagagcctcatga

SEQ ID NO: 41858 - DNA, 789 bp, Glycine max
  Peptide Sequence Number=SeqID_133543
atggagaccaaggaagtcactttaaaacaaaatgtaaccgcatcaggtattacatggaaaatagtcaacgattatggcggagccggaacgctctattcatcatcgttcgatccttcaaacgccccagacttatctgtgtttgaagccaggaacgcgcaggctcccgccgggccagcaccgctagcgatgagatcaaaactggcgccctgcttcagtctcaaggacttatcgcaatatggtgttagagttaaagcattcacgaaattgcaagaagatgctaatggttgtactaacctgacggttattccagataccaaagcggattttgattttaacgcgcagcgtttaaatatctccatccctcaggcggcattatctaccgtcgtgcaaggatttatccctgaggatcaatttgacgacggaattaacgcgctactggtgaattaccagttcagcggctcggatgatttcgaatccgaagacgaatactatagtcttaacctccagtccggcttaaacctcggcccctggcgcatcaggaatctgagcacctggaataaaacaaaaggcgacgcaggcgactgggagtcggcgtacctgtacatgcagcgtagtatacgccccattaacagtaatttggtgatgggcgaaagctcctcgctttccgggatctttgacagcgttccgtttactggggtccaactcgcgacggatacctccatgctgccagagagcctgcgcggctatgcgccaattatccgagggattgcaaaaccaacgccagggtga

SEQ ID NO: 41859 - DNA, 90 bp, Glycine max
  Peptide Sequence Number=SeqID_133544
atggaatctaaagttttaggaatccctttacaggcccacgagtttgctaatgaacttcgtgctagtttaagcagagctagtggtctttaa

SEQ ID NO: 41860 - DNA, 402 bp, Glycine max
  Peptide Sequence Number=SeqID_133545
atggtgtatgccattctgacacggatgagcgttcatgtggctcagttgatcgctgatgccatttatctatttgcaggactctgccagtcgttcggagtccccgtcgcacctagtaaggtgattcgaccacccatcacccgagcttttattgagaagtattgcacgcagagacaggcacagggtggcgaccctcaggccccagatgcaccgcctccacctcctcaggctgacccatttgtgtcatttgacacggaacgggcagaggtcgcatggcccggagattggcctgaggcccaggctgcaaaggcacccacagagactcccggtgagccagatgaggctcgcgaggatgaggagatgtcagatttgctcggcttcttgggagggagtggagccacatga

SEQ ID NO: 41861 - DNA, 782 bp, Glycine max
  Peptide Sequence Number=SeqID_133546
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcgcatgccgtgcttcatcaacagcatccgcaagctggacgtgaaggcactgcgtgcctccgagcaggagctgcgccaggcgcaggtgcaggagcgcgaggaaaatacgaaatagcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41862 - DNA, 369 bp, Glycine max
  Peptide Sequence Number=SeqID_133547
atggctccgaaaaagctttccgcgaagagatctaggagtgacgctgcagctgaagggaccagcgccgcccccgagtttgatagccaccgtttcaggagcgccgagcaccagcagcgcttcgaggccatcaaaggatggtcgttccacagagagagacacgaccagctcagggacgatgagtacacggattttcaggaagagatagctcaccgacattggacgtcgctggtcactcccatggctaagtttgacccggatatagtcctggagttttatgctaatgcttggcccacagtagagggagtgcgggacatgcggtcatgggtgaggggtcagtggattccctttgacgcagatgccctcagctag

SEQ ID NO: 41863 - DNA, 993 bp, Glycine max
  Peptide Sequence Number=SeqID_133548
atggagttggatgagttcaaggctgaattggagaggcataacttccacaagcacctcaccaatttagctgatagcaacatcgacctagccttggtgaaggagttttatgccaacctctacagtcccaaggggcctttaccaaaacaagtcagaattcaaggccacttgataaaaattgatgcagacaacctcaacaccttcctggagacacctgtggtactggctgagggagaatccttacccgcttactctagatactgtagaatgcccattgatatcaaagagattgaggctgctttgtgtatacccggccgagggtttgttttaaatgctgaaggccatcctgggaagatcctcaggaaatatctggatctgacaactcttgctcaggtttggagtgttctctcatactccaacctgtctctgacttcccacacctcagatttgatttcagatagagctaggttaatctttggcctagtctctcagctggacatgaatgtaggatctctcatctctggccagatcacatcaatggcccattctaactcctctagacttgggttccctgctcttatcacatctctatgtaggtccagaggggttgcttctgatagcctagtcttcgaacgcttgagcccattcattaacttggcctatatcaggaagaactgttggaaccttgccgatctgacagttactattagaggggctaggagagcgagggcaaggccagctaaggctccttccacatctacagctcctcctccagcacgtaccttagcagctccttctaccccatcttctgtagactttcaacgtcttgaagccatgcttcaaagcatacatcaagggaagattgttttattacaaagtttacagctggtagcacctccagactctatcccttctgttgaacaatttaatgaatgggtagcctggcccgggactcagcctccccttcacagggaagacgaaggtctcactgctcag

SEQ ID NO: 41864 - DNA, 330 bp, Glycine max
  Peptide Sequence Number=SeqID_133549
atgtcaggtgccatttcattgagctgggaaagcagtgtcaaggacctgaacgagtacttcctcatagaaagaaaatttccctgctccggacaaacttcactctactccgaaaatctcagtgaatcttcttccactgagctggccttgaaccagaaatatgtacctgttgcaagggtctgtggtttgtgctcctctgctgaccaccatacagaccttttcccttccatgcagcaacctggagcaattaagcagcccgaagcttatgctgctaatatttacaatagacctcctcaacctcagcagcaaatcaccacagcagaacaattataa

SEQ ID NO: 41865 - DNA, 51 bp, Glycine max
  Peptide Sequence Number=SeqID_133550
atggatactcatctccgtgtgattgatgatcccatgaatgaagtgcaacgg

SEQ ID NO: 41866 - DNA, 288 bp, Glycine max
  Peptide Sequence Number=SeqID_133551
atgcccgcctcttgcaaagctccaaagataaaccttcttgaggttatcatgtcctttatttgcttgggcctctgcagcacgcatgcctctatcgcatttactgccggtcccccatggttggtgagtggatttgtcttcacatttgggccatcttcttggaagatgtcctttgttggacgggtgccgacttggaggggtttccggcacgagtcgaaaagctcggatggtgctaagcatactgatgagtatcatgaggggttgattggggttttggccaagcagagctga

SEQ ID NO: 41867 - DNA, 351 bp, Glycine max
  Peptide Sequence Number=SeqID_133552
atgtcagttctggaattgtacatagaaaaggatgtgtctggtggttctatgtttcattctgcaaattctcttacatcatgtggaaataatttatctaataatgaggcggaaccgtcaagaaatgtaagcaatttacatggtgatgaagataatgatgatgattatcttgtgtctaactcatacgtcgaagagtctttagacgaagatgataatgttgacgatatatctgatacagacgatgaagtcaccaacatgattcaaccagtaagaattgttcacccagccgaaggtgtagaacaaattcaaaatcccttttggaatgatgtttttcattataacaatatcaactga

SEQ ID NO: 41868 - DNA, 288 bp, Glycine max
  Peptide Sequence Number=SeqID_133553
atgaaaggaaaccaacaaaggggtaagtcacgtggagtcgccaactgtcgcaacctacccttcggcgggagggcgacgcgagactcgcgggatgcgaaccagagattctgggttcggtccccagtggagtcgccaactgtcgcaacctacccttcggcgggagggcgacgcgagactcgcgggatgcgtgttccacgaaaggaatacgcgcggagtcgccaccaacgtttattcgaggaaaacgtcggaaaaaccggaaaagacgcgatctacgaacttttaagttga

SEQ ID NO: 41869 - DNA, 297 bp, Glycine max
  Peptide Sequence Number=SeqID_133554
atggccaccgagctgaaacaagctcaatcacaaaactctgacaagttgccttctcaatctgtccagaatcccaaaaatgttagtgccattacattgaggtcgggaaagcagtatcaaggacctcaaccaatagcatcgtcctcatccgcaaatgaacctgcccaacttcactcaactacagaaaaagatgatgacaaaaatttaaaaacagtagcatatccctcttccattccctccaagagcaatttccaacaaaaaaatggaagaggcagagaaggaaatcttggaaacatttag

SEQ ID NO: 41870 - DNA, 459 bp, Glycine max
  Peptide Sequence Number=SeqID_133555
atggtgaaagttggaacctcttacgtgccgatcaacgtctcattttcgccaaaatcgttggcttcaaaaccggcttcgcggatagactcaatagtcgatcaatttatcaagcttatcgataccgtcgacctcgagggggcaggcccgctactgaaattgttatccgtcacaattcggcacacaagcataccgagccggaagcatcagcgggcaagtgtaaagcctggggtgcctaatgacgtgagctacactcacacccttaattgcgttgcgctacagctgcccttcgccttcgtgccaactgtcgggaagggacctgatcggtgccagggcctcttcgctattaagaatcgccaacgcggcgaaaggggagtgctgcaagttgcgattaagttgggtaacgccaggagtgttcccagtcacggcttactatgttgtaaaactgatgagggccagtga

SEQ ID NO: 41871 - DNA, 345 bp, Glycine max
  Peptide Sequence Number=SeqID_133556
atgaaggttttgaggtttaggaatggaggaacggcgcaaggaagaaggagctgcgtaagagattctgaaaatgtgatatttatagagcaggacgcgtggaggaggcagcttactggtaatcgattacatgaatactgtaatcgattacaggccatctgttctagtgtaatcgattacagtattcatgtatacgatcaagaaggataccatagtcagataattgttgcttcatccataaaatttgtgcacaacaactgccggcagaaatatattccgcttcaacagtggataaagcaacactgttttgtttcttactatgccatgagacaagagcggatccaatga

SEQ ID NO: 41872 - DNA, 279 bp, Glycine max
  Peptide Sequence Number=SeqID_133557
atggtcctccgagaaaaagccctcttccacaacagaaaggccctaaggggcggacatgcatttccccagaggatgcggtccttgacagcttatgccggaatgagtgtcatgtccgtgatttctcttatacagtgtgacttctaccgctcaaagaacgctggctccactccctacaatgagaaccttttatcgttcgtactgaagtctcgcggtaaccgtgtaacgcgaatgggagcatctcgtgccaatccttgtatgacacggtcatcttttggataa

SEQ ID NO: 41873 - DNA, 288 bp, Glycine max
  Peptide Sequence Number=SeqID_133558
atgcgggagaccatttggtacccgcaacttttctttgtatctctaagattcataagtcgagtgataacgcatgcagagacaacattatggtcttctgtgccctttgtcattcggggccaaggcaatcgtgtctggtggcacacagagacaaattatgatcattctgcgccttgccgcccaggctcgatcatgcccaacaacacgcagagacaaattatggtcattcttcgccttgtgtcaaccaagaggaatggattcgacagtatcaggatgatgtgtcggtactga

SEQ ID NO: 41874 - DNA, 132 bp, Glycine max
  Peptide Sequence Number=SeqID_133559
atggagcaagttagcataggataccagaattgggggatggcatttatggataaatgggtggtaggtaaggagaagggttgttattggctaagtaatgacatcgttgggttggtgggaaacttggccgtatag

SEQ ID NO: 41875 - DNA, 351 bp, Glycine max
  Peptide Sequence Number=SeqID_133560
atgggagctaagattgccaaagaagcgtggaacacattgcaggaggagtttcaaggaagtgttaagccccaaaacaaagaaaatagaggaaagaaaaattatggagaaacttctagaagaagagaaggttctaggaatttccttaagaacaaaacagataaaaatcctccatgcaatatatgcaaaagacaaggccacgcagagaaaaattgctggtttcgtaatatgccacaatgcaaccattgcaagaagttcgggcacgtagagaaaaattgtcacaacaaaaataggcatcaagctaatatcgtagaggagcatgatcaagaacaatgtacattctacgccacttaa

SEQ ID NO: 41876 - DNA, 123 bp, Glycine max
  Peptide Sequence Number=SeqID_133561
atgcctcacgtgatgcaatcctaccccgcaagggcattggatagaagactccaagaagattgggccagagatgcaagagaaggccctagggttctcatgagccttaggggctccataatgtag

SEQ ID NO: 41877 - DNA, 457 bp, Glycine max
  Peptide Sequence Number=SeqID_133562
aaagaccaaggtcaaggcatcttaggggtgacaccttctaagcccaaatatgataaggggaagacaatagaaaagcaaccccttaaggctagtatgcaagagaagactagctccatgaagtgctttaaatgtcttggaataggacacattacttctcaatgcccaaccaagaaaaccatgactatgaggggccaagacatttatagtagccaagatgaggctactactccaccttcctctagtgaaagtgaagaagcaaaagcggaagaatctagtgaagagatttgcccccaagaagaaagacaacctttaatggttaaggaggaatgtaaggagacacctgctagcattgccacacctattaggcttgagtttaatcctcaagtaaaggagttgttggatgagggtttggttcacaagagcttaaatccttgtgctttgttggtgcccaaaatag

SEQ ID NO: 41878 - DNA, 595 bp, Glycine max
  Peptide Sequence Number=SeqID_133563
atggtgaaagttggaacctcttacgtgccgatcaacgtctcattttcgccaaaagttggcccagggcttcccgggttaatttcgagctccatggcgtatcatggtctatcagctgtcctcctgttcagtactgaggaatgtgttatccgctcaatcgcaacaagcataccgagccggaagcatagcgggcaagtgctgcgcaaactgtggaacgatcggtgcgggcctttcgctattagacgccaagctggcgaaagggggatgtgctgcaaggcgaattggaaaaaagctgccaccgcggtggcggccgctctagaactagtggcccccgggctgaacaggaaattcgtgctttctgctaggctagacaacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgctgttatggccgcgtttgtctcattccacgcctgacactcagttcccgg

SEQ ID NO: 41879 - DNA, 954 bp, Glycine max
  Peptide Sequence Number=SeqID_133564
ttggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgcggggtgattttttgcaccgtccagccgcgtccgaccagggccttgacgatggcttgctgcatctgcgcccggtcactgtgaatcgaggcatgcaaggtgcggtccgggttctgaatgggtttgctggtgcaggacacggtgcccagcagggcaagggctatcagggtaataatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41880 - DNA, 526 bp, Glycine max
  Peptide Sequence Number=SeqID_133565
gcaccctatggacccagatacgtccaaccgggccctgggatttcccgcactgatcacaggactctgccagtcgttcggagtccccgtggcacctaccaaggtgattcagccgcccatcacccgggcttttattgagaagtactgcacccagagacaggctcagggtgatgctccaaaggccgcaggcgcaccaccaccacctcatcgggctggcccggctgggtcatttgatatggagcagtatttacggcatttggttcagcaacaggcggccaaccaccgggcacatgtacagacccatgattgtctgtaccagctgagcctcagcatgcagagccagggcttcgcttcttcttcatgccctactccagaccagttcagggcaggggtcgcatggcccggggattggcccgaggcccaagcaggagaggcacccccagaggttcccgacgatggagaggaggcccacgaggacgaggagatggccgattttcttgacttcttgggagggagtggagctacatga

SEQ ID NO: 41881 - DNA, 450 bp, Glycine max
  Peptide Sequence Number=SeqID_133566
atgaaaagagaaaaacatgtctcatatagtagtcatgactcttgcaagagtttaagtgaagaacttagcgactattatagagggcgccataggtcacatactaaacataactcccaaagaagagaaaaggatagaaggcctcaagagattaacattagcctcccatatttccatggaaaagataatagagaaaagttccaatgtctacccttagctttcaagggtatgccctttattggtggacttcccttgttaggcaatgaaggattcatgggtgtcctcccagtagagtattggaatgatcttaagagtgcccttcggaagaggcatattccctcctactatgaaagagagcttatggacaagctccaaaggcttagacaagggagtgtgagtgttgaagaatataggaaaaaaaatggaactactccttttaatagctggacttag

SEQ ID NO: 41882 - DNA, 369 bp, Glycine max
  Peptide Sequence Number=SeqID_133567
atgtcccttgccactctatttggaaagttgcaggaacacgagatggaattattgagattacaccaacatgaagaaaatgacaagaaaaagaaaggaattgctcttaaagcatcatcatcaattcaagaagaaagtgatcaggataatgatccagatgatgatgatgatgatctaagtctttttgtaagaagattcaacaagtttcttaaaaaaaagatggaaaaatctgaaaagaaaaatcatagtgaaaagaaactgaagaaagcatacatcacatgggatgaaaatgatatggaatcttctgaagattctgaaaatgaagagataaatctctgccttaaggctaaaagttacgaaagtgatgaagag

SEQ ID NO: 41883 - DNA, 243 bp, Glycine max
  Peptide Sequence Number=SeqID_133568
atgatggtggcctgggtgatgttagggcacggctatgagctcggaatgggtttgggcaagaataacggcggcagggccagcctagtaagtgtcagaggaaactgcaggaagtttgggttaggctataaacctatgcaggctgacataaggaaaaacatctcgaaaaggaagaacaaaggccaaggcccgcggtcgggacaacaagccaaagaggttccgtcgtgccacatcagtaggagcttc

SEQ ID NO: 41884 - DNA, 399 bp, Glycine max
  Peptide Sequence Number=SeqID_133569
atggtggctcaagtgatgttggggaatggttacgagcccggaatgggtttaggcaaagacaacagcggcagaaccagcctgataagcgccagaggaaaccatgggaagtttgggttaggctataaacccacacaagcggacataaggaaaagcgttgcaggaaggaagagcgggggtcaaggctcgcgattgggacaagaagtcgaaggaggcccgccctaccacatcagtaagagctttataagcgcggatctaagacacgaaggccaagtcgttgcaatatgcgaagatgattctctgagtgaatcggatttggtacgaccatgccctcctggtttccgactaggaaattggcgagtggaggaacgcccggacatttacgcaacaagcataatgtaa

SEQ ID NO: 41885 - DNA, 978 bp, Glycine max
  Peptide Sequence Number=SeqID_133570
tagtagtcataactcttgcaagagcctaagtgaagaacttcatgactattacgaaggaaggcataggtcacatcttagacctcactcccatagaagagaaaaggaaagaaagcctcaagaggctaacattaacctcccatacttccatgggaaggacaatgtagaggctaacttagtttgggaaataagggtagagcaacaacttaaaaagaattctacgttaaaatcttatggctctcactcttatccaaagaaataccaaggtcaaggcatcttaggggtgacaccttctaagcccaaagatgataaggggaagacaatagaaaagcaagcccctaaggctagtatgcaagagaaaactagctctataaagtgctttaaatgtcttggaaaaagacatattacttctcaatgccccgccacaaaaaccatgattatgaggggccaagacatttatagtagccaagataaggctactacttcaccttcctctagcgaaagtgaagaagcaaaaggggaagaatctagtgaagaaatctacccccaagaagaaggacaaccattagtggttaaagagaagtgtaaggaggtaagtgtctcctccaagaggttggctaagaaggaaactcattttacaataaagacaaacattaaagaaactttacctcttagacaacctccacattttctcttttgtaaaaagacacttgctagcattgccacacctcttgggcttgagtttattcctcaagtaaagaagttgttggatgagggtttggttcgcaagagcttaaatccttgtgctttgttggtgcccaaaataggttttaatacaaacctaggtgctcatatgggacaccttagtattcaaggggttcccacgaaccctaagagaataaaggtcattcctgattggcccactccaccaagtataagggaaatgtggggcttccatgacttaacaaacttttataaaag

SEQ ID NO: 41886 - DNA, 195 bp, Glycine max
  Peptide Sequence Number=SeqID_133571
atgggcgaggaagagaaaaaaccagaggaaaacaaagtggaggagaaaaaagcaaatgaagaaaaaaagaaagaagaagagaaaaaatcagaggaatcaaaagatgacaaggaatccaaggagaaatctgcgcggccagaaatcgtgctaggcacaacctttgcaatgcatggatactttaagcatgatttctag

SEQ ID NO: 41887 - DNA, 665 bp, Glycine max
  Peptide Sequence Number=SeqID_133572
atggtgaaagttggaactctcttacgtgccgatcaacgtctcattttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggcccaccaaaacttttgtttaaatgcactgtaaattggggtgcatgttcaacggataccagctcaaatgccatagctgcagggattatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 41888 - DNA, 450 bp, Glycine max
  Peptide Sequence Number=SeqID_133573
atggcatttgagctggtatccgttgaacatgcaccccaatttacagtgcatttaaacaaaagttttggtgggccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41889 - DNA, 758 bp, Glycine max
  Peptide Sequence Number=SeqID_133574
gatatggccagataggtactctggaagaattatcggacgaggaagccagagaaaattttgatgtgaacgtatttggctccttaaatgtgatcagaaatgttatgccttatttacggaatcagggttccggaaatatatttaacattgcttctgtaggaggtttatttggaagttttccgggttggggaatttattgttctactaaatttgctgttgcaggattcactgaagcccttgctgaagaagctaaagctttcggagtaaaagctacagtggtttatccgggctatttccgcacagattttcttgctaaaggttctgtaaggacacctaaaaataccattaaagcatacgaagcagcccgtgaatctgagcaattacaccttgatacaattaatggaaaccaggccaacgatccggagaaggctgctgaagtgcttattgccataagtaaggaggctcagccaccagatgggtacgtccgtcatgaattgctgccgggcaaccggtatgatgaagcacgtggctcaagagaaagtgcttatcagggaagttatatcgtttcaggtaatcatattgattataaagatgacaccggatttacagctgacggagagtttaaagaagggatattatatcatggaggacctgaacatccgctgatcagtctgattgattatagcagggtttcttaccctgtgaaggatgatgaaatgaaatggattcagaatctttattctattggtttaaagcggaat

SEQ ID NO: 41890 - DNA, 132 bp, Glycine max
  Peptide Sequence Number=SeqID_133575
atgtctccaaatcttaagggaaaaactatcgcaacacaacctctagacatggtggtttcatgctcctctcatgagtttggaagctataccaaaatatcatctatgaacatagcaccactcaaaattatcaag

SEQ ID NO: 41891 - DNA, 1359 bp, Glycine max
  Peptide Sequence Number=SeqID_133576
atgttatctgacaactttagtattgataaggaaacccttaggaaaaatttctattctccggagaatgaacctcaaaggagatggtttttccaacattacaagggtacaaacagaaaacaaatccaagacaagttctacgaatttgtcgaaagagtcaaaattaatgtccttttctttgattggtttcatgcttatgccatcagaaaggatatagactacccttggaaacaagacatcataggtaatccaacaacaaatgtcataacaaattggcaagtgaaggatggtgagttaatccagtcggaattacctcccacaacacaatatcaactaccaaatatcaaagacagtaacaacaaacctgtcatggcaattccattcaagacaaaagatgtcaacgaggaagtaacctctagagacattaaaagcctaatggaacaggcaaattataccaacaaatacttacaagctttaggagaaaccattaaaactaaggtagttcctaaacaaaaatcaattgaggaagcttcgccgagtgtccccattgaaaaacctttattcaaacctttcaaagttagtgataaggctaaacgaaaaattagggaacttagaaaaactaaatccttaattgaaggcgtagataacacaactgagataggatcagtgtcagaaaagaatataaatccaattaattccaaacactggaaaacaccctccaaattatattatcaacgtccaactgcccctgaccttctattagaagaaagaggtgaaaacaattttaagagttttagtgcaaacaacatctatgaatggaacatagatgcacaaacggagtataacatcatgaatacactccaacatatgaccatggtggctacggcttaccaaacctcccatgaatgttcagaagagaccattatagatatcttagtggcaggattttctggacaattaaaaggatggtgggataattatctcactaacgaagagaaatcaaaaatttacagcgcagttaagacggatctcaatggaaaagtcattactaatgacgatgataaagagattcctgacgctgttaacacattaatttttacaatagcccaacatttcattggagacccatccttgtggaaagataggtctgcagaattattgtcaaatcttaagtgtagaaccttagcggattttaggtggtatagagatactttcctaactagggtttacacaagagaagatagtcaacaacctttttggaaagaaaaatttctagctggtcttcccagatcattaggagacaaggttagagataaaatccgtagtcaatctgccaatggagatattccatatgaaagttaa

SEQ ID NO: 41892 - DNA, 708 bp, Glycine max
  Peptide Sequence Number=SeqID_133577
atgaccaccctgactcagatctggatgactttgctgctcagcaacatccagcccagcgatcataattcccacctccccctgccgaagtgtcagctggtgtatgccatcctgacacggatgagcattcacgtggctcagttaattgctgatgccatctatctatttgtaggtatggcgcctaccaggcaccctctggacccggataagtccaacagggccctgggatttcccgccttgatcacaggactctgccaatcgttcggagtccccgtcgcacctagcaaggtgattcggccgcccatcacccgagcttttattgagaagtattgcacacagagacaggcccagggggatgctccgcaggccacagacgcgccgccacctcatcaggctggcccagctggatcgtttgatacggagcagtatttgcggcatttggttcgccagcaggcggccaaccaccaggcgcatgtacagacccatgattgtctttaccagttgagcctcagcttgcagagccaggattttacttcttttccgtgccctactccggaccagttcagggcagaggtcgcatggcctggagattggcctgaggcccgggcaggagaggcaccagcagaggctcccgacgaggcagatgaggcccatgaggtcgaggagatgaccgatttactcgatttcttaggagggagcagggccccatga

SEQ ID NO: 41893 - DNA, 839 bp, Glycine max
  Peptide Sequence Number=SeqID_133578
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgaccttgatgcacaacgcctagagcagaagaaagacgctcttaagaagaaggctaacagcttcccagtcttcgcctcggttcacttactgaaggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41894 - DNA, 279 bp, Glycine max
  Peptide Sequence Number=SeqID_133579
atgggcaaaaattatgaaagcgacgaagaggtatctttgaagaagaaatggtacatagatagcggctgttcaaagcatatgacgggagattcatcaaagttcacacatatctctcccaagaaaagtgggcatgttacttatggtgataacacaaagtacgtcatttcagtgtgcttttgccttgatcacgtagatgcatgctttgttaggatcattcaacagtggaaactgttttggtcaagttcagtccaacaagaggaatttgaggatgatgcttga

SEQ ID NO: 41895 - DNA, 758 bp, Glycine max
  Peptide Sequence Number=SeqID_133580
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagctcataggcagaagggccttgcctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 41896 - DNA, 447 bp, Glycine max
  Peptide Sequence Number=SeqID_133581
atgaccatgattacgccaagctcgaaattaaccctcactaaagggaacaaaagctggcattgggtaaatacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41897 - DNA, 471 bp, Glycine max
  Peptide Sequence Number=SeqID_133582
atgaccctctcttcagcacacccggtttactgctgcccgctgcgtgagcgcgagcctatactgcgtctggcgaaatcggcgctggtgaccgtctatccgctgccggatacccggatgctgatggtggtgaacatccacgcggtaaatttcagcctgggcgtggatgtgtacagtaagcagttacttcccattggcgatcaaattgcccaccacagcgggcctatcattatggccggtgatttcaatgcctggagtcgtccgcgcatgaatgcgctgtatcgctttgcgcgtgaaatgtctctgcgtgaagtccgttttagtgacgatcagcgtaaaaaagcctttggtcgacctctcgattttgtcttctatcgtggtctgagcgtgcatgatgcctctgttctggtcacgcgcgcctccgatcacaaccctctactagtcgaattcagtcccggcaaacctgataaataa

SEQ ID NO: 41898 - DNA, 420 bp, Glycine max
  Peptide Sequence Number=SeqID_133583
atgcatagcataggggttagggaccctttggaacaaccccccccccccccccctatagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgatcacactgcggccaacttacttctgacaacgatcggaggaccgatgagctaa

SEQ ID NO: 41899 - DNA, 513 bp, Glycine max
  Peptide Sequence Number=SeqID_133584
atggtgaaagttggaacctcttacgtgccgatcaacgtctcattttcgccaaaagttggcccagggcttcgggccggatcaacagggacaccaggattatttattgcgaaggtcttccctcctggcgtaatcatggttctatcagctgttccctcctgttcagctatgacggggaattggttatccgcgtcacaattcggcaaaagcaccagccggacatcagcgggcaagtgtaaagcgggcgcgtgcccttcgcattggtgcgcaactgtcgggaaagggctgatcggtgcggcctgcattaatgacgccagcgcgggggagtgctgcaaggcgattaagttgggtaacgccaggagtgtattgcttaccatgttcactgacgttgagggcgcagaaattccgatgcttcgtatgactcgcacgctcggtcgttcgactgcggcgagcgaaatggcttacgaacggggcggagatttcctggaagatgccaggaagatacttaacagggaa

SEQ ID NO: 41900 - DNA, 504 bp, Glycine max
  Peptide Sequence Number=SeqID_133585
ttcctgggccaccccctgatattggagggcgaccaactgtgcgagcacatccagagagggaggctatcatgcatctactatgcataccggagcaagatttcccccgtgcagctgcaaaaagacgaggatcgcgcccacaagacacccagtggacccgaagaagtccaacagggccctggggtttccaactctggttacgggcctctgtcagtcctaccgggtgcccgttcccccagcaagatcatgccatcgaatggcacccacaaagacacacagtggacccggagaagtccaacagggccctggggtttccagctctggttacgggcctctgtagtcctacagggtgcccgttccccccggcaaggtcacgttatcatgacatagggatcgcacccgcaagacacccagttgacccgaagaagtccaacagggtcttggagttgccaagctctaattacgggcctcggtcagttctacgaagtgcctgtcgccctcagcaag

SEQ ID NO: 41901 - DNA, 183 bp, Glycine max
  Peptide Sequence Number=SeqID_133586
atgaagactcgtgttggttcccaagttatggttctttcttgttgggggtttgaaagcaaaagtgtttcactcaatttgggagtgcttcttagtccaatagctcttaaggtggttgctcccttgcttcttgactcaaattcttcaagatatggcaccaatcctcctttccaattccctatatag

SEQ ID NO: 41902 - DNA, 426 bp, Glycine max
  Peptide Sequence Number=SeqID_133587
atggtaggcaaagatttgggaagtacgggcggcccccattattcgcaaattcaaaacaagcacgccttctcgccatatggcttgcctcccaactatacaccacccaatgtggcgtacactcccagtgagaatgtcaataactccactcccatactcattgagagccgacaaccccaaactgatcattcacatgtctctcaaaccgtgggggagacacatgaaattccccaccataatctagccgacttcgagccttgcctcggatatgccactgaagggcaagtagttggtggtatactcttgcaaaacactttggaaggccctcaatttcgcccccaaccacaacccttgcattccacagcaggtaaaatccctcctattatggaaggaatgggaaaagttggatcatctaaaggaaaggcttag

SEQ ID NO: 41903 - DNA, 261 bp, Glycine max
  Peptide Sequence Number=SeqID_133588
atggccacctcatggattcctctaaggacaatagcatcatttcttgcactgaattgttgggagttggaagccatcttctcaaccaaattcctagcctcagcaggggtcatatcaccaagagctccaccactagcggcatcaatcatactcctctccattggtcctagatgcagggaagaatttctccacgaacaccctcttaaggtcatcctagctgaaaatagacctgggagcaaggaattaatgaaacattgggcttaa

SEQ ID NO: 41904 - DNA, 93 bp, Glycine max
  Peptide Sequence Number=SeqID_133589
atgggaaccgaaacccacgattcgtttcgcgcgtgggaggcatcaaaacggcaacttgatcggaatgtgggtggcgggaaacggaagacatga

SEQ ID NO: 41905 - DNA, 204 bp, Glycine max
  Peptide Sequence Number=SeqID_133590
atggtaaagggaagaaaaccttttgttttgaatgagaaattgaaaggtattaaaggagctctaaaggaatggtctaaacaacacggtgaggattttgatgggaggattgtggaagcaaacaaggaggtcgatgatattgataagctgggagaattacaagatctggttgataagcagcataatagaagtgatggatctacatga

SEQ ID NO: 41906 - DNA, 222 bp, Glycine max
  Peptide Sequence Number=SeqID_133591
atggagaagaaatcaatagctgggttgtgcttcctcttccttgttctctttgttgctcgggtccatgcttcaccactggcagctgcgatgatcactgcaagaacaaagagcacttgctcagaggcagatgcagggacgattttcgctgttggtgcaccaaaaactgttaaatggatccattcactccaacgtgaagaagatgcatgcagcgctattttataa

SEQ ID NO: 41907 - DNA, 2338 bp, Glycine max
  Peptide Sequence Number=SeqID_133592
caagctctcattcgggtcgagtcgggtaatcggatccgatcggcgctgtgatcggatcatcgatttgacgcttgtttgggagagaggcattttcattgccaatgggaatgcccaatcccaacaacattcttcccagtcctcctcgtcacctcgcaccatgagcaaagccctgggaggaacaacagaagacgaagacgaagaagaacaacaactactagaacaagaccaagattgtttctacgactcacacgaccgtttactctctctctcttcttcatgctcctgctccaactccaactccgacaacgaaaacgacgccgaagaacaccaaaacgacaccctccccaatttcaccaacttttacgacatatggatctcccaaccctcctccgtttcagaacgccgcacgcgccttttactttctcttggactctcttccctcacgcgcccaatccctcgcgatcgcgcgtccccgctccgtttcatatccgacaccaccaccacaaaccctaacaagccaccaaatcctaaaccccccccaccgcctccgccgccgccaccaccaccaccaccaccaccatcaccaccaatagaagagctctgcacgattcgagatctcgataacgggaaagagttcgtcgtgaacgaattggagaatctgcgcgaggttgctacggggcggcaattgacgatggaagaattcgaaatgacggtggggcattcccccatcgttcaggaactgatgcggcggcagaatgttgaagaggcgaacgttgattccaatgcgggtggttccaaagcgaagaagaaggggaccgggtggttgaagagtatcaagagtgtagcgagttcggtggcggggtatagggatcgccggagtagcgacgagagggacacgtcgtcggagaagggcgggaggcggtcgagctccgccaccgacgacagccaggagggcagtggtggcgcgtttcacgggtcggagagggtgagagtgaagcaatatgggaagagttgtaaggaggtgactgctttgtataagagtcaggagattcgggggcatagtgggagcatttggagcattaagtttagtttggatgggaagtatttggcgagtgccggggaggattgtgtgattcatgtgtggcaggtggtggagggggagaggaagggggagttgttgttgttggatagggagaagggtgaagatgggaatgtgaatatgtttttggtggtgaatgggtcgccggagccaatggcgggggcggcggggttgctgtcgccgctgggggatggggagaggaaaaggaaggggaggtcgagtgtgagtaggaagtccttgagcttggaccagtttgtggtgccacagaccgtgtttgcgcttactgacaaaccagtttgctccttcctgggacatctccatgatgtgcttgacctctcatggtctaaaactcagtttaatcctgttgatgatagatacttcattagtggatctctggatgctaaggttcgcatatggagcattcctgatcgacaagttgttgattggaccgatctacatgagatggtcactgctgcttgttatacacctgatggtcagggtgcactggttggttcatacaaggtcctaactgaattttatgaacagtttgccccaggaagttcatcagaagtacttatcacatctgctgactcacgaattcgggtggttgatggggttgatctagttcataagtttaaaggctttcggaatgccactagcccaatttcagcatccctcacggcaaatggtaaatatgttgtcgcggctagtgaggactcccatgtatacatctggaaaaacgaagctgattgcaggcctaacagaactaaaggtgtcactgtcacacgatcatatgaacattttcactgtaaagatgtgtcagtggccattccctggcctggtgtgggtgatgcatgggacatgcatgatacgctatccggagaacaacccgagcttgataaccatgctgatgaagtcgcatcagccaaccatcctcctacccctgtagaggagaactttgttactgagggttcaagatctgcatcaggttacagcaacagtccacgccatgcaaccattgcaagtgcaacaaatacttacttttttgatagaatttctgcaacatggccagaggaaaaacttcttctggctactagaaaccaaagccctcgtgtcagcatggatttctctaacggggtaagtcaaaaaatgtcagcctggggtatggtgatcgtaactgccggcctccgaggggaaataagaactttccaaaattttggattaccacttcggatatag

SEQ ID NO: 41908 - DNA, 624 bp, Glycine max
  Peptide Sequence Number=SeqID_133593
atgggggcctaccaagtaaccaaggacgggaatgatcataatttgtgctcagagattgttaaggcttgtgattctgcttcaattgattcccgcaaagtgacatttatctgtgggcgtgctggtgtttgtgctcttggtgctgtcatagctaggcatagtgaacagattgggatacctcatgatttgccctatgagctattgtatggcagagcagttgcggatgaagttactatggctggcagacaattaggtcgcaaaggaagatgtcctctgatgtatgaatggcatgggaagaaatactggggtgctgctcatggacttgcaggaattatgcatgttttgaaggacatggaactcaagccagatgaggtggaggatgtcaagggtatgctacgatacgtgattaacaatcgtttcccttggggcaattatccctccagtgaaggaagtgaaaatgaccgtcttgtgcattgttgtcatggtgctcctggactcactcttacccttgaatttttgcaagcaactgttgatgcaggggaagtagtatggaagaggggtctgcttaagcgagtcgggatctgtcatgacattggtgggaacacctatgtctttctttctctttaa

SEQ ID NO: 41909 - DNA, 261 bp, Glycine max
  Peptide Sequence Number=SeqID_133594
atggccgacaacaactccttcattcccaacccctataagtcatccaaaccccttgcttgcatcactttcaccaatgtcaccaaacttcttcccaacaattatcctaattggaaacaacaagttgaagctctccttgatggctatgatctcctccaatatccagatggatcttttcttgcgccgtcaaaaacgatcctcaccgttccaacatcttcgacgtcgactctgtcggaaacgacccccaccattgcatcacttctg

SEQ ID NO: 41910 - DNA, 1104 bp, Glycine max
  Peptide Sequence Number=SeqID_133595
atggacatgttggagagtctacttggggttggtctgaaattcaaccatctaagggccaaacgttttggtggcggtgttagtgctcttctcaggatctctttgctcgccacgcgcctcttcttctcccctggctccatgccggtctggaccggggaaccacggccaagtacctacctttgtgctgcccataactcaaatcacccaccctgtgcccggaaaagggcacctttggtgaaagttgtgaactttcttcggtttgttgctcaaattccgaaacacccctatgaaggaggatttgaaaagtggaaactttgtgtggattttggtttggaagaggttttgaaactcccttatgaaggaggttttgttgaggttgagactttggtttggtttgaaactagggatattatattgaagggaagcaacaaggacattgttgcacaaataatatctgctagcattgccggcgatttagttcttgctacagcatattcacatgagctgccacgatatggtcttgaagtaggacttacaaattatgcagcagcttattgcactggtctcctgttggcccgaagagtcctcaaaacacttgaaatggatgaggagtatgaaggaaatgttgaggctactggagaggattattcagtggaacctgccgagagcaggaggccattccgtgcactccttgatgttggtcttgttaggactacaacaggaaatcgcgtctttggtgcccttaagggagctctggatgggggtttggatattcctcacagcgacaagaggtttgctgggtttgataaggagaagaaggagcttgatgctgagatcttggcagaagatgaaccagagaaataccagtcacacttcagcgaatacatcaaacgtgggatagaggctgatggtattgaggcactttacaagaaggttcatgctgccatccgtgctgatcctactctcaggaaatctgataagcagcccccgaaggagcacaagaggtacaacatgaagaagctgacttatgaggagaggaaggctaagttggttgcacgcgtggcagccatcaactctgctgctgataatgatgaagatgatgagtga

SEQ ID NO: 41911 - DNA, 333 bp, Glycine max
  Peptide Sequence Number=SeqID_133596
atgagttatgatggatctttgaaatcatcacaaggtatggctacttgtggaggtctcctgcgagatcatcatggcagatggaaaataggatttgcgaaaaagtggggtgcactacaacctttcttgctgagttatggggagttttacagggcttccgtattgctagagatcaaggaggctaataggtgtgcagatgctatggttagtctcgcatgtgatatggaggctgattatatgatttatgaggaaccaccagctcctttgctgcagctgattagttttgatgtaaaggggatctctagttgcacttattattatttaatactagcatga

SEQ ID NO: 41912 - DNA, 285 bp, Glycine max
  Peptide Sequence Number=SeqID_133597
atggagaggaacttgccatccaagaaggccacctctctacatggcaatgcaaggaaaatcaacattatggttaccctcccagaagttgtggagatatatgtcaatgttgtgcctgtcactaaggaggacagtagaatacacaactatcaaatccctgataatgattgtttcgcatgcttggaggtgcagttcaaattctatggacttatcagccagattttcagaatccagcaaagtcaggtgtggcaatgccagtggttggaggggaagacaaatatagaataa

SEQ ID NO: 41913 - DNA, 294 bp, Glycine max
  Peptide Sequence Number=SeqID_133598
atgtctatgattttatggtgtatttggaaaaggagaaaccagaaactttgggagtcagcagagattctattgcagatctctatatgttccgcgcttcagtattatgaagaatggagtcgtgctaggaatgcgcatcatcaacaacgaagtcatcaacctctcgcgcaggtttcaacatcattgggctgtgcatatatacgccatgaattcaagcaaagacacacactccgaattcaaaagaggcccaggcatggggtcttaaatggattcaagagctgtgctgtcatagtatga

SEQ ID NO: 41914 - DNA, 1122 bp, Glycine max
  Peptide Sequence Number=SeqID_133599
atggcggctgaggctgagcttccggagtacttaaagtgtccgatttccctggaaattatgtccgaccccgtcatcctctcttccggccacaccttcgaccgctcctccatccagcgctggctcgacgccggccatcgcacctgcccaattaccaaactgcccctcccggaacactcttctctcatccccaaccacgccctccgaagcttaatctccaactacgcccccatcaaccctctcatcaatagtagcaattcacaccctcaaaccctaatctccaccctcacctctccctcctctcctctcccctccaaactccacgcgctccaccacctcacgcgcctctcccactccgactccctcttccgccgccgcctcttcaactcccccgccctcgtccccgccctcctaaccttcctccaacacatctccgccgccgacctccgccaccgcgccctctccctgctcctccacctctccctggacgacgacgccaaggtcggcctcgtcgccgagggcctcctctcccctttaatctctctcctcctctcctccgccgccccctccgactgccgcgccctcgccgccaccctcctcaccagcctcgccgtcctccacgtcaacaaggccaccatcggagccttcccgggctccatcaatgccctcgtgacactcctccgcgacgggaagggaagggaaagaaaagaagccgccacggcgctctacgccctctgctccttccctgataaccggcgtaaagcggtggagtgcggcgccgttcccgttctgtttcggtgtgccgattctggacttgagaggagcgttgaggttattggggttttgtcaaaatccaaagaggggagggagcagatggaacggttttgcgggtgtgtgcagattcttacgcgcgttttcaggaatggaagctccaggggagttcagtatgctcttatggctctttattcactctgttgtcacagtcaagaaactgttgtcgaggctttaaaaaacggggttttggaaatatgtcaagggttggtggaggatgataatgttacggtcagaaggaattcctcgtgtttggttcagcttctccgtgggaacacccatcgcttgagttga

SEQ ID NO: 41915 - DNA, 561 bp, Glycine max
  Peptide Sequence Number=SeqID_133600
atggagaacatggacgtgattttagctactaaccgtttgtatgacggagtagaagcaaaactgtggcaggtacctgaaacactgtctgaagaagtccttgtgaagaagggagcacctccaaagagtgatgatgttcctattattaaaccccgtgagcttgccgatgccgatggctttctgttcggttttccaacaacatttggaaccatggcttctcaattcaaagcatttttagaaggcactatagggctgtggcatacacaggcactagcaggaaaacctgcagggttcttctctagcactagttctcaaggaggtggacaagaagagaccccgttgacctctgtcactcagcttgttcaccatggaatgatttttgttccggttgggtacacatttggagatggcatgtatgagatggagaaggtcaaaggtgggtccccttatggctcaggaactgttgtcggggatggctcaaggcaacctagtgacttggaattggctcaagcttttcatcagggtaaatactttgcagccattgcaaaaaagctcaagggatag

SEQ ID NO: 41916 - DNA, 303 bp, Glycine max
  Peptide Sequence Number=SeqID_133601
atggttcttgactccattctgacatctcctcgtctcaagtctccatctttcaggagacagtttaaaaaggatgaactgggtagttggtccacacttttccagaggcatcgcttcctcttatctgctcttgttctgctaactctcctctgcactgtttatctttactttgctgtcactttaggggctagtggcacctgttctggtttgactggagcgcagaaagcttcatgccatatggagcttgttaaggattctgtggccaaggggaatattctttctttatttttgcctgagtataggtga

SEQ ID NO: 41917 - DNA, 207 bp, Glycine max
  Peptide Sequence Number=SeqID_133602
atggtgggaagcagagtcgacgtaggtgcagttgttaatggtgatttgggagaagatggagtgagtgtgagagcggatagccggtcaaggatgacgttaagcttgacggtcatctgcaaagtcttggtggttctgagtgaggcaatatacaacctcttcaaggcggtccatggtggtgtggtggccgttgtgagcgagcatgattag

SEQ ID NO: 41918 - DNA, 675 bp, Glycine max
  Peptide Sequence Number=SeqID_133603
atggctgctctaccaacggcggagcttagtgacgcaaatgcaacacatgtagcaagttgtgatgtgagggtgttgcatccagtgttcaaggtttacggtggggccaccgcgttctccggccccgttgtcaccgtgaaggtgtttgaagacaacgtgttggtgagggagcttcttgagacgaaaggcgaaggaagagtattggttgttgatggaggaggaagcttgaggtgtgcattggtgggagggaatttggcactgattgcacataacatgggttgggctgggattgtggtgaatggctgcatcagagatgtggatgagatcaatgcaagtgatattggcgtcagagccttggcttctcatccactcagatccaacaaaaagcgcactggtgaaaagaatgtccctgtttatgttggtggaacatttattcgagaaggagaatggttgtatgctgataatgatggcatcctcgctctttctggggggtggggtgaaatgttgagaagtttgtcttcgaagtatacaatatttcactggattggggcagctgttaaatctgaattggcaaaagacgtgccatcacctaatgaaacaaattcatttctgaagtatctaatcgaagatgctagtcgagtcttggctttgctagcaaagattgcttggctcggatag

SEQ ID NO: 41919 - DNA, 1347 bp, Glycine max
  Peptide Sequence Number=SeqID_133604
atggcacagaagcaaaagctgcgcccttctcctctcgacgagccacccactgcttcctcttccgattccgaggaagaagagccacaacaacaacaaccatcctcccagaagaacaaagaagaggaagacgaagaagtttcctccggagaagaagaagaagaagacgaagaagaagaagaagctgcttcctccgaagaagaggaagaagacgaagatctcccaccaccaccagtttccaaaaaccctccaccccctcccgcaaaccctcagccccaacactcttcctccgaatccgaaaccgaatcaggatccgagaccgaatccgaacctgaccccactcccgtcaaggtcaagcctttagcttccaagcccatggaccaggcccaaaagcccaaggcccagccctccccggcgccacccccaaaattgacactcaagcgccccgccgagaacaacaacaacaacgcccgcgtcgccgactccaaacgcgccaagaagaaagccaccgaatcttcttctgccgccaactccgccgcggccgctgcttctgacgacgagatggaggaggacgggaagaagtccggcgataactcgaagaagtttcagagactgtggagcgaggaggacgagctcgccattgtgaagggcgtggttgagttcacttcgaaaacagggctggaccctcttaagtttcccaataccaacgcttttcacgatttcgtgaagaagtcgcttcacgtggaagtttcctgcaaccagctgaaggagaaggtccgaaggctcaagaagaagtttgagacccaggctggaaaagggaagaacggagaggcccctaagttttccaaaccgcacgatcagaaattctttgaattgtccaaaaaggtttggggacgtgaggttactgctggagctaatgggggccccgtggagaagcccaagtctaatgggagtgctgtcaagagtccgaagaagaaggaaagcggtagcaggaatgtggcttctgctaagaaaccgaagcctgaatcaaaaccggagccggttccagtgctgtccttggagtataaggattctgaaaagatgcagattaatcaaaagcctgatggtggtgatgcaagtttgtttttgcgcgaattggctcgatccaaagagggtgcgagtatttgtaagctggatgaggatgatgtgaagagggggttggagttgattggagagtcaaagagggcagagttgagggggaagtggaagaaattacatcttgctgagatggaactgtttgcgaatcgctcagaactgataggggagcagactaagttgatacttgaggcgcttcaggcatccgatcattag

SEQ ID NO: 41920 - DNA, 2100 bp, Glycine max
  Peptide Sequence Number=SeqID_133605
atggcggaaactcggtgtttggcaattatagacgaagaggaaatagaagtagacgacgatgacatctacgagaacattgaagctcccaagttcgtcgacctcaccgcacctgattgtcgccgccccgaccatgaccgccactggttctgcttccgcgttgggtgtgaccaaaagcatgagcaagagttggactctgaggcaatttacaagaattttgttcttcgggttatggcagctagaagtccaaatgtacgcctcagaaaagctttgaatagaagagaagcaagtgcaaacttgaagtgcccccttacagctcctgccaagtcaagggtgtcaaggatggacttaatttcctccttgccacacaagatgactgacaataacgtgaaagttaaacctctttctatggttgctgcaaccccgaatgctaaggtgaagcaatcaccttcggtggccaaggccttgactacaccaaggaatcatcagaagaaggtttccaaggtagaacaatttagaagtgttcagagcaagaaagccttgactgttggtgtgcctaagagcagagtggtggcgaaggctcttgtttttcactcacctaagaaggtactaaagatcaagagttctatagagttgaaaacagcaatgagaacactgtgttcagcaatgaataagcttgaacttaatggagtgaagaagaatggaaaaggaggtagcaactcattggcagtggctacctccaaaaagcaattgaggggaagagaggttaaaagccgtgtgtttgattccttgtattctaataatcgcaaggaaccagaaaccaacacaaagacaagtttgaaggagaagaaagtaaaaaaaggcacgcagaaatgcccggttgctgtgcctcatgaaaatgacactagtcatatggagatagatgagaaatctaggtgtggctctctagaaggatgccatgaatcaggaacttcaggaagtggtggtgaactgtcttttggagatgaaaaatcccataaatcaacaagaggagagagttcagttccagttttgacagaagcttctagaagtgacattacctcgctttcgagtttgaacaatgaagagaacaagactacagaaaggagtgaaaatgaagagacaaagaactcagtttctaataagggaaaagtatctgtagccaagaagagaaaggctgaagaaaattcattggcttctgatgacagagaaaatgagaggcaactcactgagaatgatgaaaaggaaaatgtttcagcccctcatgagaacatagagattagtaacaatgatgacgtgcccaaaaaaaaggctattcttgggagcaagcatgaggattctagaaaaacacaaaagaaattcacatcgacctcaactactcctcaagttctgaaattcagaaaattaaagcccacaaatcctaagccctttaagctgagaactgatgaaaggggaattttaaaagaagcaaacttggatagaaaaattccctcatctttaaaagaaaccacagttaaaggtagtgagtccaaggcaatgaggaaatatcagaatgcgaaccgatcaagtgaaacttgttccacaaaaagtgaacaagacactgataatcattatagcagctgtgatgagaaatcaaaccaaacaacacgagaaaaccaatctgggagcattaaaagtaacaactccaactgcaaggtgcaacgaaaattatctgctacatcacctcttagaaatcctcctggtcctaaacttcagaaagtcactgatctggatgacaatttgaaaagaaaatcccgaatgatgcaacgaaaaattgtaaggcctagaagtgctttgccaaggaagaaagaaagagttgtccttgcaaccaaacttagtgttattgtggaaaaggcatcagatattgtgaagccaaaggaaacaaagccacgtaaaaatgacgcagtttcttcacctacaagtaaaactacaggttccattcacaggcctttttcacggggaaagagagatttaactgttcccaaggaaccaaagtttcagagtctacatgtgccaaaggactgcaccaccgggggacacacataa

SEQ ID NO: 41921 - DNA, 903 bp, Glycine max
  Peptide Sequence Number=SeqID_133606
atggcggcaaaagacggcgtcgttgcggggttcagtatagggttagggttagggtcaggaaagtttatggaactagctcggcatagagttatggagaatggggtaggtgaggagatggagggtgaaacttcagcacgggttcccctcagggagcgccgtgtctaccctgctcatccttcatgcttggtgaggaagagagcttatatatttgatggcatggggaacttttatcataaggattgggatctagcagacctttttcaaaaagaagagaaggaatcgggtgtaggagaaggccgaggaaatgagttttcttggtaccacgttgaattaccgaaaggaaatcaaaagttgtcacaatctgcacaggacctgattggtgttttctgcccacctttgaaactccaagacattctttcacttgttagcaatggacccttttgtgctcatgtagatggggcgcttgtcttccgggttaattcgcctggtcctccctccagcgacttcacatttaggattgctgctagagttacagaacattcagtaattaccgtttccttgggacgtgttcccaggttaggcttctcacgtgtgggtgaatctctactttcggagattcctagtgttgaaagttcctatccttcaagaggtcagcagcaggaaaggacagtgatcaaggagcatgttcttgaattcttattgactatgaatcactctgaggaagctgacaaccctgtgcctagatctgtctcaaatcttgtagttcacataattgacacacatgtagatcagattcaagaccttgtgactaagcttgagatggagttggactccgtggagcttgacttggataaaggtgatttcgtgataaactccttgatcccccctcccaatccattctga

SEQ ID NO: 41922 - DNA, 330 bp, Glycine max
  Peptide Sequence Number=SeqID_133607
atgagaacaacaacaaagctacaacaaagtaaaagcttcaaatcagaggcaaatcgaagtgaccagggcactatgacagtaacgcaacaacgacaagagaaaaggaatgaaggtggcacgaccaaggatgattcaacaatctgcaagagcgaacaaaacattgatatgcgagcatggaggtggtgcgagtgcgaccagagaaaggattatgcccaacggtggcaagagaaagtcgcagtggcacgagtggtgcgagtgccaccagggagcagacgatgtatgagcacgatggctagagaatgtcgttgtggcgcaactagtgtagggtga

SEQ ID NO: 41923 - DNA, 1314 bp, Glycine max
  Peptide Sequence Number=SeqID_133608
atggtggtagtggtagtagtggttggtagcagtgggagtgctgacagggtggttgtagtaaggatggtagtggtagctgcagtggtggtggcaatagaaagagggagagaggttgcacagtgtggggatgaggaatcaagaattttaggtataaagatggagctgagtagcatcaaagatgcatttgatcgtgtagccaagaagcaaaaattatcctcttccaagtctcaagaagttgttgaccaggtggggtgtgaaattgagcaagcattggcaacaattcagtcatcacatgacccctcagctcctgttgaccagaaatctgttctcacagaacttaagtttaagcttaatgctattggaccacttcaacagttggaaggatcaaataaggaattgaacataagtcttaccaagtatcaaaaactccttgaaaaattgttaaaccctgacatatcaaaggcatacagaaatgtggactttgatactcatattgtcaatcagataattgcaaaccacttttaccatcaaggtttgtttgatcttggagatagcatcataaatgaggctggagagcctgatgcagctgcacttagatctcaatttttggaaatgcatcagattattggagctatgagggagagaaaccttcagcctgctctcacatgggtctctgctaatcgagagaaacttgttcagattggttcaaatcttgagcttaagattcacacgttgcagtttgtagaggtcctgcaaaatggaacacgagctgatgccttaaaatatgcccgaacataccttgctccttttgcttctctcaacaagggtgagttcccaaagcttatgggttgcctcttgtatgcaggaaggctagagagctccccttattctgagctgttgtccccaattcattgggagatgacaactgaagagctcacacggcagttctgcactctcctgggtcagtcctatgagaacccactgagtgtagcagttgcagcaggagttgaggggttgcctacactgttaaagcttgcaaatgtaatggcagcaaagaagcaggagtggcaggaaatgaagcagttgccggtgccggttgaattgggtaaggagtttcagttccattcgatttttgtttgccctgtgagtagggatcaaggaagtgaagaaaatcctccaatgctgctgccatgcttacatgtcctttgcaaacaatcaattatgaagctatcaaaaaacagcacccgaacattcaagtgtccatactgtccagccgaagctactgttgcaaactgcaaacagctgtatttctga

SEQ ID NO: 41924 - DNA, 537 bp, Glycine max
  Peptide Sequence Number=SeqID_133609
atgggggccaaaaatcatgtggttgtaatgcctgatgctaatgtaaatgctttagttgctgcaggttttggtgctgctggtcaaaggtgcatggctctcagcactgttgtttttgttggaggctcaaaactgtgggaaagtaaacttctggagcatgccaaagctcttaaagtaaatgttggaactaaacctgatgcagaccttggtccagtcattagcaaacaggtcctagggtatgaatctggcaattttattgacccaaccatcttatcagatgtcactgccaacatggagtgctacaaggctgatagcttggaagaggccataaacattatcaatgaaaacaagtatggaaacggtgcttctatatttaccacatctagtgtggctgcgaggaaatttcaggccgagattgaggctgggcaggtgggcatcaatgtttccagttcctttgccctttttctcatttactggcaacaaggcctcatttgctggcgatctcaatttctacggtatagtgatttctccctaagctag

SEQ ID NO: 41925 - DNA, 2070 bp, Glycine max
  Peptide Sequence Number=SeqID_133610
atggcagacgaggttccttctcctcccgcagcatctgcagctactgctcctcttggttccagcgtgatctcccttgtgaaccgccttcaggacatcttcgcccgcgtcggaagccaatccaccatcgacctcccccaagtcgccgtcgtcggcagccagagcagcggcaagtccagcgtcctcgaagccctcgtcggccgcgacttcctcccccgcggcaacgacatctgcacgcgccgccccctcgtcctccagctcgtccagaccaagcgcaagcccaacctcgacaacaacgacgagtacggcgagttcctccacctccccggccggaaattccacgatttctccgagattcgcagggaaattcaggctgaaactgatagggaagcgggtgggaacaaaggtgtatcagacaagcagatccgacttaagattttttcaccaaatgttcttgatatcacactggtagatctcccaggcattacgaaggttcctgtgggtgaccagccttctgatattgaagctcgcatcagaacaatgatcatgtcatatatcaaaactcccacctgtctcattctagctgtcacaccagctaattcagatttggctaattcagatgctcttcagatggcagggattgctgatcctgatggtaatagaacaatcggtgtaatcacaaagttggatataatggacagaggtactgatgcccggaatctgttactaggaaaagttattcctctccgacttggttatgtaggtgttgtaaatcgcagtcaggaggatattcaaatgaaccggagtataaaggatgctcttgttgctgaagagaattttttccgcaatcgtcctgtatacaatggtttagcagatagttgtggtgttcctcaactagcaaagaagttgaaccagattctggcacaacatataaaggctgtgctacctgggctgagagcacgtataagcacttcactagttgctgttgcgaaggagcatgcaagctatggagaaatcaccgagtccaaggcatgtgttaatactgggatgcgtcttggatcgttctcctccatgcttgagggaaagaatgagatgtctacatccgagctatctggtggagcacgaatccattacatttttcaatccatctttgtcagaagtttagaggaggtggatccgtgtgaagacctaactgatgatgacatccgtactgccatacagaatgctactgggcccaaatcagcattgtttgttccagaagtgccatttgaagtccttgtgcgaaggcaaatatcgcgtctattggatccaagccttcaatgtgccagaatgtgcctaaacaaaatcccttctcttcagatcagccatcgctgtatggtgactgaactgcagcgattccctttcttgcggaagcgcatggatgaagttatagggaactttctacgagaaggccttgaaccctcagagaacatgattgcgcacctcatagaaatggagatggactacataaacacttcccacccaaattttattggtggaagcaaggcattagaaatagctgcgcaacagaccaagtcctctagggttgctataccagtttctaggcaaaaggatgctctggaatctgataagggatctgcctctgagagaagtgtgaagtctagggctattctagcaagacaagctaatggagtagttactgatccgggtgtccgtgctgcatcagatgttgaaaaaattgtaccctctggaaacactggtggatcaagttggggtatctcatcgatttttggtggaggtgatagccgtatgactatgaaggagaatatagctagtaaaccacatgctgaaccagttcacagcattgagcaatcaatctctatgatccatttgagagagccacctcctatcttgaggccatcggagagcaattcagagacggaagctattgaaataactgtgacaaagttgcttttgagatcatactacggcattgtcagaaaaaatgttgaggatcttatccccaaagcaattatgcacttcttggtactttactacttcatatccttgtag

SEQ ID NO: 41926 - DNA, 270 bp, Glycine max
  Peptide Sequence Number=SeqID_133611
atggcgggaagtgtgaggcccaaggcacgtgacgagcagtacatattacgagttgcattgcaggatctatcccaaccaaagtcagagattagtccaccagatggtctgctggcagttcctcttttacgacatcagtgcttcaacatttctaatgcctgccataaagcctccattcttagtcacctcatccttgcttccttagctgcgcctccccagcaggttttacgcggtacaccttactccttcatgcaatgtgtgaagggtggttga

SEQ ID NO: 41927 - DNA, 516 bp, Glycine max
  Peptide Sequence Number=SeqID_133612
atgtcaagcatgcaacaaatacttgaaaggcgtgatcggcattcagggattcaaggattagttaatccatctattggtcaacagcttggaagtgactcccttggcatcctgcgaaaggaaatagaacataagactaatgaaatgagtcagttgaatggggaagagatccaaggattgacaataaaagaattgcagaaagtggaggaacttcttcaaagacgttggaccactatttcaaaaattaaggatgaaaaaattatacaagagatcaatcaccttaaaacaaagaagccaagtgacctaaatctggaggcttatgagacctcaacaatcctaaaatgtgtgaatgatcgggggggacgattcgcaacccttcaagtgccaacgcctgaaagacccctcaaggtgtcaaacctaaaagttggacagtccataatccctctagcgttgagcttgaaacacttgaaacacataattcagtctgcttctgtggtcaccacttcccaaaactcttaa

SEQ ID NO: 41928 - DNA, 1149 bp, Glycine max
  Peptide Sequence Number=SeqID_133613
atggagggcatagtggttggaatagtgaatgtggggattgagggagtgttgggcaatgaaggaatggttggaatgctgctgggaagtggaggcaaagtggtaggcaaagatggcagggtgggttgtggcagtgttgagctgaatgagattactatagagtgggatttggacagtttcccaggatggttctattccatgaacccaacccccaaaccaagatcatctgatcctacttatcttcaactgggtggaagtgtgcgaataaatggtgaaggtaacctatactctggccagtccgttactggtggaaatggaggaaatatcactcgaggaggagaattgcccatattgggcattgtgggagtggaaggtggtggggagaggaatgggatggagggcatagtggttggaattgagggcaatggaggaatgttgagctgtgggagtgttggaatggtagggatgctgctgggaagtggaggcaaagtggttggcaaagatggcaaaggtggcaatgttggtgaaggcaaacttggaatacccggcaaatttggtgcagtacttgtttgcataagatggcgagctgctaggctcatgctcatgcttgagaaggtcagagcaagaaggaaagctgtgatgaataatttgcttgaggccatagctcaatggaaatggctgaaggatagtgcttggtcttatatagggctagagagttgggatatatcatggtttcacttcaactttgttaatttggagaaccaaatagagagaggtgagaagggtggaagcgtgcgaatcaatgggggaggcaacctatactctggccagtccgttactggtggaaatggaggaaatatcaggcgaggaagagaattccccaaatcggggcttgaggctgaaggtggcggggaaagaaatgggatggagggcatagtggttgggattgagggcaatagagggaggttgagctgtggaactgttggaatggttgggatgctgctgggaagtggaggcaaagtggtaggcaaagatgctgctaggctcatgctcatgcttgacatggtcagagcaagaaggaagaaagctgtgatgaatgctttgcttgaggccattgcaagaatgaagaagaataagaatttccaaatatga

SEQ ID NO: 41929 - DNA, 327 bp, Glycine max
  Peptide Sequence Number=SeqID_133614
atgttttcgtggtgttgggtggttgcggcagtggtgttgggttttttgcggcattgggtggtgaggacgcaggaagcaaaaaagaaggtgcaggaagtaattatctacatgcacatgcaaaagaagaaaaaaaataaaagaggttcacgaagggcattgctacctacaccagcgactttgctggagagaagaaggcataccaccattggtgctggcagaacagggagggaggagagagacccgccattggcactggcgggacatgccaacttgggcagtctcgccattgggtcctgcggcactcctccaatgtgtgctaacttttag

SEQ ID NO: 41930 - DNA, 492 bp, Glycine max
  Peptide Sequence Number=SeqID_133615
atgcagagtctatctggtcatactagtccagttgaatccgttgcatttgactcaggagaagtgttagttcttggtggagcatcgacgggtgtgataaagctttgggatttggaagaagcaaagatggttcgcactgttgctggacacagatccaattgtactgctgttgagtttcatccctttggtgaattttttgcatctggctccatggacactaatctaaagatttgggacatcagaaaaaaaggatgtattcatacttacaagggtcatagccagggcatcagtattatcaaattcactccagatggccgttgggttgtttctggtggatttgataatgttgtgaaggtgtgggatctaacagctgggaagctcttgcatgacttcaagttccatgaaggacacattagatcaatagatttccatccgcttgagtttcttctggctacagatggatcattcactgccgacatgagtagtgagcagtag

SEQ ID NO: 41931 - DNA, 981 bp, Glycine max
  Peptide Sequence Number=SeqID_133616
atggtgttgctgtccaaagcaacaacagaacaatactcctacatcaagaactacatgccaactgcattctcctcaacaattcccatagtggacctctccaaacccgatgcaaagaccctcatagtgaaggcttgtgaggagtttggattcttcaaagtcatcaaccatggtgttcccattgaagctatatcccaattggaatccgaagccttcaagttcttctctatgccactcaatgagaaggaaaaagcagggcctcccaaaccatttgggtatggtagcaagaaaattggacacaatggggatgttggttgggttgagtaccttcttctcaacaccaatcaagaacacaacttctctttttatggcaaaaatgctgaaaaatttaggtgtctattaaacagttacatgtcttctgtgagaaaaatggcatgcgagattcttgagttgatggcagaaggattgaagattcagcaaaagaatgtgtttagcaagcttctgatggataaacagagtgactctgttttcagggtgaatcactaccctgcttgtcctgaacttgccgtgaatggtcagaacttgattgggttcggagaacatacagacccacaaatcatttctttacttaggtccaacaacacttcaggccttcagatttttcttagagatggaaactggatttcagtcccacctgatcacaaatctttcttcataaatgttggtgattctcttcaggttatgaccaatggaagatttcggagtgtgagacatagagttttggcaaatggatttaagtctaggctctcaatgatttactttggaggtccacctttgagtgaaaaaatagcgccattaccttctctcatgaaaggaaaagaaagcttatataaagaatttacgtggtttgagtacaagaattcaacctatggttcaagattggctgataataggcttggacattttgagagaattgttgcttga

SEQ ID NO: 41932 - DNA, 4776 bp, Glycine max
  Peptide Sequence Number=SeqID_133617
atggcatatgaattgcatggaattttaagtggtgctatcagcttaacaacatgggaaaaggtcatgccggcatatggaggagaaacagagtctttccttaacaatgttgtcaccccaatatacaccgttataagacaggaagttgccaatagcaaaggaggggcggctgattattctgtatggagaaactatgatgatcttaatgagtatttctggtcccctgattgtttcaaaattggttggcccatgcgtctggaccatgactttttctttgtaaagcctagaaataaaccagaaccagatgtcaagaatgctcttgttgtgtcacctggtaaaacaaaagagaagaaaaagagagaaaagagggatgaagaagaaccagaggatacaagggaggaaatccatgaacaacaatggctaggaaagacaaattttgtagagatccgttcattctggcaaatttttagatgctttgatagaatgtggagcttttttattctatcccttcaggccataataatcattgcttgtcatgacttgggatctccactgcagttattagatgctgtagtatttgaggacataattaccatcttcattacctctgcatatcttaaacttattcaagcaattttagacgttgcttttatgtggaaagcaagatataccatggaatcttctcaaaaggtgaaacttgtggtgaagctggtcttagctactatatggactattgttcttcctgtatgctatgctaattcaagaagaaaatatacttgctattccacaaagtatggaagcttggttgaggaatggtgctttacttcctatatggttgcagcagcaatatatctgacaactaatgcagttgaagttttgttattttttgtccctgctgttgctaagtatattgaggtctctaattacaagatatgcaaagttttgtcttggtggactcagcctagaatctatgttggtcgggggatgcaagaagaccagataaaaccactcatagcacctaccagacagattatgaaaattggtgtaaagaagtatgaatggcatgagctttttccaaaagtcaaaagtaatgcaggtgcaattgtggctgtatggagccctgtagtaattgtatattttatggacacacaaatttggtattctgttttctgtacaataattggtggactttatggtgttttgcatcaccttggtgagataaggacacttggaatgctgagaagtaaatttgattccttaccttcagcatttaatgtctgtcttatcccaccatcttccaaacgtggtaaaaagaaaagaaaaggtctcctcagcaatatatttcaaaagttgccggatgaaaaaaatgccactgccaaatttgttgtggtatggaatcaaattgtaaatcatcttcgtcttgaagacttaattagtaacagagagatggatttgatgatgatgcctgtgtcttcagaattgttttctgctaaggttcgttggcctgttttcctattagcaaataagttttctacagctttgaccattgctaaagattttgagggaaaggaagagattcttgtcaagaaaattacaaaagacaaatacatgttttatgccgtaagagagtgttaccagtcactgaaatacgtgcttgaaattcttgttgtgggtagcattgagaaaaggatcatatgtgatatactaagcaaaattgaaaagcatatccaagaaacaagtcttctaaagaactttaacttgaaagttctcccagctctacatgctaaagttgttgagctagctgaacttctgatggagggagataaagaccatcagcacaaagttgtgaaggccttgctagatgtgtttgaacttgtaacaaatgagatgatgtttgattccagaatattggatatgttccactttcccgaacaaaatgagtgtggctttgtctattttagaaatgatgatcaactatttgacagtgtggaaatgaatagagatttctatccatttgccaaagagaattccatccattttccattgccagaaagtggtcctctgatggaaaagatcaagcgtttccatttgttgcttacagtaaaagatacagcgatggatgtgccttcaaacttagatgcccgtaggcgcatatcattctttgctacttctctgtttacagatatgcctgatgctccaaaagtgcacaatatgatgccattctgttcaatcacagaactctgtctgatatatgacatgattggtagtgttataactccacattacatcgaggacattaatttttcgcttaaggagcttggttcagataaagaggaggactccatcatcttctacatgcaaaagatatatccagatgaatggacaaattttttggaacgtatgggttgtgataaccgtaagagtttagaagatgaacacaaaacagaagatcttagactgtgggcttcatttcggggtcagacactaagcagaacagttagagggatgatgtactacagagaagccttaaaattacaagcattccttgacatggctgaagaagaagatattcttgagggctatgagactgctgaaagaggtaaccgggcattgtttgctcgtctagaagcactagcagacatgaaatacacctatgtcatttcctgtcaatcatttgcatcacaaaaggcttcaaatgatcctcgttatcaagatatgatcgacttgatgataaggtatccatctcttcgtgttgcttatgttgaggaaaaagaggagatagtgcagggtaaacctcacaaagtatattcatctaaactggttaaagttgtcaatggttatgaacagacaatatatcaaataaaactaccaggcccaccacatcttggagaagggaagcctgaaaaccaaaacaatgcaataatattcactcgtggtgaagcactccaaacaattgatatgaaccaagataattacttggaagaagctcttaaaatgagaaaccttctccaagaatttcttcggcgccaaggaaggcgtcctcctacaatacttggtttaagggaacacattttcacaggaagtgtgtcttctctggctgggttcatgtcatatcaagagaccagctttgtaactattggtcaaagggttctggctaatcctctcagggtgcggttccactatggccatccagatgtatttgatagggtttttcatatcacgagaggaggaataagcaaagcatctaaaacaattaacttgagtgaggatgtttttgctggatttaattcaactttaagacggggatgtatttcctaccatgaatacttgcaaattggcaaaggtcgtgatgtagctctaaaccagatctcaaaatttgaagccaaggtagcaaatggaaactgtgagcaaactataagccgtgacatgtttcgccttgggcggcaatttgattttttccggatgctatcatgctatttcactacagttggattttacttcagcagcttgatttcagtgataggaatctatgtatttctctacgggcagttatacctggttcttagtggattggaaagagcacttatcattgaggctcgaatcaagaatgtacagtccttagaaacggctcttgcctcccagtcattcatacaacttggacttctgacaggcttacccatggtgatggaaataggacttgaaagaggtttcctcacagccctaaaggactttgtccttatgcaattgcaattggctgctgttttcttcactttcgccctaggaacgaaaacacattactatggccgaacgcttttgcacgggggtgcaaagtacagaccgacagggcgcaaagttgtattccatgctagcttcactgagaattacagattgtattcaagaagccactttgttaaggcatttgagctattgctgctgttgattgtttataacatgttcaggaggtcctatcaaagtagcatggcatacgtgttgataacatatgccatttggttcatgtcattgacttggttgtgtgcaccttttctttttaaccctgctgggttcagttggaccaagacagtagatgattggaaagagtggaataaatggatcagacaacagggtggtataggaattcaacaagatagaagttggcattcttggtggcacgatgagcaagctcatcttcgctggtcaggttttggctctaggttgactgaagtattgctttctcttcgttttttcatctatcagtatggtttggtctatcacctagacatctctcagcatagcaaaaattttcttgtttatgtcctttcttggattgtgattgttgcaattttcctcttggtgaaggctgttaacatgggaaggcaactactcagtgctaattatcagcttggattcagacttttcaaagcattcttgttcctggctgttcttgccatcatctttactctttctgttatatgcgagttgtcgttgacggacattttcgtttgctgtctagcattcatgccaaccgcgtggggattgataatgattgcacaagctgcaaggccaaaaatagagcacacagggttgtgggacttcacacgtgcacttgctagagaatttgattatggaatggggatagttctttttggacctattgctattttggcgtggttgccaatcattaaagccttccatgctcgttttcttttcaatgaggcattcaaaaggcacttgcaaatccaaccaattctatcaggaaaaaagaagaagcacagaacttga

SEQ ID NO: 41933 - DNA, 285 bp, Glycine max
  Peptide Sequence Number=SeqID_133618
atgaattcatgtcgtggagggtttggagggccatgtccacgcgctggaaggagtgcgcgtaggctttggttaaggtgtggaagaagtcatccgagaaacggcgtcgttatattagggtttggtggagggtgggatagggttgaggtgttgggcttgggcgagacgcaccagagttgcggtgtcggtgttttgggtggtggaaaattgggacagggagaacaacaacaagaacctcgtcggggtggtggttttcagaggaaccacgacacgagcaagggttcgtga

SEQ ID NO: 41934 - DNA, 1092 bp, Glycine max
  Peptide Sequence Number=SeqID_133619
atgccaatagctacaaaactgtatgcatccaacgtgacatccacactcaactcaaaaaccaattccaataatggcgaccttatctatgtcatcttgatcgtaatccccgtcatcaaactctttctttattctacgattcacaatcaaaacccaacaacttcaactctccaatctctatcctcaattcaacccttttggtggcaacttctatttatgctacaaaaaatgctgcgattgcacttcaccaccgcactctctcactttgcttccaaggcctcaccttttcctctcacacccgtttccgttaccgtttccagagctattgtttgcaacaaccccaccaggttcagatcgcaaatgggttctttctccacttcctcttcctcttcctccaaactcttgttccgccagctttttgagaaggaatcttccacctacacttaccttctcgctgatgcctcgcacccagaaaaacctgcacttctgattgacccagttgataggacagtagacagggacttgtcgatcattgagcaactggggttgaagcttgtgtatgccatgaacacacatgtgcatgcggatcatgtcactgggactggccttatcaagagcaaagttccttctgtaaaatctgttatttcaaaagcaagtggtgcaacggcagatctttatgtggagccaggtgataaggtccaaattggtgatctttttctagaggttcgtgcaactcctggtcataccaaaggttgtgttacctatgttactggagatgcacctgatcaacctcaacctaggatggcattcactggagataccctattaatacggggatgtggtaggacagattttcagattttaacactgcccaagagtacgttaatctatccagctcatgactacaaaggattcactgtgagcactgttggagaggagctgcaaaacaatccacgcataacaaaggatgaggaaactttcaagaacatcatgggaaatcttaacctgtcatatcctaaaatgattgacatagctgtcccagctaatatggtttgcggaatccaatccaatccaaagcaagctgaggcttcataa

SEQ ID NO: 41935 - DNA, 222 bp, Glycine max
  Peptide Sequence Number=SeqID_133620
atgatgatgtgcctgagatgtagagatgtagggaaaggggttacacacaattatagaggtggtggtgtcgcgcatacactgattgagttgggtgactatggatgtgcgatagtggtggtggcttgggtggtagcagagtgggggaagatgaagtggttggggcgtgggaaagggttggtagcggagcatttgatggcgagtgagcatcacgagccagcatag

SEQ ID NO: 41936 - DNA, 681 bp, Glycine max
  Peptide Sequence Number=SeqID_133621
atgaaccatgagagatcctattctttttccttttccatcgctccaatttttaaggttgttatggtacccattttagatttcacgtgggctaaggcttatcatttggcgagagcagtaaatgctgaatacgtggaggaaccagcaacaaatgtgaaattccagacatctttgagttttcccggttgctcaaattcattaactttgtttggaacagatcaatctatcgcccttgaattgaatgcttggaaagggcaatcaaaagaagctattcaagggaattcttccttgttcgagaccattttccaatcttccttcgaaaaatcattgcaaattattctagtcagagatgttgatggtaaaactttttgggatgccttaagtgatgccatatcaccaagaattcaacaacccacaaccacagatgaaactgctttgacaactttccgtggtgtctttctagatcgccctcttaagaaaggagctatcataattttgacatggttgaacccctccggattgcttgtttctgtctcctcaaatgggcttccatctaccatggatgctacaatcgaatctgcaaatgtggcttctgctctttttaatgtattccttggagatagtccggtttctccctccttgaaagcttcagtggctgaaagcttgtcaaaagtactgaaataa

SEQ ID NO: 41937 - DNA, 1695 bp, Glycine max
  Peptide Sequence Number=SeqID_133622
atggattcaaatgctgcaacaatgcatggtacaacaaaacagctcaagtatggagcaaaagacataataagccaaatacatgacagcattcttggtcatatcttgtctttccttccaacgatggaggcagtccaaacaagcgtgttatcaacaaggtggattgatgtttggacatccatcaccaacctaaagttgaatgatggtgtgctaatttgttctgggaagaagatgcagaaggaacaatatgagtattttgtaaacacaatgcttcttcaccttgccaatttaagcatccaaagtttctctctttgtttaacatgttttcattatgagtcatcccaggtcagtgcatggatctcttctatattggaaagaggagtccaaaggcttgaaattcaatatgctaataaaatcttctttccttcgcataccctctttagttgcaactctttagtacaattggtgcttcaaatgagatgcactcttagtgttccaatctttgcatgtctcccaaaccttcaaactcttggcctttcggggatcaagttagtgagtgatcatgaatcctccacttattcaaaagatctagttcttagcttcccaattctcaaagtgtttgaagctaaaggatgtgagtggtcaactaagcagaatctttgtatccaagtacctctacttgaaaggttttccatagcaatgtggaactccctatcaaatgaatcatgcaaatcttccatcaagattttctctccccatctaacagatttctcttataagggtgatcttgaacaggaaatcattctattaaatacattattaattcgcactgcttctgtagtgattgtcattgatgaagatagaaaggaaagcatgagaagacttgggtttcaagtacataagcttctcacacaaatctgtgaagtggaacaattgaaattactattgtacaaggttttagtgcatgctgctgatattttcacccatctaccagtttttggaaagttgacttatctgctactgaatgaggttaccggtgaagctctgttgaacctactccacaattctcccatgcttaatactcttatattacaaaatggagtatttgacttaaatgaagatatgttgacatctgcatcagtgcctcaatgctttttgtctagcctcaaagtttttcagtttaaaggatttaatgtgcatgagcatgaacttcttctggcgaaattcgtgatggcaaatgcaacagtcttggaaagaatgactttaagcacagcattttggctgcagtattcagatattgacatggagaaaacgatgagtatacattctgaagcacgaatattctgttttggccaatgtaccaatatcggatacgtatccgatatcgatacgctcggatacgccttgaatacgtatctcacacatttttctaatgagggtgaccttgaacgagaaatcacgtctattaaattcacactactgagtggaaaagctcttcagcgagatggcagtgcttgcacaatggtatattcacctgttcttgcagggcaaaggctgctgtatcacaatttcacaaagtatgaactatacaaaagggctattacttttatgataaatgaaagtaggaaacagaataaccgaagtttgaagcaagtaataaatgatcaagttgtcatgaaagtaagatatttgagctga

SEQ ID NO: 41938 - DNA, 312 bp, Glycine max
  Peptide Sequence Number=SeqID_133623
atggaaacacttagatttgaatctagatctttgatgaaacatagatctcaaacaaagatttgttgccgctctcatcacagattatggttggatcgttggcaatcgcacgggtggttatggaggacaagtggtgttgtgggcactaaggtggtgcaggcgacacgacaatgtcagggttgggcacaggtggtacatgacgatgctagtaagggttgtgtcgatgtcgttgaaggcacaagggtgcaggagtttggaggcaaaagggtcgtgcgtgcgattaaatttggaggtggaagtggtatgcaacattaa

SEQ ID NO: 41939 - DNA, 1443 bp, Glycine max
  Peptide Sequence Number=SeqID_133624
atggaagcagcgtggatcacaattctggtactgatattgatcctctctctgataggcgcatggaagttgctgaactggttatggctcacacccaagagactagaaaggcttctgagagagcaaggccttcaaggcaatccatacacgcttcttgttggggactccatggaggttatcaagatcagaaaggaagccttatccaaacctatcactctcttctctcatgacatagtgccgcgtgtctcttcctatgctcaacacactctcaacaaacatggcaaaaattcttttatctggtttggaccaataccaagggtgaccctcacagatcctgagctaatcaaagaagtactcaacaagatttatgactttggaaagcttaaattgaatccgcatgtcaaattactagttcctggtcttgcaaggctggagagagaaaagtggagcaagcacagaaagataatcaaccccgcattcaatttagacaagttgaaggctaatggatcaagtgaaatcaacgtatggcctttccttcagaatttggctagtgatgctatttctcgaacagcatttggaagtagttatgaagaaggaagaagaatatttcaacttctaaaagagcaaactgaacttactatgaaaattatactcaaagtttatatccctggatggaggtttgtacctactactactcatagaaggattaaggaaatagatagagttataaaagctttgcttatggatatgattaacaagagagagaaagcgctaaaggcggatgaagccactaaaaacaacttgttagatatacttctggagtcaaatcacaaggaaattcaagaacacaaaaataataagaatgttggattgaatcttgaggaagttattcaggaatgcaagctattttactttgcagggcaggagaccacttcagttttgcttgtttggacaatgatattattgagtaggtaccctgattggcaaacacgcgcaagggaggaagtcttaaaggttaccatgattttgtacgaggttcttaggttatacccaccggcaattggtcttgttcgaaaagttaacaaagatgtgaaacttggaaacctatcattacctgctggagtgcagatttccttgccaatagttttggttcaccatgattgtgagctttggggcgatgatgctaaagagttcaaaccggagagattttctgaaggacttctaaaggccacaaatggaaggttttcattttttgcctttggagggggtcctagaatatgcatcggacaaaacttttcctttttggaagcaaagattgctttgtcgatgattctacaacgtttcttgtttggactttctccaacctatactcatgctccaactaccgttattactcttcagccccaatatggtgctcatctcattctaagaaaggtggaaatataa

SEQ ID NO: 41940 - DNA, 1413 bp, Glycine max
  Peptide Sequence Number=SeqID_133625
atggggaggtggggcacctgggaagagctcctccttggtggcgccgttctccgctacggagcccggaattggaaagtcgtcgccgccgagctacgggcacgaacagtttgtccctacatcattacacctgaggtctgtaaagccaaatatgaagacttgcaaaagcggtactctgggaacaaggcttggtttgaggaacttaggaagactagagtagcagagctgaaaagagctctggaggtgtctgaagattctattgggtctcttgaatctaaacttgaaagccttaaggctggaaagaatgagaaaaaagatgatcgttatgttgacaaaggatcggctcgtccaaagttacatgtagcctcacagaaattggaaagagttgaatcttccaccaaagagacatcaaaagatgggctatctgctgggagtttcacacatgaaaccaggacaaactggtctcctgaatgtccggttccagcacggtctgtggaagatatggagactaagcctgaggtttcacactccactgagcaggccaaagttttgaatgtagataatcgggcacatactatatacgaaggacaaggaggaagtcttaaaaaacggagagggaagaggaagaggaaggattgtggcagaaatatgaaggaagcaagtgttggggaaagtgacttgttagattcggctgacattgtgtcatggtgtaaagaaagttcgaccagcaactgtggtgaagttgccaaatcatgtggtgtagatgatcaaaataggaacttaaaaaaggatagggtggaagacatgatggagattttggattttatatttgaaactaaaggtgctccggctttccgacgcagacttgatagtcagaagagaggaaggtacaagaaaatgatccggcaacatatggactttgacactataaggtcaagaattagcagccagacaattaagtcgagtgtagaacttttcagggacttgctcctactcactaacaatgccttagtcttctactccaagagcactcgtgaatacaaaactgttctactgctaagaggcattgtgaccaaaaaaatgaaggaaactttgaagggtactacgagcaacaaagtcaccactcaagctaccaatgttcctattaaactacctgtgcataatcctcatgtgaaaccaagaagtgtaaggccaggcaacagaaaaatagttgcaaaggcagttggtggcaacaactctgcatctggggtgtcacatggaactaagaaacctagtaaagttgaatctccatcctcagtggaatccttaactgtgaagaaaaaaggttttggtcgaccaaaaaaggttggacgtggggctgcaggtcagaggcctgcaatgccaatgaagggaaagaaaagagttaggacaaagtga

SEQ ID NO: 41941 - DNA, 330 bp, Glycine max
  Peptide Sequence Number=SeqID_133626
atgaagactttagccatggaagagaccatcaagaacctatcaggaacttcacttttggtatcatcagttcaagagttggctaaacagaatttgtctagtgttcctcaaagatacattcagcctcaaaatgaagacattgtgactatgaggatgaactattacccaccatgtcctcaaccagagaaggtttttggcctcacttcccattcagatgcagctagtgaagtagaagggcttcagataaggaaagatggcatgccctccgaatctatatccaccacttgtcccgccacaaccccttccgtactgatcgatttcactaactcccca

SEQ ID NO: 41942 - DNA, 462 bp, Glycine max
  Peptide Sequence Number=SeqID_133627
atgagggcttgccagctcatgattccgttagacgtaatccaccaaatgccggggtgggtggctcttgcatttgggacgttggtgaccaccttccatggtcaagagaattctgatgcagaagagggattacccattttcttcaccccttttgctgaagaagatgatgttgtgaaggtgaatagggaattcaaggtgacattctcagctgcctcaatatgtgtgcagggcacaaattggaatttggctgagaaggatagtcagagtggaaggaggctcattgctgcatcaggcagtgatgattaccttagaattaccaagacaccaatcaatggtttgacagtggcattgttggtggttagcgtgagaatgggaagattttgttggccttggatgttgggaaataacaggagctactgtgtgaaagtgaaagttcctggtcaaaagtataattgggtgaaatag

SEQ ID NO: 41943 - DNA, 1467 bp, Glycine max
  Peptide Sequence Number=SeqID_133628
atggaagctatctttcttaacaaactcaagtcacacatacaccacatttacaaccaaaaatatgctttgaccgctttcactggccgctatgtgtacattctccctgtttcttactcagatgtagcacttgtcacatctttgagggatggaatgaatctttttgctggtgctgcacagtcacttggtgctggggctattctggtcaacccttggaacatcacagaagttgctactgcaattgccaaggctctgaatatgccatcggcagaacgagagaagagacataagcataactatgaacatgtaaaaactcacactgctcaggaatgggcagaaacttttgtaagtgaactaaatgatactgttgtcgaggcacagataaggacaaaacaagttccaccacggctcccaacagagactgcagttgaacgttatttgcagtcaaataatcggttgcttattttgggtttcaatggaactttaactgaaccagttgagagagaaggtgatcggtttaaagaaagggaactcactgtgcatccagaactgaaactgcccttggcagaattatgcagtgacccaaagaccacagttgttgtgcttagtggaagtggtagagcagttctagatgaaaacttcaaagaatatgacatctggctggcagcagagaatgggatgtttttaaacccttcaaagggagaatggatgacaacaatgccagagcaactgaatatggaatgggttgacagtgtgaagcatgtttttgattacttcacggacagaacacctcgatcatattttgaagaaagggaagcttcacttgtatggagttacagacatgcagatgctgagtttggaagattgcaagcgagggacatgctgcagcatctctggacaggtccaatttctaatgcatctgttgacgttgttcaagggagccgatctgttgaggtgcgagctgctaatgttacaaagggagcagctattgaccgcattctaggtgagatagtccacagtaaattcatgacaacaccaattgattacgttctgtgtataggacattttctgacaaagttgcagcaggatgaagatatatacgccttttttgagccagagctaccttcaataggtgtgggtcttcaaagaagcaagggaacagaaggagtaaagtttccagttgagagggtatcgtcattgaagaacccagcaagtagaaatggagcagcaaagtcgtcatcccaaaaaaagggacaacgccctgtgtcaaataatgagaagaaaagaaacaatcatgtctgccgcgggccacgtcggctggctcccgaaaagatatcttggaatgtccttgacctgaagaaggagaattacttctcgtgtgccgttggacgaacacagaccaatgctcggtatacgcttggatcaccagatgaagttgttgcatttctcaaggaactagccaatgtctga

SEQ ID NO: 41944 - DNA, 912 bp, Glycine max
  Peptide Sequence Number=SeqID_133629
atgttgccacagccaccatcattaccacccctgttattgttgccatcactaccattgacatcatcatcattaccactatcaccaatctcaccactaccattactttttataagagaagcattaggctattttttctgtctagaagatcgggctctgctctgcagaaaatgtgatgtggcaatacacactgcaaatgcttatgtctctggtcatcagaggtttcttctcactggtgtaagagtaggccttgaagctatagaccctggtgcttccttaacttctttgaagtcagattctggggagaaagtttcagatacaaagtcttcttctgtctctagaaaggtttccacagtgccccagccatcaaattacaatgaagtgctacccattgaagttggaggagttggggagtttccaccagccaaggtgtcttttggtggtggttctacagatggaaatatctcacagtggactattgatgaatttattggcttaaacgagttcagtcagcattatgattacatggaaggatcatcaaggagttcagattcatcttttgtcagagattgcaggctgtatggtagtgccccctcactcatgcacacacacacacacacccacataccagagaaaggacaggccgatggtggtaagcttggggattctgattctcctgttttaaagtctggtgaagaggatatggaggaggaggatgactatttggaacgtgttccagattcgtcgtggacagttcctcagatcccttccccacctactgcttctgggttatgctggccaaaagaccctcaatattcatctgatagtgttctgtttgttcctgacataagcttctctctcattcaacaatctcagattagtagtatttgtttgagacgctggaggcagctttaa

SEQ ID NO: 41945 - DNA, 813 bp, Glycine max
  Peptide Sequence Number=SeqID_133630
atgaacccccgcaacaacagtcatgccaacagatccaaaacccaacagtcctttaactctttccatataaattgtggtggtgaaagggagctaagtagtgaaggtatagtatatgatccagatttagatccatcaggagcagcaacgtctaaaatcatgggttcaaattgggcatttagtaacaccggtcacttcttggatgcccaaaaacctgtatcagaaacctatatccagcaacaaaataaaaccgggctttctaaactatatcaaaccgcacgtgtatcccccatttctctgacttattatggattttgtctggaaaatggagactacacagtattgctccattttgcagagatcatgttcactgatgacaacacatatagcagcttagggaggcgtatatttgatgtttacattcagggagtgcaggtgatgaaggatttcaatattgcaaatgaagcaggaggagttggaaagaatattacaagatcatttcctgctcatgtgaggaataactctttaataatccgattttattgggctggaaaagggacaactgctatcccatatggccctcttatatcagctatatctgtcactcatgtatcaaatgacactaatttattactcttgtgcaatacatgtactgaaacagtctctacaactacaagtggcagcatgtctacaggggttatagttggaatagtagttgctgcaattgttcttgtcatcctaatcgtacttgggtggagaatttatattgggaaaagaaattcatttggaaaaggtggattctctagaataaaataa

SEQ ID NO: 41946 - DNA, 99 bp, Glycine max
  Peptide Sequence Number=SeqID_133631
atggcagacatcaagcagccctgggagatcgataacatgctcataccacatggagagcagtcaaactactccaataccagaattactagtattaagtga

SEQ ID NO: 41947 - DNA, 996 bp, Glycine max
  Peptide Sequence Number=SeqID_133632
atgacgtcggggacgaggctacccacgtcgaaggagagagaaaacaacaagaggagagagagaaggagaagagccatagcggcgaagatcttcgcgggtctgaggatgtatgggaacttcaaactccccaaacactgcgacaacaatgaagttctcaaagctctctgcaacgaagctgggtggaccgttgaacccgatggaaccacttaccgcaagggatgcaagcctttagagcgcatggacatagttggtggatcatcagcagcaagcccttgttcatcttaccatccaagtccatgtgcttcctacaatccaagccctggctcatcatccttcccaagtccatcttcatccccttatactcaaattcctaatgctgatggcaactccctcattccatggctcaaaaacctctccactgcttcatcttcagcatcttctcccaagcttccccacctctacctccacagtggctccatcagtgctcctgtcacacctcctctgagctctccaacctccagaacgccacgaatcaatgtcgagtgggacgagcagtctgcgcggccggggtggaccagacagcagcactactcattccttccatcttctagtcctcccagccccggtcgccaggttgttgaccctgaatggtttgctgggatcaaacttccccatgttagtccaacctcaccaacattcagcttggtctcctcaaacccttttgccttcaaggaagatggcttgcccggaagcggttcgcgaatgtggactcctgctcagagtggaacatgctctcctgctattccacctggctctgatcaaaatgctgacattcctatgtctgaagctgtttcagatgaatttgcatttggaagcaacacgttggggcttgtcaagccttgggaaggagaaaggatccatgaggaatttggatcagatgatcttgaactcacacttggtaactcaaagaccaggtactccaccattattacatga

SEQ ID NO: 41948 - DNA, 859 bp, Glycine max
  Peptide Sequence Number=SeqID_133633
gtttctcactgcgccctccatgggtatcttcagtaccctcttctctcgccgcaccctctccctttccctcctcaaaatcccttccagacccacctcctcccagcccgcccctaccccaaccccaaccccaacccttgccgggcccaccaaaaagcccctccacgtcctcttcacccaagccctcggcctctcccaaaaacccaccccctccgacgaagaagaagaagaagaagaagaaactgcctccgaaaccctaaccgaactcaagaacaacctgaagcagttagagcaagagattaagaccttcaaagacagcacaaaagatgttaccctaaaatcagagaagaagaagcagaagatgagcttgttcgctgtgtttaccaataagcagagggaaccgaaaccaaaggaggagtcactcgctgctgctaagaagctctcccccgatgtggcggtgttcgtgcagtacttgttcaagaaggggtatttcaacgacgccaatttcgctaaggggaggaagaactttaatcctgattggttctccaatgtcttcgccttaggctatatcaagtttgccgccaacaaattcgccagagatcatcgagaaatcgccaatagcaactgcaacgataagaatatcaatggtggcagtggtagtaataatagtggtggagcctatggtggtaatgttgttggtggtggtggttgtggtgacagaagtaatattaatggtgattgcagtgatgtcagcgatgttggtagcaatggcgatgacattgacgttgatgagagtgacactgatgatgatagtggtagtggtaatgatacaggtgatgacgatgatgataatttgttatga

SEQ ID NO: 41949 - DNA, 801 bp, Glycine max
  Peptide Sequence Number=SeqID_133634
atggagaatcagccttcaaatggaaaaagggcaatggaagaagagctgatcaaagggtgtgagacagcaaaccagttacttgaagtacttgttcataaatccaacactactcatgaagatgtagaactagaagggtcagtgcaacctttggttgaagatcttgtgcgcaaggtgttgtgttcattcacaaatacccttttgctattgaacactaataatattaatgatgtctccaaatacactatcaaagatgccccttcgtccgtgaaatgtccagagactcagggtacggatgaggcttgcaagagtttcttccacgctgaaaaacgaagagggtgctacaagagaaaatcaagtgcaccaacatgggagacgaacagctcaattctgctggaagatggctatgcatggagaaaatatggacaaaagataacactgaatgcaaaatacctcagatgcactcacaagtatgatcagggttgtccagcaaccaaacaggttcagagaactcaagaggaccctccattgtaccggacaacatattatggacatcacaattgcaaaagctctttaagtcctgagataatgatggaaccagctttttcttctggctcttctatgatccttagcttcactagcaccctcacaagcaaagaaggatacccattttcatcatcactttcttcatccacaaaactggagcctatggaagtgattcaggatgaccatatcgttcagaaccaattatcctcatcagattacctcctgttatctgactatggacttgatttcaattattag

SEQ ID NO: 41950 - DNA, 231 bp, Glycine max
  Peptide Sequence Number=SeqID_133635
atgctgatttgggatgctcttcgagccgctgccgaggctgatctaactttagcacaagcaattgtggatagtgccggggtcattgtccagagttctgatttgacagtatgctatgatgaaagaggagcaaagtatgagctacccaaaattgaaatgcaaggttacaaaaaactgccaaggtggactcttataatcaggctagttaagcaagtgaaagaccattccttttaa

SEQ ID NO: 41951 - DNA, 1890 bp, Glycine max
  Peptide Sequence Number=SeqID_133636
atggcttccaaaagtgatgccgagatcccaagtcccataaagaggaacaatgttgaagaacttgttgaaggaaatggtggacatggaggcgcagttggcatgggaagcagaggcggcatggacggcggaggtggcataggtagtggagtcagcatgggtgacgaagtcggcatgggcggcggcggcgacattggcaacgaagtcagcatgagccgcgaagttgacatgagcatagttgatatgatagactatgagtctcctgttgtaaagcatctgaacacaagggatgggttgtctctgtgtggttcagactttgtaagggattttacaaagatagtgaaaatctcaagtgggttgcttgagtacttgacggctcaatcgctgaagaaggttatcgatggtggtggccaaggtgtcgacgacaacgacgagcgggaaaaagttaaaggtggtttggcgggtgctgtggattgcggtggtttgggctggaatgaaaaccatggaaggcaaccattggagctctatttggcaagtggtgtgagttgcgatgggaatgttcttcaatttgaaaatggttacgtggtggagactgttgtggaaggaaacgagattggggttgtcccttacaggatccgcgtctctgaggaggatggtgaactctttgctgttgatgcaattaacagcaacattgttcggataactccaccgctgtcccaatgtatggttgctcgtcctcttgagggatacactggccatgtggatggaaaaccaagtgatgctcgtttcaatcatcccaaaggcataactgtggatgataaggggaatgtttatgttgctgatactcagaatctggccatcagaaagattggagatgctggtgtgacaaccattgctggaggaaagtcaaatgttgcaggctacagggatgggcctagtgaggatgctaaattctcaaatgatttcgatgtggtatatgttcggcccacctgttccttgttggtcattgatagaggaaatgctgctcttcgacaaatctctcttgaccaggaggactgtgattatcagtctaattcaatttccagtacagatatacttacagttgttggtgctgttatagtaggatatgctacatgtatgcttcagcagggatttggatcctcttttttctcaaaaacgcagcaaccatcacaaaaacagttcaaagggttagcaagcaatgagaaacacatgccaatcctggagagcagtaaagaggagccgggatggccgtctttcggacagctcattgttgatctttctaagctttcccttgaagcattagctagcacattcattcaattcataccctcacatttcagacctagcaactccaagagaggcctaacaccactgaaagatcgtcttgtgatgcctgaagatgatgtgccgcctccattggtcaacaggcaaaatgctcaaggacatactcctcttaccgaaaataggatggcatcacaggtccatactcctcttaccgaaaatcggatggcgtcacaggtccatactccaaccatagctgagaaatattcagaaatgaagcccccaaagataaaatcaagcagtttcaaggacccctctatgtcaagcaagcaccggtcgtcaagacgacctgagtatgctgaattctatggttcttctgagattcctccgtacaccaaatctaagagccagaaagaaaggccaagacacagacaacgagaaaagagtggagaagtcgttatgggggcagttggagctgaggctaaaccagttgagacaagggctgttgatcataataatccaaagtttgaccattacagtatgagaactaagtatgcatctgaggagaccttccgattcaactctcagtaa

SEQ ID NO: 41952 - DNA, 1170 bp, Glycine max
  Peptide Sequence Number=SeqID_133637
atggaggacgagcataaaaagttggattctttgcctgaatttggattatcagagccagagaaatattccaaggaattggaggtggctgttagagcagtgcagatggcgtgttccctctgccagagagtgcaggacactttgatttccaacgctcggaccaatcatcgtcaggttcagtccaaggatgacaattctccggttacggttgcagattggagtgttcaagcaattgtcagctggatgttgtcagaatgtttagggagtcaaaatgtctcaattgttgctgaagaagatgctcaaactctctccgaggctaacgcatctgagctgttagaagctgtggttgaaactgtgaatcaatgtctagccgaagcacctcgatttggagttcaggagccaaaatcacctcttggaacttcagatgttcttgaaatcattagtcgctgcaactcaactgggggtcccactggaagattttgggtactggatcctgttgatggcacattaggatttgtacgtggagatcaatatgctgtagctctagcactcatagaggatggagaagtgaaacttggtgttcttggatgtcctaactacccaatgaggaaggaatggttaagttatcatcaccgatatcataggattatatccaagttgacacgtccagcttctgaaacttggaacaaaggttgtgtgctatatgctaaaaagggtagtgagaaggcttggatgcaaccactgctccatgtcaataagatgtttgtgtggccaaaccatgcaaaacaagtttctgtctcttccattgacaatcctgcactggccactttttgtgaaccagttgagaaggccaattcaagccattcttttacagcaggactggctcacagtgttggtctcaggaaacagccattgagggtgtacagcatggtgaaatacgcagcaatagctcgtggggatgctgaggttttcatgaagtttgcaagggccggttacaaggagaaaatatgggatcatgctgcaggcgttatcatcatacaagaagctggtgggatggtaacagatgctggaggacttcccctagacttctcaaaaggcttatatttagaaggccttgatcgtggcatagttgcttgttctggagccacactacatgcaaagatcattgatgct

SEQ ID NO: 41953 - DNA, 1725 bp, Glycine max
  Peptide Sequence Number=SeqID_133638
atggcttcgaacaaaaggcatttcgcggagaaagacgacgatcctcactcgttatccaagaaggcgaaggaatctgaatctgaatctgaatctgaatccgttgcatctccttcttctctgcaagttcttctcaatcctgcggactgtgacttggaagggtttgcttattactggtctggtgcccgagctaaggtgggaataaccagaggtagatattgttttgcctgcaaagtggtttctgcacagacggttaacatggaggacactgcccctgagcagcagcatatttgttgcctcgggatttccagaggggacaatgcgtttggtgttggtgatacaatagtttgttgtgttgacctcgaaagcaaaccgctggcttctattggtttctccaagactgggaaattgttgggtgctgcgactcaatttgatgtagctcgccttggagtggcggattcttctccagggaacttacaatggacatcagccctttttccacatgtgctgttgaaaaatgttgtggtccagatgcagttcagtgtcgaagatggacttggcagaaacatagtgatcggaccttctttttctgaacctagggattgcgaagtgataatgatggtgggattaccagcttcaggcaagactacatgggcagaaaaatgggtgaaagatcatccagagaagcgttatgtgttgcttgggacaaactcaattcttgatcagatgaagtttttgctgaaagtcaatgttacgctggtacctggactattgtggagaaacaactatggtgaaagatttgatcttttgatggatagggctactcgaattttcaatgtactgctatccagggcagctaatatacctcgcaattatataattgaccagacaaatgtctataaaagtgcgcgtaagcctaagcttgagccatttgctgattatcagaagtttgctgttgttgtattcccaaagccggaagagctcaagatacggtatgataaaagatttacagaaatggggaaagaagtgccacctgatgctgtgaataaaatgatagtgcgctttggttctggcagtggtcttcatctgccaggctcttattctcctatcactcttcccatctatgggacccctggtcaagttagtcaggttaatgcaaatgatcatgtgactgaacttaatgggagtatgaattcattttctggagtatatccaggaagtcaaattccgcatgttgccagagcgcccacttcttgtgaaccctattccaataaagaatcaagttgttttgctagagatattgccggttataatcaaacttacggtgccattctgactggtgatatccggaattacaacaactctgttgtgggtggcccatacagaccaaacattgtagagaacaatatggtttctcgggatgcttttcctgatgcctacatgagtggcatgaatgaaccctctccaatagcaagtgcaagggcaatatcttttgattttagcacttgtaaggaaccttatcctggtgcctacaggagtggcatgaatgaatcctctccagtagcaagggctagggcaatgtctttcgattatcctagagaggtttccagccatttctacagagattcactttccccatatgggacaccgactacaagacctacatatggaagttcacctattaacacgccgtattcaggaagatatgcctctcagcgtccaagataa

SEQ ID NO: 41954 - DNA, 1206 bp, Glycine max
  Peptide Sequence Number=SeqID_133639
atggaggaggagagcgagtttcttttagaaacgaagctcattatcaactcgttatgcacagaaacactttcccttctctctgttcactcttcccaacctctgttttcatgcattgtcactttctgtttcttgattctcctttatttgcctcatctattttggaagatagttttctcacccgtgctgtttctctctggggttctcttgctcctccttctccgtctcggtgcaattcagaggtctcaaaatgaagagaagaaaaacccggttgaacctgaacccattgcaaacgaagaaaacaggggaaacagagaagagaaacaggggaatcccattgaaccggtggaaaccgattctcaggatcatgtttacaggtggatcacgagccaatctcaaacaacgataaaatctcaaatgggttttcaatcaagttcgcgttttgacgagtctttcgtggagtggaacgtgaaagcgccgttggaggtcatatacgaaggtgaagaaacagagcagaatcaaaatgagaaacgtgacgagggtattttgaggcacccgtcgttgtcacggtactaccctgaaactgactccgatagctcgtcggagagtgggtttccggcgacggagaactgggactcgccggagaacatgtgcttcagatgggatgaagaagacagggaagggttaattgagatagctcttgacggttgcaagaagagggaagtggggtttcacttcgatgaggagaatttgatcgagattgatatttctccgacgaggcacagggaattttccggcgaggacgaccccttttccgatgccaactctggtgtggtggtagtgaggagtggttgggacgatgatgtcggaggtaaagatgataatcgtgacaatgatagcagtgcaaatagtgatgacagagatgatggtagtagtaacaatgccaaaagtagtgataaaatgggctatactctgcggttctggatatcaagaaagcgaactcactgttgctgccaactaagtgtgatgagatgcatggggatagtcaacatgaaggaatccctagctattagatggaaaccaccatcaaggttaaccttgatgcctcggcgaagaagaatattggcaagggtcagggtgtcatctatcgtgattcagagggccacaagtgctagtagcagcaaaatcaaagaaggtagtgggtgttag

SEQ ID NO: 41955 - DNA, 1431 bp, Glycine max
  Peptide Sequence Number=SeqID_133640
atggccaagagagctagaagcgactcactggcattgtcatcagtgtcatcagtgtcactgcttcctcgcattttcgaagaacttcctcttgaaattttgttgcacgttttctctttcttgcccattaaagtggcagcgcagaattgcacccagggatccaagttccggaattgcaagcaattcaatcgcaaattcatattcggcagagagttagcgatgcgacgcaaccgcgaatccgtcgctaaattagtggatcacctgttcgacacacacaagggtgatctgatcgattcatttcagctccacatcgacccagttgaaattgaagagttgcttgacaagtggctcagaatctgtgtcgagaagaaaatccaggatctcgaattgtattttctccgaccgggatacacactcaccgaggattttctcaaccagctcaaaaatttgagctctttgaagcttgtccactgcgaattcgagttaccactcaagctccaaagtttgaccaatctgagaagtttgattctgtggcatgtcccgctcaggaatgaaaggcttcagactttgatagtccgatgtaggatgcttcagacaattgatttgcttcactgcgctgaactttcccgtgtggagatctatgcggccgagcatagatatttcaagatgttgagaatagctgggtgtaataatttgtcaatggttgaggttgtttccccaactcttcggtgtgtgcactattgtgggcacgtaccaagcacaataacattccaggcacctcaattgagtgaggccttgttcaattttgtgcctgctgggaacagaaggtacttgcgggcttctgtgctggaaaagctggtctgtgatatctctaatgtcactgttctttcagcttcagtccttattcctgaggctttgacggctaagattcatcatggagtttttggagaaatatgttataattttttgaatctccgggagcttcacctgataatgaatggaggacttttttgtaatccatacgatatcatcatgttaatgaaacggtgtcctattctggagaaattattcatcgatattgatgattacaattttgaatgtggaccgtattgggaattgcatcagaagcctaagctggacaaacttgatcactactttgatcggctcaaatatattaagctcaagggtttcaagtttctacagtctgaacttcaactggtaaagatccttctgagcaaagcaacccatttggaggctctaattcttgtcacaccaaagaatggtcgtattaaattatggagagcagatggacccaaatatagtcatctttttgactcttggaaagcatcgccggaagtcaaaatagttttatttgaacatacggctgatcgcagtcttgttcgtccctcccattcaaaagattggttattgtag

SEQ ID NO: 41956 - DNA, 426 bp, Glycine max
  Peptide Sequence Number=SeqID_133641
atggcttttggcggttcgggtaaaggatctaggaagggggggtcctgtgttggatcatcatcttcctctatgatgaggagaaacaccttggagttgaaacaaatacccttatcacaacatgtcgccaactcgtcaggggacaactgtttgaaagggacaaacgacgatttggcctgtggtgatacgaagggagatgacagacttgaacatggtatggtggtcttgaaacttctcctcgggcaatcgagccaagcctacgacctgaaccaatgtcagaggctggagcacttgaacctcttgacgaatttgaagggtcgggctagagataaagcaactcaagagaaaagggggtggaagtccaatgatatgattcgcgagcgattcaaactcggaaaggtagtcatcgacagaaccatgttgggttag

SEQ ID NO: 41957 - DNA, 807 bp, Glycine max
  Peptide Sequence Number=SeqID_133642
atgagacaagttgaaaccctgagagagtcacacgtaaacatgcacgcgccatcaccccaacctctctctgttctcttcatcaaccctcactcatacattaccattagcaacggacagaagagagcaacaatgaacaaccctagttctccctctccctgcgcggccttcgcggacttctacgagcaatggttcgaggagcttcagtccctgatgcagcaactcaggggtgagggcagaaaagaggaggtgatggagaaggtgatgtggcaccaccagaactactacgtggccaagtcggcggcggcggagaaggacccactcaacgtgttcctatctccctgggccaccacgctggagcgctccctccactggatcacagggtggcgccccaccaccgcgtttcacctcatctacaccgagtcctcgctcatgtttgagtcccacatcatcgatattctccagggactccgcaccggcgacctcggcgatttgtcaccctcccagttccgccgcgtcagcgacatccaatgcgacactgtgaaggaggagaatgcaataacggaggagctatcagagtggcaggacagtgtgagcgagatgatgggcccaggtgcgaacatcaacgacaagatcggacggctggtatgcatcataaagaaagcagatgatctacggctgagaaccttgcggagtgtggtggggctactgtcgccgcagcaggctattgagttcttgattgcatcggcggagttgctagttgggatacgcggttggggattgaatcatgaccgtccacgtggcagatga

SEQ ID NO: 41958 - DNA, 2118 bp, Glycine max
  Peptide Sequence Number=SeqID_133643
atggaaggtaccagaagaagaggaggcggcagagcaatagagagaaaagttggaggagcgtggcggctttggtttgaaaggaggcgaagcaacgttgaagccattattggattgtacgaagaaggaggaatgtttccaccccagagcactgctgcttcaaacgagaaaattcacaaagttaaattgaatttcatgagagagagagagagagagagagatgaggaaaaacctgttaatggaagtagccattgggttgggggagagcaaagaaagaaagtgattcctatgtggagtttcgtttccttatctctgcggctgagcttctccggtgttcccaccatcaaaatcgtttcactttcacagtaccctagcaacacttactcgccattggggatggagccaactgggccagatagttttgtgaagaaaggtgaaaattcagctgaaaaggtctcagaactgagtttagaaaagggggaagaagtagctaaggcatctcatgaatctctggtttctgatgccaaatgggtatgtgaaagccccaaagctggcgtctcttcaacagcttcaggatggccttcctttaatgacatcaaagcacctcctctcacttattctctatctgcagaagagaaagcaactgtggcagtgctgcaattgcagcacaaagcattagaagcttgccagaagttcttagtcggggatgctggttctgatggtgacgaagatgacaaagatgatgaggatgaagacgaattggtagatgattatgattctaaagaatgtgaggagtacaagttctttgaaaaagtgtttgcagaagatggtgacttgaggagatattatgagagcaatcataaggaaggggattttcattgtttggtttgtggaggtatagggaagaaagtatggaagaggtttaagaattgtaagacactaattcatcactccactgccatactaaggacaaaaaggaagagagctcacagggcctatgcgcaggtcatctgcaaagttgttggttgggacattgatcaattgccagctattgtattaaaggatttggattcctccttgacaggttcaaggaagcttttgggttgtgagaaagaaagtgtgagtctagacggaaaggtcttggaaccaagttcagaaaatggaggagaaatagttaagagaaagttaccaagattcacaggagtggatggtaccctgtggcaaagctacaagaatgtaatttttggtgctccttcaaaagctgaggaatctcatgaatctctggtttctgagtgggaaagtgaaagccccaaggctggtttttcttctacagcttcaggatggccttcctttgatgacatcaaatcatcttctctcacttattctctatcagcagaagagaaagcaactgtggcagtgctgcaattgcagcacagagcattagaagcttgccagaagttcttagttggggatgctggttctgacagtgacgaagatgatgaggaggcggaggatgaagatgagctggtagataatgattctgaagaatctgaggagtataagttctttgaaaaagtgtttgcagaagatggtgaccttaggagatattatgagaacaatcacaaggaaggagatttttattgtttggtttgtgggggtattgggaagaaggtatggaagaggtttaaggattgtattggactaattcagcactccactgccatattaaggacaagaaggaagcgagctcacagagcctatgcacaagtcatctgcaaagttgtaggttgggatatcgatcaaatgccagctattgtgttaaaggatttggattcctcattggctggttcaaggaagcttttcgttgaacccaaaaatcctgctgcgggttgtactgatgatacaaattcaaatgatgttcttcaggaaagtgtagccaatgtgaatagcactttgttaatatggtttgttgggaggctcatgtacttgttgatgatgtggagacttgtgagttgtgatagggtttatatcttgtgtcctgtgaatttctctcctgcactagcggatagttttgtaaatccttcaattgcaagtcttgcgcacccaaaatttgatggctaa

SEQ ID NO: 41959 - DNA, 273 bp, Glycine max
  Peptide Sequence Number=SeqID_133644
atggagggtttggatcagcctaaaaggtccattgcttcctgcaccctatatattttaaacaaaattgaattcccaaaaataccctggaatgccctttttcctctcttctacctcattttttatcctgattttgtttggtcttctcgtgcacctcctaccctattcaaaggttactggtgcaatggagaagagcgcgtcgatgatgacctccagaacgcacgtacgacgacatttgcaatagtacacgcatcgacgaccaacaacagacattaa

SEQ ID NO: 41960 - DNA, 243 bp, Glycine max
  Peptide Sequence Number=SeqID_133645
atgaattggggagcttgcaaatttagaatgtctaggactttgaaacctcagtttgtaagatacggtcacttgagagcctttgagacccaacatcatgggtgtcagatccagcaatacatatcacatgagagagaggaaattctagggctttgggaaaaggaagaggtgatgaaatttcgtcctggcattgctgttcaattctttgtccctcattgtgcatcagccactggtgctaaatgctaa

SEQ ID NO: 41961 - DNA, 825 bp, Glycine max
  Peptide Sequence Number=SeqID_133646
atggcttcctctctcactttccattggttcctcttcctcatcctctggatcctggtcctctgctcccacgctcacgcgcgctttttcaccgtcgatccagtctccgacggcttcgccgccgcctcgggctccaagtggcagagcatcctccgcctcccaacggcgctgacgggcgagtcggtctgcgagcagacctacggcttcctaccgtgcaccaccaccgtcctcggaaatttgttcctcatcatcgtctatggcttcctcatgttcaaggccgccaccttcctctccggcggcagcgagctccttctcgagatcttgggccccggcattgttggtggcctcttcctccccatcctcggcgcactccccgacgccatgctcattctcggtagtaaagaagttgctcaaagtcaggtatctgttggaatgggactgctagctgggtcaacaacactgcttctgactataatatgggggacttgtgtaattgttggcaagtgtgacatcgagggttcaattgcaatagattcacgagacactaggggatttagtttaactggttctggtgttagtactgatatttggacaagttatgctgcaaggattatggttatatctgtccttccatttgtgatcgttcaattaccacaaattctcaattcaacttcaggaaggcacttggctgttttgattgctctcattgtgtctctcggtttattgattgcttattgtctttaccaggtgtttctcttttttcatcagcctgcaccattgttatttaactctgatgatacacattttttgttgttggatgtgatctga

SEQ ID NO: 41962 - DNA, 2124 bp, Glycine max
  Peptide Sequence Number=SeqID_133647
atggcgactcagatcctctctcgcatcttccccaaaaccctagcccccttcctctcccgttctctctccaccgccccctctcctccctccctctccgcgctctccttcctccgccgcatctccgttgccgccaacccctccctccaccgcgccctcctccccaactctccctccctccgcgccctctccacacgcgccactacctcctccctcaacgaccccaaccctaactggtccaaccgtcccccgaaagaaaccatcttgctcgacggctgcgatttcgaacactggctcgtcgtcatggagaagcccgagggagaccccacacgcgatgacatcatcgatagctacatcaaaacattggccaaggtcatcggaagtgaagaggaggcgagaatgaagatatattcggtctcgactaggcactactttgcgtttggggctcttgtgtctgaagagctttcttacaagattaaagaattgcctggagttcggtgggtgcttcctgattcttacttgaatgttaaggaaaaggattatggaggtgagccctttattaacgggcaagctgctccctatgatcccaagtatcacgaagagtgggttagaaacaatgctcgtgccaatgagagaaacaggcgcaatgacaggcctcgtaatgctgacaggtcaagaaactttgagaggaggagggaaaatgtggtaaacagagacatgcagggcaggcctccttcgccaaatcctggccctaatgtgggcggtcctcctccaagcaatgcagctgggtaccctccaagcaatgcagctgggtaccctcctagcaatgcaggatatgcccctccaagcaatacaggcgggtaccctcctagcaatgcaggatatgcccctccaagcaatgcaggcgggtaccctccgagcaatgcaggctatgcccctccgagcaatgcaggctatgcccctccaaatacagctggatattcttctccgaacgccgcaggaggttaccctcctaatgcaggtggtggctatggtcctggtggtggtgtgcctcagaataactacgcagggaacatgggagggccaccatcaaaccagaacatgggagggtttcaacaaaattcaggatggtcgaacaatgctcccagtagagatgtgccaagcagggatatgggaggaccacctggtgggaacccatattctggcgagaccactattccgagaacctccgcgcttgttcagctgtcggcagcggtttctggtgactgcgtcggaaacgaagaagaaagagaaggtgattgtgatttctggacccaccggttccggcaagagccgcctcgcattggaactcgcaaagcgcctcaacggcgaaatcgtcagtgccgactccgtccagtggctttattggcttgtattgtgccacaggtgtatcgggggcttgatgttggatctgcaaagccttccccaaatgaaagaaaggatgcaaggcaagctacaggatgtattcttgacaatggccgtgttcccatagttgttggaggcactggattgtatttaagatggttcatatatggaaagccagatgtacctaaagcctctccagagattgtatctgaagcatatcaagagttagctgaactgcagaggaatgatgactgggatacagctgtgcagttggtggtaaaagcaggtgatccaaaggctcaatttctagcagtgaatgattggtaccgattacgacgtagcctagagattattaagtctagtggatcacctccttctgcttttcgggtaccatatgattctttcagggaacagggcgaatatggtgttgctgatggttctgagttgtctgatatgaatacttatggtgatgcaatggaaaaaaccaactcatcagagttagactacgagtttatgtgctttttcctttctagccacagacttgacctctataaatcaattgattatcggtgtgaagatatgctgttaggaagggatgggattttgtctgaggctcaatggcttcttgatacaggtcttcatccaaactccaattctgcaacaaaagcaattggttacagacaacaagaagttctttatgccttaagaaatatttttggttga

SEQ ID NO: 41963 - DNA, 592 bp, Glycine max
  Peptide Sequence Number=SeqID_133648
atgatcagaaacgtttccaaaactccatactttatctttctccttgtattagtaacagttgaggttcaaggtcgctatctgccagagcgtgccaccgaactagtttcagatggcgttcataataaccttcaacacaacgaaacttcttacttagttctcaaaggaattgatgatgaatcctttgaggaaccctgcaagcaaatgtacggcttcttgccatgcacaaacaatatttttggccatctctttcttattttggtgtatgaatatttgttgttccatggagaatcatatttggctaaagggggtgagcaaattttcaagattcttggtcctggtatctttggtgctagtgcttttcagatccttggtgcccttccagaatccttaattctacttgtttctggacttgtcagcaatagggagatagcacaagaatatgccttcagcggggttggcttattggctggatcatccatcttgcttctcactgtagtttggggaagctgtgtcattgctggcagccaagaatttgagcatgattctcccacttctaactctgcgcatacaagtcttaaagctttattgactg

SEQ ID NO: 41964 - DNA, 2058 bp, Glycine max
  Peptide Sequence Number=SeqID_133649
atgagaggtaataccggcaaagtaggaatgaattgggactccaaaaaatcaggaacttatagtgggacatattataagctggatcaactgagttttcgtcttgttgatgcctcttggaggaatggacgttgtgtacactcgtttgacatagttattggtttgcacttttgcagatatttgatgcttagaaatataaggagagctgcccagtctgtttgtagaatcaatagcagatacctggaagtgagtaaaaatgggccagttgtctcagttggaccgaatatccaccactgccggttgtacatgcaatataagtttccaagtgaagcatgcagttcattcttgtggcatgggacaagggaaggctttcgtaaacgtggttctttcaggaacttttctgtaacctcagcaagtaatacagtcacgcaccattcccagattgcttggaaaaggctgtacagaaagtattgttccagtggtgatggtacatttcctcctaccgtaaatatgattgctcaggcagtaagcttggctttggctcgttcttatttgctagttcctggtattttggcatttacatgtggagagcttgcattagctcagcaaaattgggcagatgcagaacgttacccatcacagaatggtttgtatatgcgtgcacaagatgggtataattacatgtttacatttgcattcataatagttgaaggacttatcttattgatgagggctctctatctggcaatattattctctcctagcattgtgatggcaccatttgcagattgttttggaccaaactttaggaaactgtggctccatgtagttcatcgcacactagaaaaatcaggtccagcattcataaaatggggtcagtgggcagctacacggcctgatctctttcctcgagatctatgcactaagctttcagaacttcataccaaagctcctgagcatagtttctgctacacaaagaaaactatagaaagagcatttggccgaaaaatttctgaaatttttgacaattttgaagaacttcctgttgcatctggaagcattgctcaagttcaccgtgcttcactaaaatgtcgttatcctggtcagcaggcaaagccactattggttgcagttaaggttagacatcctggcgtgggagagtcaattagacgggattttgctattattaatttggcggcaaaaatttcaaagttcattcctgctcttaattggttacgattagatgagagtgtacaacaatttgcagttttcatgatgtctcaagttgaccttgctagggaagctgcccatttgagtcgctttatttataatttccgtagatggaaggatgtttctttccccaagcctgtctatccacttgtgcacccggctgttttggtggaaacatatgaaaagggtgaaagtgtctcatattatgttgatgatcttcaaggacatgaacgggttaaatctgctcttgcccacattggtactcatgcacttttgaaaatgcttctggtggacaacttcattcatgcagatatgcatcctggaaatatccttgttcgagtgtctcagaacaagtctcgaaaacggctcttcaaatcaaagcctcatgtagttttccttgatgtaggcatgactgccgaactctctggtagtgatagagtaaatttactggaattttttaaagctgttgcccgccgagatggccggactgctgcagaatgtgccctgaacttgtcaaatcaacagaactgtccaaatccggaggccttcattgaggaggtggaagagtcatttactttttggggcaccccagaaggtgatattgttcatcctgcagagtgcatggaacaattacttgagaaagttaggcgtcatagagttaatattgatggcaatgtttgtactgtcatggtgacaaccttagttcttgagggttggcagcgaaaacttgatcctgggtacaatgtgatgcagacattgcagacattgctacttagagctgattgggcaaagtctctttcgtacacaattgacggactcatggccccttag

SEQ ID NO: 41965 - DNA, 960 bp, Glycine max
  Peptide Sequence Number=SeqID_133650
atgagcttgaggtacatgagcagggtgatataccaaggtgggatgagaatgcttcagggcatgaaggagcaattagggtctaataagtgtgactcaaccataaagtctctgaacctgagggattcatcctctaagcagaatcgcttcttgtcatcaggcacatccttcaaacctcccaacaatgacaacaagctaaaacaggcagaagactctctcaggactgtcatgaaagcaacaccacgtagaatagaagtcaaatgcagtggtgcagaaaataagggtgagagaacgtttttgacactggaggaagctggtttggttgagatatcaggcttgagcacacatgaacgctttctatgccgtttaacgatatcgtcgttgaacttgctaagagtgatatcggagcaagaagggtgtccaattgaggagctcaatgctgccaagatatgtgattggttcctcaaagataagctcaaaagagaacagaacttaggctctgcgtttcaaacaaatgcacccaagagctgtttcatgcgacctcctgggggaattctagcacctggcgagagtataattgcaactgtgttcaagtttatagagcatccactgaataatgaaaagccacaaaaaactggagtcaaatttaaaatcacgagcttgaaggtcaaaggaccaattgattatgtccctgaaatgtttgatgagctgaaggatcaagtaacagtggagcagattttgcaggttgtttttctggatccagagcgtagctgtcctgctttggaaaaactgaagcttcagctggctgaggctgatgctgctgttgttgaggcacgtaagagagccccagaagatgcaggtcctaagattctcggcgaagggcttgtcatagatgaatggaaagagaggagggaaagatacctggccaagcagcagggtgaagtagtagtggactctatatag

SEQ ID NO: 41966 - DNA, 882 bp, Glycine max
  Peptide Sequence Number=SeqID_133651
atggcgattgatatcctgcgttcacctgtctccgccgtccgattctttaacggtgccgccactcgcagtcgttgctgtagtagcaccttccgcttcaaccaaaacgcaaagcattacaaagagcttgaagccgctgttgacgtagttcgcagggcttgccgtctctgtcttaatgtgaaatcatccttgttctcaactgatgagaaggttcttgaaaaaaatgaccagactccagtgaccgtggcagattttggagttcaagctctcataagtttggagttaaataagctgttcccttctatacctttggtggccgaggaggactctgctttcttgctatcaagaaacttggcagatactgttcttaatgaagtaactgacacacttagttccacttgtaaaccattgacacaagatgatgtactcgaagcaattgatagagggggcaaggatgcttttgtatttggatcaaagccggccacatattgggtgctcaacccaatcgatggcccacatggttttctaaaggctggcaaagccttatatgtggttggtttggctcttgtggttgaaggagagattgttgttggtgttatgggctgccctaactgggaggaagacttatctgagaaatcctctactgagattgaggagggttgggattctcttggtggatcaggaactgtatgggaccatgctgttggcattatatgcgttcatgaagctggtggaaaggtaacagactggcaaggcagcgacatagatcttgcagtgggtcatgttggccggcggattatatttccctatggcggtgtccttgttaccaacagcaatttacatgataagattttgcagattatcgatcagacttcaagagtttga

SEQ ID NO: 41967 - DNA, 1386 bp, Glycine max
  Peptide Sequence Number=SeqID_133652
atggcatgcaacattagagcgagtacgaggcttcaccaaggaatcttccaaacgttctccaacaacgttaaaacctcaaccccacggttcgtgcattcgtgtccagccacgttcatccagaaccttctcaagttccgaagagacaaacccacagaacagttgtatcgagctctcgaccagtgcgggttcgacctcaaccacgacctcgttctcgacgtgctgcgacgacaccgttccgattggcgacccgcgcacgtgttcttcaactgggcctccaagaccaccaccgggtaccagcccagttccgatgtctgcaacgagatcgttgacatccttggcaaaatgcagcgctttcaggaactgcaccaagtgctcgacgaaatgtccaagagagaggaactcctcgatgaagccgtgttcgccaccctggttcgtaggttcgtgggtgctcataaagtggatgaagcaattcagctattctacagaaggaaggagtttgggttggagttaaattcggaggcttttcgcactctcttgatgtggctgtgcagggctgatataaagatgtggaacgtgatcctgaatggttggtgtgttttggggaactcgcatgaggcaaagagggtgtggagagacatagtggcttctccatgcaagcctgatatatttacctatgccaccttcatcaaggcattgaccaagaaagggaaacttgggacggcactgaagttgttccgtggcatgtgggacaagggtggtaaaccggatgttgtgatatgcaactgcatcattgatgctctttgtttcaagaagaggattcctgaggccttggagattttctgtgatatgagtgagcgaggttgtgaaccgaatgttgctacttacaattcacttattaagtacatgtgcaagatacagcggatgaagaaggtttatgagctggtggatgagatggagaggaagaaggggagttgcttgcctaatgctgttacatattgttacttgctcaagagcttgaaggagccgggggaggtttgcagggttttggagaggatggagagaaatggatgtggcatgaatgatgatgtttataacatggtgttgaggttgtacatgaaatgggatgatggggatggagttagaaaaacatgggaagaaatggagaggaatggatggggaccagataggagatcatataccatcatgattcatgaaaactttgagaaagggagagtaaaggatgccgtgcgttatttagaggagatgatatctaagggaatggtgccagagcgaaggacggagaagctagtaagttccatgaacattcggttgaaggggaggtcagaaaaacaggaagatgttgatggggggacaactagtctttga

SEQ ID NO: 41968 - DNA, 567 bp, Glycine max
  Peptide Sequence Number=SeqID_133653
atgaaggacatcgcagttcaattggagaaagacaacctccctgacaaggcgaaggaactggaagatgcggttattgagttagtagggctatctgagctcagtgtgcaattttcatcagcggttcaagcttttgctaacgcataccagcctaaggaagagttcactaattttaatacgttgtttgaggatgagctttccaggtttaaggccaaccaatcttcagatgttcctaaaaatcctgtagtacgccaatttaaggaagctgtgtggaatgttcatcatgcggggcagccaatgccaggcgaagagcaggaggatattgtaatgaccagtatccagtccaacattttgaatattacctgtccattgagtggaaaacctgttactgagcttgcagaaccagttcgcagcaccaatttttcagaaaattcttgctggaatgataaattcaagcatgccaagccaactttctgggtggattatggggtggatgtgaatgggttggcttggttgaaggctgaagacacatgcaaatcaatgagaaagatgcctgtatctgtcttgtaa

SEQ ID NO: 41969 - DNA, 258 bp, Glycine max
  Peptide Sequence Number=SeqID_133654
atggtagaggctttatataccatcatgattcatgatcgctttgaaaaagtgaatggtgtcagagagctcaggatggagaaacttgtaaattccatgagcattgagttgaagggagagagcaccaaaactaggaaaaatctaagaggagtgaggtcttacaatgttggtccaattggaaaacagattgacaatgtttccttcaactatgtagttcagcttagcagcttgagtttcgttggaagttggaaccacatataa

SEQ ID NO: 41970 - DNA, 276 bp, Glycine max
  Peptide Sequence Number=SeqID_133655
atggctgatgtggcaggtctagttgaggcctcaggatcgagattcagttcattggagcttattggacagggatcattcggagatgtctataaagctgtgaataaaaaacttcgtaccccattgcccagaggctcttcgctatgcgaaggtatgggggagggatattgtacgcagccttacccttgcatatgcaaagagactgtttccggattcgaacccatgaccaacaagtcaccaaggcacaactttaccgctgcaccagagctcgccctctga

SEQ ID NO: 41971 - DNA, 453 bp, Glycine max
  Peptide Sequence Number=SeqID_133656
atgaaaatattaatgttgcatgaggtggcagaaggaagtagtgaagatgggggcgatgaagtgaaacaagaagacttggctatgagtaatgatgcagctagagatggtccaataaaagctgtagaagaggcagacatggtgagagatactgccaaggagtccatggatggagcttggattgcagctcaagaagcttcacacaagggtggtgattcaattgtaggagcatcagcacaaggggcagtgaaggcaacagaggtgttggagaatgtgggagaaagggctaaggagacagtggacacagctttggatgcagcaaagaagactacagagggtgtgacagagacaacaaccatggttgaggcagataacaatgttgtggacacagttgagtacagatgtactgaagatttgcggggccagcttggagatggccatgatagttataattga

SEQ ID NO: 41972 - DNA, 1515 bp, Glycine max
  Peptide Sequence Number=SeqID_133657
atggaaaacgtggagcagataaaagaggagatagagaagatggtggcaagttctagttcagaaggaacaggagtacccctattgagagcatctgataataatggaagagatcaaaacacaagatccccccaagctgagggatggtggaacaaagtgttggacatggaagaggccaagcaccaactcttgttttcactgccaatgattcttaccaacttgttctatcacttgatcattttggtttctgtcatgcttgttggtcaccttggtgagcttcagcttgctggtgctactcttgcaaattcatggttcagtgtcactggcgtggcagttatggttggtttgagtggggcactggaaacactctgcggacaaggatttggtgcaaaggaataccaaatgctgggaatttacctacaagcctcttgcatcatatctcttattttttcaatcattatatccattatttggttctatacagaacccatcctagtgttgcttcatcaatctcccgacattgcaagaacagctgcactttatatgaagtttcttatcccgggagtgtttgcttatagcttcttgcaaaacatcttgaggtttctccagacacaatctgtagtaattccattggttgtactctctgctcttccaatgctggttcatattggtgttgcatatggcttggttcagtggtcaggtctgagttttacaggtgcaccagttgctgcttctatttcactatggatatcattgctattattggccttgtatgtaatgtatgctaagaagttcaagcagacatggaaaggattttcaacgcattcatttcgttacgtatttacaaacatgagactagctctgccctctgctgcaatggtatgtttggagtattgggcttttgaagttttggttttcttagctggactaatgcccgactcacagataaccacttcgttgattgcaatatgtataaacacagaattcattgcctacatgatcacttatggtctcagtgcagctgcaagcacaagggtatccaatgaattgggagcaggcaacccggaacgagctaaacatgcgatgagtgtcacactgaagctctctctcctccttggattatgttttgttttggcacttggatttggtcacaatatctggattcagtttttcagcgacagttctacaattaaaaaggagtttgcttcagtgacacccttgcttgccatttctatattacttgatgccatccaaggtgtcttgtcaggggtgtccagaggatgtggctggcagcacttggctgcttacattaaccttgctacattttatcttattggtttgccaatatcatgtttcctaggatttaagaccaatttgcagtacaagggtttatggattggtctgatttgtgggttactttgtcaaagtgggactctcttccttttcataaggcgtgccaaatggactaaattggatctctctagggacaatgataaagaacggcctcttgttgtttaa

SEQ ID NO: 41973 - DNA, 969 bp, Glycine max
  Peptide Sequence Number=SeqID_133658
atgctgaaaagcaggagtttagatggcacagtaacacacttcacacctctattagatgtatctcatcataaagaaaacacaagacagtaccgatggtggaacagcaaaatcctggatttggaggaggccaaacatcaattacttttttcactacctatgttccttacaaacttgttctattacttaatcgtgttggtttctgtaattttcgctggccaccttggtgatcttcagcttgctggtgctactcttgcaaactcttggttttctgtcactggtttggctgtcatgcttgctggtgctactcttgcaaactcttggttttctgtcactggtttggctgtcatgtattgggcttttgagattatggttttcttagctggattattgcctgacccaacaatatcgacttcattgattgcaatatgcacaaacacagaactaattgcctatctgatcacttatggtctcagtgcagctgcaagggtctccaatgaattgggatcaggccacctggatcgagctaagcatgcaatgggtgtcagtctcaagctctctctcctccttggtttatgttttgttttggcacttgcatttggtcacaatatatggattcagatgttcagtgatagttctaaaattaaagaggagttggcttcactgacaccctttctttccatttccatattactagattctgtccaaggtgtcttatcaggggtgatcagagggtgtggttggcagcacttggctgcctatgtcaacctagcaactttttatcttattggtttgccaatatcaggccttcttggatttaagttcaatttgcaggttaagggtttatggattggcctgatttgtgggttggcttgtcaaactgggactctctcatttttggcatggcgtgccaaatggactaaactgaatgtctccttggacagagatgaaatccaaccaccatctgcttaa

SEQ ID NO: 41974 - DNA, 444 bp, Glycine max
  Peptide Sequence Number=SeqID_133659
atgaccagttctcgagagcgtttggtgaaggcggtgaagcagtttgtggaggttcgctacaaggttttcggcgaccgttatggccaaaacatcatcgacatcctcgactttccgattaaggttgtcttgtctcccttcactctcgccttcgatattgcaggctctgctcctcgcggcttcggcgtcccggaactcatctccaagctctctgccacttccgtcttcgaaatggagattataaaaatgtcattttctcccttcactataccaccctcaatggcggtgaggttgtttcagcttaaccagtgctctcgaaatcgaattcgagtactgggtatgcctgcttatactttgagggagagttttgtcgcctacagtggtcttactgtccgagctcgagcaggaatttctcatgtggaggatggaggatacatgtggtcttga

SEQ ID NO: 41975 - DNA, 654 bp, Glycine max
  Peptide Sequence Number=SeqID_133660
atgcaaatctatattgcaaactattggagtatgaagagaataaaaaagaatgacaacatcacaaaatttagctggttcggtttcttcaagttgccacgcccgtgtctgcggggtccacacgcaataatttcctccagcatccaacgcatcggaaataggcttaatgacgagaatgccctccccggtggtggcgcagcaaaacaccgcgaggaaccccacgagcgaaacgacgccgtgaacctcctggtgcgggctccaccgaacgctgaaccccaacgctacaatctgcagcggaatcgcaacaagcacaatccaagccagcacgtaaatcctcatcctcaagcctttgttgatgacaagcgacaaaaccctccaacacgagaacaagaaccacgtcgagtacgtaacgccaaacacagcaaaaagaacactactcagaaaagggtacgcgcagagcacggtctcgaagccgtagccgtcgttgagaaccaccgaggtttcagccggcactcggttctcgaaaggggcaaagaatatgagcaatgcctggagcgtcgcaaaggggaggcacgtgaggagcacggacgtgatggcccacttgtcattatttttcggtgtcttcgttttgatcgaagcattgagaagaaacaatag

SEQ ID NO: 41976 - DNA, 309 bp, Glycine max
  Peptide Sequence Number=SeqID_133661
atggcgaccatttggaagacaaacgcagcgagaaacgcagtgcgtagtttgacgcagtccttgccattcactgcccgcacaccttcgatcccctctcatttctcctccgtccgttacctccgcacggtcgcgatcccagttatattagtgcttgtttcaatgtggttaattacttgtggcaatccaattaatgtgacgaagcacacctgtatcctccctgatttctgcttcgacaataacccagctgtatatatccatataaatatcaagctggtaggcttgaggtactcttcccatattgcttgttag

SEQ ID NO: 41977 - DNA, 1383 bp, Glycine max
  Peptide Sequence Number=SeqID_133662
atgggtacccccggaaatgatgaaccaggtacccagaccccacaaaacacaaaaagttctccccttttcagatacaattcacccttcattcagatcgttttaattgggttggtctgtttctgttgcccgggaatgttcaacgccctctccggcatgggtggcggtggccaagtcaacgcaaccgcctccaacaacgccctcaccgccctctacaccaccttcgccatcttcggcatcctcggcggcggcatctacaacattctcggaccccacctcaccctcttcgcaggttgctccacctacgtcctctacgcaggctccttcctctactacaaccactaccagcaccagttcttcgccatcgtcgccggcgccatcctcggcgtcggcgcagggctcctctgggccgcgcagggcgccatcatgacctcctaccctccggagaatcggaaaggcacttacatttccatcttctggagcatcttcaacatggggggtgtcatcggtggcctaattcccttcattctcaattacaatcgcggtgactcagctgtcactgtcaacgacggaacctacataggattcatggtatttatggccgttggggctgttctgtcgttgaccattttacccgctagcaaggttgttcgcgacgatgggactcggtgtactaaaatgttgtactccaatgcggcaactgaatccgttgaaattctcaagcttttctacaactggaagatgcttctcattattcccgctgcttggtctagtaattttttttatacctaccagtttaaccatgttaataagccgcagttcaatttgaggactagagggttcaacaatgtgttctattggggggcgcagatggtgggttcggttgggattgggtatgtgatggatttcagctttaggagcaggaggaagagaggggttgtggggattggtgtggttgctcttcttgcttctgctatttggggtggtgcacttgcgaatcagattaagcatgaccccggggtgatcttggatttcaaggactccggttctcgctatgctgggccttttgttttgtatttcagttttgggttgcttgatgccgtgttccaaagcatggtctattgggttatcggtgccctggccaatgattctgagattcttagcaggtatgctgggttctataaaggcatacaaagtgcaggggcagcagtggcttggcaaattgataaccataatgtgtccgctatggctcagttgattgtgaattgggtgctcactactgtgagctatccgttgttgttgattttggttgttttggctgtgaaagaaggagacaacaggggagaagaggaacctgtcaaagaggttgctggctttgcccactga

SEQ ID NO: 41978 - DNA, 1308 bp, Glycine max
  Peptide Sequence Number=SeqID_133663
atgtcagcatttgttttagtgaaacgacgtgtgatagggagtttaggaaagcaaaacaaatcaggactcgggttgcgtcagaaagaaagttcccgctctcggttggtagcagcagcagtgaaggcgccatctcattcgctgttgacactgtcctctgattctgggtcttcacgtggtggtggatcttggaatgaggataaaactgatgatgaagggttttctccaaagtcatccagatttctgaaggttaccaagagcacgagaaagacaccagaagctgcgagtcctaaagtagaagaacaaacaccatccaaaagaaagaaattagacaagaaaaaggccaaaggaaacaaagaggaaaaggaggcagtgaatgaatcaaacattgacaagcatatagaccataaagaatctattcattcaatctggacactatcatcagattctgagtcattccacgatcatagcccaaaaagagatcatattgatcaggtggaaacctctcagcatgaaatatcagatgaaggagagtgtggggatggacttgtttttggtaatgatggaaagtttccatccaaaaagggttcaaaagagaagtcttcacaaaaacaaatacatgtagaaggtcatacaccagttaaagggaaggaaataaaggccagtgcaaagggaaaaggtagtggtgatttgaaagttgaagaggaagaaacttgtgaaaagcctgctgaaccaaatgtttcctccgcaagattgcctttgatgctttctgagaaagttcaacgtacaaaggcactcattgagtgtcaaggtgactccatagatctgagtggtgatatgggtgctgttggacggattataatttcagattcaccatctggggatcaagaaatgtgtttagacctgaaagatagagatatcttaggtggttttggcatctatcggaaagacctattgaagtcccagttagctttgggcagtcagaggcaaagtcaggttgaggccataatgaatgatttcatacagctgaagccacagtctaatctgtatgaagctgaaactatggttgaagggacactggatggtttcttctttgattcggatgaggaggctggcaagatgcagaaatcaaccaaccaaactgatcaaaatgagaatgttgaggaacaagctaatggtaaatccaaagggaagactgacaaaacatcaggtgctggaaagaaaagaggtagaagtacaggaggaaaaccacaagcgaagatagcaaagaaaaaaactccaggttccaaaaaggcaaagaccaagaaatga

SEQ ID NO: 41979 - DNA, 198 bp, Glycine max
  Peptide Sequence Number=SeqID_133664
atggtaccggaagagattgagattgagattgagatactgggggcagagagaaaagcttttgggaatcttggtggtgttttttcaaaaaccaggaaaccaaggaagacaggcgcaataagtggccctgttatttttggaggggaattgagaggtaaaaatgagccagaggctcaagaaaaagaaatagaggtttattag

SEQ ID NO: 41980 - DNA, 3045 bp, Glycine max
  Peptide Sequence Number=SeqID_133665
atggaggaggcgatagatgctactgcaactttggattatgcttcaattcagatttttcctaacctaaaaaggtatgaggcatttgtctgtaaggggaaacaatccgacaaagtagcagctggacatttggaacatttgttgcctcatttacctgcaataaatgatttacatgctgaaggatttgatacaaactttgatcttaaattaccagaaaatctgcatggtgctgaatggttttccaaagcaactgttcaaaggttccttcattttgctagttcaccagatttgatacatgccatcagtagtatcctagatgagatgtctcagttggaggattcaaaggaatttcatgtttctttgtatgggaagcctgaagttaacattgtgtcatccgatgcttcaaagaatgaattgttacgagcaatggacctaagactaacagctttgagcgacaagttagctgaaacttttagcaaggccactggtgctacatgctccccggaagatctgacttgtttagctaaattttctcaacattttggtgccactaatatagagcattctttatgcaagtttatagaacttactcaaaagagccaggatgttgcccccctgagcaaagaaacaaccttgcactcatgtgatgtgaccaaagatgatgcaaacgaggctgttaaaaacctgcaggtttccaaaccattaccttcagatacaccagttaagtatggtgtttcaccagcaaaagcggcccaagttgagagacacagttcaacagaaagtgaggaatcttctaactctagtgatgaggaccaaagatctgccgagagaagtcgttctctagtaagatctgcaacacccagaaggtcagcatccccaatgcgaagggtccaaataggaagagctggaccccgcagagctgctgcattaactatcaagagcctcaattattttcctggcagagagaggataactgtacaagatgctgctgaaaatgactttgaaggggaagtatctgaactacccaataaaaagtcagaaattgatgtaaagaggataactgtacaagatgccatcagtctttttgaaagcaaacagcgggatcaaactacagatattcagaagaggaagtcattagcagatgtttctgttagtacaaataaatctgtattgagaagatggagtgccggtatgggggaaacctctgttcaagaccagccagaatatgttcctgaagatcctgttccagtgacttctaatgatgtggtacatgctgaggctcctagaaattcagaagtaggagtggtgtctgattttatttcggaatgtcacaataataatgagatcactgatcatgatgtaaaaccagaaagacaggaaaatataggttatgttgctgtagataatccagatgaaaccaacccaacagtaaaacaggaaactaacaaaaagttagcagcatcagcagagtggaatcaacgaaagcaagaagagttcaaccaaattcttaaaaaaatggtcgaaagcaagcctgttttatttgggaagtcccagcccagcagaaaccagaatatttcatttgagcagagaggagggtcttacgataattataaggaaaaacgtgatgcaaaacttcgaggagcaaaggctggaaaacaagtagaaaaagaagcacaatttcgacaaatgcagcgactacttgataagaggaaggttgaaatgtccaaaagtgtgagtgcaagtaaaaaaagttctccaaggttgccccaaagttctcttagaaattcaactccacctgcaaattccccaaaggaaacctctaaaccttcaactatgaaaaaaacatcatctagaacatctcccatgcctgctacacgtaagtcttggtcagcaacaccttcaccaagggcagctgggacatcccccgccaaagctcgtggtggaatttcatctgctaacagcaccccaacacatcgtaagccagtgtcaacatctgttccccaaccaagcacccaaagggaaaaatctctgccccggaacagaaatgagaaagaacctcagaccaataatgccaggagcctcaaaagcatgaatgagaagcggcagccagctgtcccaaacaagagcaaggcagtcaaagcaaaagtgacgaaagcttctgaagaagcctctgttccttcaaagactagcattggtaacaagggaaccaagaaaagcagtgtggtgccattggaatcaaaaccatttctacgcaagggttctcgaatggggcatggaactgctgatcttaacaagaaaaaaggtcctcctaagatggacaaatctctgagagtaagtgcagatcttattgaagatcaagaaagtgagttggttgtcaatgcttctgacttggtcagtcagcattcagatggggacacaatgacacctattcatcagaatgctgctacagaaccagacccacagatacataaccaattgcaatgcggtgagacagaaaacttggaccaaaatcctacagatggtgaggtcttaacatacacaggagagtcttccataaatataaggaatgaagaagaatcaaccatatcaccttctgcctggttggagacagaagaggatctggaaatgcccaagccatgtgaggatgacaccttccaatctgcatctctagccaatgctgccccagtgggatcagctagtcctcgtgttcgtcattctctgtcacagatgctgcaagaagaaagtagtgaacctgacacatgtgagtggggaaatgctgagaatcctcctgccatgatataccaaaaaaatgcacccaaaggagaggatgatgctgaggaatttaaaaattctaataaaaggaatgctgataatctactgagaaaggccgcacaaaatgtgaaaagctacggacaaccgaaaaattcagtacatgaaggatatgaaagaaatttaggtagagatgatggcaagggttctcacaagatgcgagatggacgagatttaggtgctggttcaaccacaagaggtcagtctttcactccatga

SEQ ID NO: 41981 - DNA, 1065 bp, Glycine max
  Peptide Sequence Number=SeqID_133666
atggaatttctgttaggatttggatcatttccgtttcccacaaaacctgacagtgtgtttatgagagaaaatgacaaactactttgcgtggaatctgttgaccctgaattggttatggtgggcaaacatcttaaagttctgacaaagcacccaaggcagaaaattaagtcctttgctattgacttaattgagatatggaaaggcataattatcaaggaaacaagcaaaaataaaaatgggggctctgatagtaaggatgagtcggctaacagggagaaatctaaagctgggaaaatgcaaaagagtccttcggtgaagattgaaaaaggtgaaaccgtcaaggttgagaaaattgaaaggaatggcacatcaaagtcaagctttgaaaatatgaaaaaggtacaaaatgatgtcaagaatgagagaactgatcgtgctgcaagtgtcaagatggaaaagatagccgaggaaaagccaatttctggagcaaagaaaatgtcatccagttctaccgctcccccaaagctaaaaactatgattaaatccaatgatgcaacacgagacaaaataagggaaattctccatgaggctttgtccaaggtcactagagaggctgatgaagatcttgtagctgtagtcaatgattctgatcccatccgtgttgctgtgacagtggagtctgtattatttgaaaaatggggtccttcaaatggggcacaaaaggtgaagtataggtccttaatgtttaaccttaaggattcaaacaaccctgatttccggagaaaagttctgcttggtgttgttgagccagagcaactgatcaacatgagcacagcagaaatggctagtgagcaaaggaagcaggaatatcagaaaatcacagagaaagctttatttgaatgtgagcgtggaggtcaaccaaaagctacaaccgatcaatttaagtgtggccgatgtggtcaaagaaagaccacctattaccaaatgcagactcgcagtgctgatgaacctatgacaacctatgtcacttgttgtgtctgcaataaccgttggaaattctgttag

SEQ ID NO: 41982 - DNA, 426 bp, Glycine max
  Peptide Sequence Number=SeqID_133667
atggctgcaggttcttcttcaaattgggtcatggaaagtggtgatgttcctcatgttttggccgttgatgacaaccttattgatcgcaaactcgttgagaaactcctcaggaattcttcttgcaaagttacaactgcagaaaatgggccaagggcattggaattattgggcttaacaagtggtggacagaacaccatgaacggtaggttcaatcttgagagtggtgagtataggagatcatcaaacatttgtaggaaagtgtcaacatctcatagatccaaagtaaatatggttatcacagactattgcatgccagggatgacaggctacgagctacttaagaaaatcaaggaatcgtcggtaacgaaggaggttccagtagtgatcatgtcatctgagaacataccaacacgaattaacaagtaa

SEQ ID NO: 41983 - DNA, 618 bp, Glycine max
  Peptide Sequence Number=SeqID_133668
atggtgatttcactttgtctgtatatatttgggttgccgatcagcccaaagctggttgtaatagaagctgagagaaagcttgctgcacttgttctcaacccacgactgaggaatcaatatctcccaacctatgcataccgtcgtgaagaggagtcacaattttaccggtcacctaaaagaagaagagagagatttgatcagggtggttttggagattcagttgttatggaaccatcaaggagtagaggtgttcagtttccatttgctgtgatggaccgggttatcataaaggtagtgtatgagctggctcgattttacttacaagtgtttttacctttttctgaaaaggaaataattagagaaaaaatggttcagggaaataaaaggacaccacaacgctttgttgggcgcgaagctattgttacaacgcaatgcctgaatggatggaaatacggaaaacttgcttctgttgttaacaaaagacttgtctacaggtatgtggtgaagacattggacaatgcagaaagtgtaaagttgcagtatagatcccttgcaaaggttatggatgatccttcaaaacctgctgcctccagcaagatgccaccaaattggctttag

SEQ ID NO: 41984 - DNA, 162 bp, Glycine max
  Peptide Sequence Number=SeqID_133669
atggccggtttaccagcgaggctccgtctccaacccaccgacgtcaaagccgccgccttgtggggcgttaccgccgccactggcgctctctacctcattcaggatttgtgccctatgccttgtttagctcttcgcattcggcgacgttacatgctgatctga

SEQ ID NO: 41985 - DNA, 471 bp, Glycine max
  Peptide Sequence Number=SeqID_133670
atgaagcaatgcagatatgaacctggaaaagacttaattgagcggaaagagcggttgcttccgtttgaagagattgaatcacacgcaccattcaatcgaaaagggggacaaggccttctcggcatcaatggcgtcgaccaacgaggaggaagaggcgtcgggggagttgcttctccggtgaccggagcgacgggtttccagatgcggagattggggtatggaacgggaccggatcttggaaatgatgcggcggagagagatccacctcgaggtcgaagtcgttggggatgcggaaatgcatctcggattgagatcgacggtggtgagagaacgacatcgttttggtttagggggggaatgagagtgagcttccgatcatgcaatgggtttaaaccggtcaccgctccgtttccatcccctctctatgttctgttatcgctggtgttatcgtttgtccgtcagattttgtag

SEQ ID NO: 41986 - DNA, 1275 bp, Glycine max
  Peptide Sequence Number=SeqID_133671
atgcatcagcagttgaagggaagaataaatgataattttctaattaattaccgccgctacacgcccgcacctgtttcctgctccgacacttgggcgattgtgatcaccgccggcaaacaccgcggtctcactcccaacactgagaaagcttcgaaacaagcacactctccaggtagggttactcagcgcagagcaatctcctccgcctccaacatgctccacaacaagtccttcgtcaagaaaacaaaaggtggcaaagtcatgaagcaagtgcgggagcactatctgcgcgatgatatatactgcggcgcaccgttttgcacagtttgcgattcttccggtgctcgcctcagtgcttctccttccaccattctcgtcgtcgacaccaatgtcgttctcaaccagattgatttgctggagaatccggcgatcgacgatgttgtggtgttgtccattgtgttggaagaggttaagaacaagaacatgtctgtttacaaccgtataagagctatctgtagcaattccatgaggaagttctttgttttttccaatgaataccacagggatacatatattaaggaaatgagtggggaaacaaaaaatgataggaatgatagagctattcgagtggctactcagtggtatcagaatcatcttggtggtgcagtaaaggttttgctgataactaatgataaagagaacaaaagaaaggctagtgaagagggcattttggctgaaacagttgagtcatatgtgaagtctttagtccgacctgatttacttgacctgcttgtgcggcctgcatctgaagatgtggacatggaagaggttgaagatcttagaccatccaagaggaaagtcatctattctgagcataagccgatgtcagaaattacttctggtttgcatcgtggaatatatcatcaagggaaacttcgtgtaaaccgttataatccatttgaagcatatgttgggagtgagagcattggtgatgaaatagttatttatgggcgctcaatcatgaatcgagcatttgatggggatattgtggcagctgaacttctgcctcaggaccagtggcaaggagtctcgtctctatctatagcccatgaagaagacgaggatgagaatgaagatgttcatctagctccaaatagtgctgatgatgcacctagagctgtttctcagcagggttcttctgaacaactaaatgctgtacccagtcgtccttgtggtcgtattgttggcattataaagagaaactggcattcgtaa

SEQ ID NO: 41987 - DNA, 351 bp, Glycine max
  Peptide Sequence Number=SeqID_133672
atgaatgattcaagcccaacacgggcgacaagactgatttcgagagtgtggactgtagccaaacaggaagtgtttggtcttgaacttcctatgcttctcggcaatagtgtttgggaacaactgagatacaggattcgaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctcctttacgcatctgtgccg

SEQ ID NO: 41988 - DNA, 573 bp, Glycine max
  Peptide Sequence Number=SeqID_133673
atgggatttggctcctcaaaagtgagggaggaaaagttgtgctttcacattgtaagcagtttctattcccatgaggagagggtggatattgctgatgtgacaaattttgttcatcctggcactccccttgatgatgaggctgcacaaaggggtacatctgtctaccttgttgagcggcggatagacatgcttcccaaacctcttacagaggacatatgttctcttcgttctgatgtggaaaggcttgcattctctgtcatatgggaaatgacacctgaagccgacattatttctaccagatacacaaaaagtgtcataaaatcttctgcagcattgtcttatgttgaagcacaagcaaggatggatgatagtcgtttgatggatccaattactgctgatttgaggaatatgaatagtttagctaagaaaatgagattaaggcgtattgagagaggagctttgactcttgcatctgctgaagtcaaatttcagattgacacagagactcatgacccccttgatattggtataatcttcttacttaataacatttccgtactactatttctttag

SEQ ID NO: 41989 - DNA, 804 bp, Glycine max
  Peptide Sequence Number=SeqID_133674
atggtggctgaaatcattgatctttcagactcccctccatcatcaccctggtcatctcataatgatgcagcaagaattctcaattttgattctgtttctaatgaaaaaaatcaatttgagaaagttattcctatatccttaatggcttgcacaaatcccaaccagccacaaactagtctatggcgagctgcttcaagacataccaatgagcactctcagattgctactacattccaacccagcatgcaattacaaagggttgctacagtacttgaaccagtacctgaatcaatcacatgcatgtttcctcatggagctagactcaaggagccctggactcacagagaacatgagctatttttgatggggctaataaagtatggaaaaggtcactggagcaaaattgctagacactttttgttgaataagacaccacaacaagttcagagctatggtgcaagcttcttcaggaatctaccatctacacacctacatggttttaggagaaggaagccaagctactcgacatctagcctcatgtccaaaaacaacaaccttatggctgcatctgcatctaccacctcatacttcatgcctatgattgttaatgagccacaacaaactcacatgtttttcccagagaatgctcctttaaattttcttctggccccatcacatggagaagcaagtagcagcaacaacaacaccaccatgtatgggttccagatgcagacaagtggtgcaagaacttccatgaatgctagtgctaatggagaagttgatttggaactgcgtttgggttga

SEQ ID NO: 41990 - DNA, 1164 bp, Glycine max
  Peptide Sequence Number=SeqID_133675
atgacgaagcagaaaattcgcaacgctcttttggtgcacttggtgattctcttcttcttttctacatcggttgtttcagcgagagttgtgtctctcttgcagaactacgggaacccgattttcagatcaaattttcattctatttacgacacttccaagtacggtgtgtttcaactgagtaacgggttgggtaaaacgcctcagatgggatggaatagctggaacttctttgcatgcaatatcaatgaaatggtcattaaggaaacggctgatgcactggtatcaacggggttggctgatttaggttatgtgtatgtcaacatagatgattgctggtcttctgtgacaagaaatctgaagggtcaactggttcctgatcataagacatttccatctggaatcaaagctctagcagattatgtacatggaaagggactcaagcttggcatatattctgatgctggatatccgcctatgcgtgatgctctcaatgcgactgggcagaagattttctattcactctgtgaatggggcgttgaggaccctgctttgtgggcagacaaggttggtaacagttggcgcacaactggagacatcaatgattcatgggcaagcatgacaaccattgctgatcttaatgataagtgggctgcatatgctgggcctggaggatggaatgacccagatatgttggaagttggcaatggaggcatgacttaccaggaatatcgtgctcacttcagcatctgggctttagcaaaggctcctctattgattggctgtgatgtaagaaatttgactgctgaaacacttgagattttgagcaataaagaagtcattgccatcaatcaagactctcttggagtccagggaaggaaagttcaagtttctggagcagatggttgcagacaggtttgggcaggtcctttgtcaggaaaccgattggctgttgctctttggaatcggtgctcaaaagtagctactataacagcttcatgggaagcacttgggcttgaatctggggttcatgtttctgtgagggatttgtggcagcacaaggtagtaactggagatgcagtgtcatcattcagtgctcgagttgatatccacgactgtcaactgtacatttttgctccatttacagtatcccactctgtagagtag

SEQ ID NO: 41991 - DNA, 1020 bp, Glycine max
  Peptide Sequence Number=SeqID_133676
atggccgcgcgagctctgttgaccagaaaaaccctagccaccgtgctccgcaacgacgcgaagcccataatcggagttggcataacagcagcggctactcattcacgcgggttgcacgtgtacacgctacccgatctggattacgactatggcgcactggagccagccatcagcggcgacatcatgcagctgcaccaccagaagcaccaccagacttacatcaccaactacaacaaggccctcgagcagctccaagacgccatcgccaagaaagattcctccgccgtcgttaagctccagggcgccatcaagttcaacggcggaggtcatgtcaaccattctattttctggaaaaatctagctcctgttcgtgaaggaggtggtgaaccacccaagggttcactgggatgggctattgacacacattttggttcttttgaagcattaatacaaaaagttaacgcagaaggtgctgcactacaggggtctggatgggtgtggcttggtctggacaaagagttgaagaggcttgtagttgaaaccactgccaaccaggacccactggttactaagggaccaaatttggttccattgattggtattgatgtttgggagcatgcgtactacttacagacttttaagcgcaggaatggaggtcgcaacaaacacggccgtggccacgtcaagttcattcgatgctccaactgcggcaaatgctgtcctaaggacaaggctatcaagaggtttctggtgaggaacattgttgaacaggctgcagtcagagatgttcaggaggcttgtgtctatgaacaatacacgcttccgaagctttatgtgaagatgcagtattgtgtttcctgtgctatccactctcatgttgtgagggttcgatcccgcactgataggagaaagcgtgagcctccacagcgatttatcagacgcagggatgatgcaccaaggcctggtcagcctggtcaagccccacgtcctgctggagtaggagctcctgcccgaacttaa

SEQ ID NO: 41992 - DNA, 219 bp, Glycine max
  Peptide Sequence Number=SeqID_133677
atggatcatccgtcttggctaatcaatggattcaggagagctgtgttagattgcaatccggtgggcattcctatgatgggatatcctttcacttggtcacatagcaaggcatttacccaagaagcatcaaaccatcaccatataaggataaggtttaaattcgaaaatgtctggttgttgttggaggaagatgtaaaggagatagtgaaaggcgactag

SEQ ID NO: 41993 - DNA, 3996 bp, Glycine max
  Peptide Sequence Number=SeqID_133678
atgaagggtgttggaggatatcacgattggccttattacgcgtcgccgacttcaaatttatcagctttcgcggcgccttttagtgtgaatccctacacttcaagcgaggcttcgtctcagttcatggatacagctgaatccgcagaaaccctgcccccaattcagtttcaaccctaccggtacgatttcttttcgggccccgttagagaattggattccgctgcgcaattctctcatctgggtttgccttcttattccgcaagatcgaaccttgtcgaagcccaaccctacactgcgtcttctgcaattcacgatcactcttctaattcggcggcgccatatcattggtcttctggggctccctcttccgattggccttctctcagggaagctaataggtctcctgaattagggttttctggtcagagtgcggtttcctgggaccagtttccggagttcaatagccgtggtaaagggaaacaggtcggagttgggagcaatctctccgtaaaggaaacaaatgcggctggttcggttggtgaacaaaggaggaaccaagggaatcaagatgtgaaggactcttctaattgtgaggttccacaaattattgattgggaaaactacaatgtgcctgcaagtgcaaatcatatacataatacatctaactggtggggaactatcaaacccatgccagttgaattttctggtacctctgttatgcaatccccgtcaatgtctctagaaactcatcatgagacccctttgaaagtagttgctgattcagggaacaatcactcgttgaacattggttcatattacaaacactcaagtcatgttgataaaccttcaagagttgacactgtttcttcaatgcctggaacaatgttggttacagatttgaatgtccaggatattatagcagatgaacatgttgggcacgatgatttctataatacaaaggaggcttctcacatgcctagtcctggaactgctggattgtttaatccaggtcctatccatatgcatctaagaagaaatgaaccttcctcctcaaacaaagcaatgatttcagacaagaatgtttcgaggaatgttgctgattatatatttagagaaagtcatgaatttcaaaatcctcatgcaaatatggataatttaagattgggacttagtgctattgaagatgtcaattttgttgagaaatcttttgagggtggtgaccgatgcaatcctgctgaagactcaccttgctggaagggagcttctgctgctcgcttttctcattttgaaccttctgcagctctgtctcaagaatatgtacacaaaaaagaaagtagctttggttctgtcattaaggagcctcagaattatctgcttgatacagaaaacaatatgaaaaaatcatgtggaaattcaaatggctttcaaatgcatactggaattgtctatcaggacagaagttcagcaggttctccaaggagattttcagtaacaaagtttgcacctgaatattgcaagtcaggtagtgctctgaatgatggtccttttcaatctaagcctagctgtgattttggacttcaacaatatgtggatattaccaaaatgaaggaaaatactgtgccaccagccaagccaactgactgtgagtctggatcttctcagatggggcttcaacttgtagatttaaaggaatttattactcaaaaacagcaagctttattatgcacaggtgatgtaaattctggatgcaatgtgaataattgctcggaatatgattcatctcacactgctgaacatgtcctgcctttaccttcttcagtattagatgcaactacacctgaaaattcagctgggaaagcgtcaactgaaaaattggatgtccaaatgctgcttgacagaatgcaaaatttatcagaattgcttctttctcattgcttaaatgatgcctgtgaatggaaagagcaagattgcaatgtccttaaaaatgtgatcagtaatcttaatacatgtgctttaaagaatgaacaaattgcccctgttcaagaatgtcttttcaatcagccagaaacttctaagcatgctggcgaatcacgcaagtttcgccagaattcatgtttgaagaggccacaattaaccaagataggaccagagagctctaagattgagtttgagaatccacttgttgcagaggcaaacttttgtttcaggtctgggaaaccacataggaagctttctgattccatttccccaagggttgatacagaaatgacaaaggctgataacatgactaaggatctaaagaggattcttagtgagaatttccatggtgatgatgatgaaggagcagagcctcagactgtattatataagaacctgtggcttgaggccgaagctacactttgttctgtatattacagggctcgctataatcaaatgaagattgaaatggataaacattcttacaaggaaaaagtgatggagaagcaatctaaatctgaggtcattccgactttgagccagagtcagagttctgcaactaaagtgcattatccaaaccctgattcttctgcggaccttaaatttcctgtcttggatgttaccaatctagaggaactatctcgcttgaatatttccactgatatgaacaagtctaatgcaataacacctgaaggaagaggtcaaaacctggatagcttcatcgataattatcttgttccctgctcagtcaataagactgaaagaaatgatgagtcttctgttatgatggccagataccaagttctcaaagcccggattgatcagtcatccactgttactaccaatctggaggaaccattagacgtagcagacagctcatcacctagagggagggataatcaaaaccaagttaatctatgccaagattcccctattcctgaaaaaaacagtgctgaatatgaaacatctgttctggctaggtttcatattcttaaatcccgggatgaaggttcaagttctatttcttcagaagggaaacagttacatggagatgaatctgctgctgtcgaaggaatggatggcataacagttgcaacaaatgtatctgagggtaaaagtttggatgtccatgcaaatcctgttgtggtgcatctcaattcctacactgccgtggacaagtcaatcccaaaggagtttcatctggattcggaggacaatcaagaaactcagcctagcggaacctgtgagtttcagcctcctacttactactccgatggcttcgcgtcagactgggaacatgggtgtgatgcatcagtactgcttgattccacttccacaaacactgcagagaaagactctccagcaaataaaccaagtctccgagggtatgaagtcaatgataatgccaaggctaaactagaagcagtatgccctggaattgtttcatgtgctgacattgttgcatttgcagcaagggacagtgtggagcttgagggcttggctatgatgttccagcaggaagaagagatagcagaatctcaccagcttcagatacaagaacagagttccccctccaactttcaatcacacactatcggccgctctcattgctgggctttcagcagcagattatacaacttcagtagcacttcaagccaggatccaagtttagatccctcgtatgcagcgctgctgaagcggcaatgtcctcaaggcagcacaaacccaaacctggtgattccaatgaacccttcaagtcctggaattgctgatgtagcctactatgttgatatattagcaaaccgaggcccgttcacatctgaccaaactctcctaactgatgctgaaacagccagccaggtgaaacaaaatgctagggatccctatctatgggcaagtcaatttgcagatgcaatgataaagatgggtcaaatcagtgtcataactggtaatgctggagagattagaacaaattgcagggtggtcaatggtgaaggacttgagtaccttcatcaatga

SEQ ID NO: 41994 - DNA, 246 bp, Glycine max
  Peptide Sequence Number=SeqID_133679
atggcaaaagtcctccacgtctccgaccactcttccaccgcttccggcggttctgtcgagacgcacccaccaccgcccacaaacgtcgccgtctcccaccaaccctcctccacttccctctccgccttcatccccaaatcccgcacccccaccgctgtggtgggtgcatctcaacggagccgtcaaaaggcggtggaagagtgggcggaggcagtgaaggggttggcggagaaggaggaagaatag

SEQ ID NO: 41995 - DNA, 957 bp, Glycine max
  Peptide Sequence Number=SeqID_133680
attgggaccagcttttggccgggataggaggtagaacaatcagttggttcccccgatggaaggaaggaaaagaaggagtccttttctcatgtggaagatacccaaacgttccgctggtaggaacgaggggttgtattaactacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaagttcgcatacggggtttagattggctcgccaagttaaaagtcgtcagcgaagagaattttgaagcaccggaagaggacgaagaagtccaagctctcaaaagcgagttaggaaaggcaaaactcgccaaggagaagttcagttggctgctacacacgttcggaaggagtgtgccgggttacgggaagagaatgcaattacctgaactcaagttgcgaagggaagaaagggaccagtcgcgagcacatagcatggttctaaaagaggagttgattgcttgttcaaggtccaaaagaggcttgtctcagcatctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctatt

SEQ ID NO: 41996 - DNA, 462 bp, Glycine max
  Peptide Sequence Number=SeqID_133681
atggccacaatgatggaggccatgatgagaatgaagaagataatggaagccaatgcggttgtagttaccgctaccagcgttgttgctaaggtgaacccgatgcccccatctggcctcaaccaaatgaatcatccaacctcagctagggtaggcaaagatttgggaagtacgggcagcccccattatgcacaaattcaaaacaagcatgccttcccaccatatggcttgcctcccaactatacaccacccaatgtggcatacactcccaatacacatgaaattccccaccacaatctagccgacttcgagccttgcctcggatatgccactgaagggcaagcagttggtggtatacccttgcaaaacactttggagggccctcagtttcgccccaaaccacaacctttgcatttcacagtaggtaaaatccctcctattatggaaggaaagggaaaagtttga

SEQ ID NO: 41997 - DNA, 423 bp, Glycine max
  Peptide Sequence Number=SeqID_133682
atgatgctgtcaagggcactattctggagaggttcaaggaagatcgcaacatgctcaaaatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 41998 - DNA, 237 bp, Glycine max
  Peptide Sequence Number=SeqID_133683
atgagtgttgcagcctacccttcggcgggagagcaacgtggggctcacgggtgcgtcttccaagggaggaaaatgcgtggagtcgccaccaacgtttattcgaggaaaacgtcggaaaaaccagaaaggtgtggtctacgaactttaagtgtgaaaggttcgggagttatatttatgcacggggaaggtattagcaccccacgcgtccgtcacaagggacgacaggggatcctctag

SEQ ID NO: 41999 - DNA, 111 bp, Glycine max
  Peptide Sequence Number=SeqID_133684
ggcgcagaattcgtctatgcgcgtttatccacccagctgttgctctcaaatgataaaggacgcagaattcgtctatgcgcgtttaccactcgactcgctgctcctgaatga

SEQ ID NO: 42000 - DNA, 165 bp, Glycine max
  Peptide Sequence Number=SeqID_133685
atggataagagcttgaacgtaggagaagatgaatggaaggagaaggagagaaagagaatgaaattttgtgcctcaaatgagctatggttcaacccactaatacaagatcaagtacaagattctccactaagtgtgcttaagtgttatgaggcatgtaaagcatga

SEQ ID NO: 42001 - DNA, 237 bp, Glycine max
  Peptide Sequence Number=SeqID_133686
atgaagaacggtggaaaaccttcacggaatcgcccacggaaacgtctcggaagcgttacggaagcgcctcggcttgcattttcttcatggaaacaatttttctcactaattttaagtgcttctcagataccaggagggggaaaagagggaggtggttgccacccagctcgcctaggcgagctgggttgcttccaccagaaggcaccgccttctgttggaagaccctggaaggcccaa

SEQ ID NO: 42002 - DNA, 456 bp, Glycine max
  Peptide Sequence Number=SeqID_133687
atggaactaattgagaatatgactgctagtgatcatgctatcttcactgatagaacacactatcccaccaagaagagtttattagagttgtcatcacaagatgctctgttggcgcataataagttgttggccaagcaactaaagactttaacagaaacactgagttgcacactttgtggtggagctcatgaatcaggctgttgtattcccactgaagaatcaacacatgaagttaattatatggggaaccagtcaaggcagaatttttatgcaggtggattttctggattccaacagggccagcattacaaccagcaacaaaatcagtggaggattcaccctggtaatcaattaaacaaagaccagggtggaccatcaaatagggcgccacaacaagggcctaacctctatgagaggacaacaaagctggaggagactcttgctcaattcatgcag

SEQ ID NO: 42003 - DNA, 489 bp, Glycine max
  Peptide Sequence Number=SeqID_133688
atggggatcgcacccacaagacacccagtggacccggaaaagtccaacagggccctggggtttccagctctggttacgggcctctatcagtcctatagggtgcccgtaccccccccgacaaggtcacatcatcatagggatcgcgcctgcagacacccagtggacccgaagaagtccaatagggtcttggagtgtcaagctctaattacgggtctctgtcagttctacagagtacctgtcacctccagcaagggcatcaggccccctactaatcgagctttcatcaagaagtactgcgtctccaggcaggcgcagggcaaaacaccacagcagcttggggatggccggcagcgggcaacagacgcaccgccatcacctctagagttcacctctgctcatccacaaaaaggtttgagtattgcctacaccacatggccggccaataggcgaccaagtccaaagccaaaggacgcacctagttgctcatga

SEQ ID NO: 42004 - DNA, 969 bp, Glycine max
  Peptide Sequence Number=SeqID_133689
ggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgaaggaagaatcaagattctatcttcatgcgaaggatgtccaaatgttcccttgatgggaacaaggggttgtattaattataatcccgttctcgccataagacagcttggctaccccatgagaggagcgccattagacgaaagcatcacgcctttcaccgcacggggttttagtgaccacaacgcgagggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaaggcagcaatagcaaactcaagctccgaagaggtgaaaggaaatcatcacaggtcaaaggcatgatcttgaaggacgagctaaaggcttaccttaggtcgaaaagaaatttgtcccaacagttaagcgagactgaagggaatatgtgggccgtcatcgatgagtgcaaagagaagctaaatctagtggcgactcacgagcaaaggctagaggatgagtacgccaagatattagcagaaagcgaagcaagggagagggagtcaagaacttccccgattactagccaaggccaaagcaatggcggacacctactccgcccccaagaagatccacagacttctgagctattgtcaacagatgatagacttaatggaccatatgattag

SEQ ID NO: 42005 - DNA, 477 bp, Glycine max
  Peptide Sequence Number=SeqID_133690
atgaccataatgccaatctccccctgcagatgtatcaattgggatcgcgcccacaagacacccagtggacccgaagaagtccaacagggccctggggtttccagctctggttacgggcctctgtcagtcctacagggtgcccattcccccagcgaggaatcgcacccacaaagacacccagtgaacccagagaagtccaacagggccctggggtttctagctctggttacgggcctctgtagtccttcagggtggtcgttccccccggcaaggtcacgtcatcatgacatagggatcgcgcccgcaagacacccagtggacccgaagaagtccaacagggtcttggagttgccaagctctaattacgggcctcgcaaggtcatcaggccccctactaatcgagctttcatcaagaagtactgcgtccccaggcaggcgcagggcaaaacaccacaacaacctggggatggccggtag

SEQ ID NO: 42006 - DNA, 502 bp, Glycine max
  Peptide Sequence Number=SeqID_133691
ggctggaccatctgaggttagggtgattcctccatccagggttgtatctgttgttggagaggctgctcaattgctccaggttgctgcatggaagggcaaaggtctgtatggtggtcagcagaggagcacaaaccacaaacccttgcaacaggtacagatttctgattcaaggccagctggctacctcatgcactcctctaatgactatggcatcatttctggcgctaaactgctgggagttggaagccatcttgctcaattaaatttctggcttcagcaggagtcatgtcctccttttcaagggcttccaccactggcagatctatctcttctctcctctgatcctttcataaaaatattggagaagaagctgttcttggaggaatctgatgagctaaagtgtcctggaagcagggaaaatttctttgctaagatgactctcttgaaggtcccagctacgcttgagaaggcaacttgtcagaaattctgtgactgttgttga

SEQ ID NO: 42007 - DNA, 198 bp, Glycine max
  Peptide Sequence Number=SeqID_133692
atggcagaagagcatgacctgaggattacccttgaggattactcaagagaagccaagaggtggctccactcattcaagggtaacaacctaaaaacctgggaagatgttgttgaaaagttcctaaagaaatacttcccagagtccaagactgcggaagggaaagttgcaatctcttcatttcatcagtttccttattaa

SEQ ID NO: 42008 - DNA, 366 bp, Glycine max
  Peptide Sequence Number=SeqID_133693
atgggccccgacgagtgcaaagaaacgcgaagaactggaaccgaagaggtggcatgcaaaccaaggcaggattttagcatccaaaaaggtccagttttttcttctttatggctgagtatgagaaacttccagcagcccttctttctccctccacgttgctttttcttccttttcttctccaccattgttgtctcttttgaagctccaaatttcccttcatttccacaccaaattgcaaggaaaagctattttcggagtctaggagcctacctctacctcgtggaaccttcaatttcagatagaaaactggtagagaggatggggagagttaacttagagttaaatgtgagaatggtagtgttgtag

SEQ ID NO: 42009 - DNA, 192 bp, Glycine max
  Peptide Sequence Number=SeqID_133694
atgaatatacacaaaaagagtgatcaaggggttcccatgaaccctaagagaataaaggtcattccggagtggcccactccaccaagtgttgaggaaagaattcttgagtttcaagaacctctggatttgaggtcaaatctttttcaagggggagggaacgatgcaattctaccccctaagggcattggatag

SEQ ID NO: 42010 - DNA, 299 bp, Glycine max
  Peptide Sequence Number=SeqID_133695
ggaaagctgctgcttcaggtgctgtgtccaaggatgccttgattgctgaactcaaggacacatgcaaggtgctggaagcaaccatcaaagccaccacagagaagaaaatggagctggaacggctgatcaaaaggctctcagaaagtggcattgatgatgaagaagcagctgaagaagaggaagaagcagctgaagaagaggaagaagcagctgaggaagaagaagaagctgctgaggaagaagaagaagcagcagaggatacagaatcagatgatgatgattctgaggccaccccatga

SEQ ID NO: 42011 - DNA, 364 bp, Glycine max
  Peptide Sequence Number=SeqID_133696
ccaagatgaggctactacttcaccttcctctagtgaaagtgaagaagcaaaatgggaagaatctagtgaagaaatctacccccaagaagatggacaaccattagtggttaaagagaagtgtaaggagacacttgctagcattgccacacctcttgggcttgagtttattcctcaagtaaagaagttgttggatgaggcaccactcattgagttggtgagaaaccatgttccttcatgggaagatgcccaggaaatgggtgttgagggaaggagcccagagtatgatgaaactcgggatttgaggtcaaatcctttccaaggtggagggaatgatgcaatcctaccccgcaagggcattggctag

SEQ ID NO: 42012 - DNA, 132 bp, Glycine max
  Peptide Sequence Number=SeqID_133697
cagtatgaaaagcatggtcccaataatgataagggagagaggagtgggagagtaaggagaggcccatctccacaatgtgcctatgctttctttcgaccacaccattctgatggtgggtgtgagggcagataa

SEQ ID NO: 42013 - DNA, 405 bp, Glycine max
  Peptide Sequence Number=SeqID_133698
atgcagcacaggaacattgttagtgaggctggagaactttattcaaagaagcttgccaagtttgttggaaagcgtctcaaatcagaatgggctgcttctatatggactagtacactgcaacgaacaattctgacagccactccaattattggatttcccaagatacaatggcgtgcacttgatgagataaacgcaggggtgtgtgatggtatggcatatgcagaaatcaagaaaaacatgccagaggagtatgagtatgtttgcagacttgtatataggaacggaaatccttatggaatagctgaaggtattgttttcagtatgccatgccgatcaaaggtgatcaccaaatctaaggaattggtaatggtctcattccaagtgtactggatgttaatctactag

SEQ ID NO: 42014 - DNA, 589 bp, Glycine max
  Peptide Sequence Number=SeqID_133699
cctgaccttcgccataaggactacacgtcctgaccttcagagagctacacgccctcaccttaaaaggactacaggtcctcaccttcagagggctacacaccatcaccttcagaggtgtacatgccctcgccttcagaggactacacgtcctcaccttcagaggactacacgcctcgaccttcagagggcaacacgccctcaccttaaaaggctacacgtcctcgctttcataggactacatgtcctccccttcagtggagtacacgccctcgccttccaagggttacacaccctcaccttcagaggactacaggctcatccttgtaacatccttcaaaggactacacgtcctcaacttcagaggactacacgtccttaccttaagagtgctacacatccttaccttcagaggactacacgtccctgccttcagagggctacacgtccttccttcagaggactacacgtcctcaccttcaaggctacacaggactacacgtccccgccttcagaggactacacgtcgtcaccttcagatgaacatgtgctcacctttaaaggctacacgccctcgccttcacagggctag

SEQ ID NO: 42015 - DNA, 544 bp, Glycine max
  Peptide Sequence Number=SeqID_133700
atgaggggcaccgtgcatgagcctcaataccctggtcttcagaggactacactcctcgccaacagagggctgcacgccctcaccttaagaggactgtgtgtcctcactttcagaggactgcatgtcctcaccttcagagggctacacgccctcgccatcagaggactgcgtgtcctcaccttcagagggttacacgccctcgccatcagaggactgcatgtcctcaccttcgtagggctacacaccctcacctttagaggactacacgtccttgccaacagagggctgcacgccctcaccttgagaggactacacgtcctcgccaacgtagggctacacgccctcacctttagaggactacacgtcctcgccttcagaggactccatgtcctcaccatcagagggctgcacgccctcacctccagaggactacacgtcctcgccttgagaggactacatgtcctcaccatcagagggctgcacgccctcacctccagaggactacacgtcctcgccttgagagggctactcgccctcgccttgg

SEQ ID NO: 42016 - DNA, 830 bp, Glycine max
  Peptide Sequence Number=SeqID_133701
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcacagttccacatgggtggggaggcctcaggaaacttacaaccagggtggagggggaagcaggcaccttcttcacaaggcggcaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42017 - DNA, 339 bp, Glycine max
  Peptide Sequence Number=SeqID_133702
atgaagatctctctgaaattgacacggtggtcaatgtctcagcatatctgttatacagttgtggattttcatctgactgagacaagtctgcgagcggggaattctgatgtgtatggattcctcgagccacagtccattcagagatctgggcaatcacaatttgaatcggaaagttacatcaagagttggatgcagagttcaaaacgagatgtctaccttggagcctacctgaatgggccagacaactatcttaagggaataattaacagtgctttgaaaagacttgatgatactccacaacctaaatccaaggctgctgctaggtggattgttgttaag

SEQ ID NO: 42018 - DNA, 204 bp, Glycine max
  Peptide Sequence Number=SeqID_133703
atgaaagccaacaaaacaagaaatgaattgaaagtctcgaaattcgaaaacttactagttgaagaacgaagaacgaacgaagaacggatgaagaacgacgaaaaccttcacggatttgctcacggaaacgtctcggaagcgttacggaagcacctcagcttggattttcttcacagaaacaattttttcaccgaaaacagctga

SEQ ID NO: 42019 - DNA, 123 bp, Glycine max
  Peptide Sequence Number=SeqID_133704
atggaagaggtgcattggcccgtaatgccttatgcattcgggaccgaaccaagtgagcccagtcgatctgaagaccgatggtccgtggcggagatggccagcagcagcggtggtggaggatga

SEQ ID NO: 42020 - DNA, 828 bp, Glycine max
  Peptide Sequence Number=SeqID_133705
atggctctagttaaggaattctatgctaatttatacaccacagaggaccaagctcctaagcaagccagagtaagaggacacctgatcaaaatagatgcagacaagctgaatgaatttcttcagactccggtggtgttaaaggagggggaatctttacccacctactttagattttgcaggttgaggactaaacaccaggagattgatgccaggctttgtattccccgcaagggaaaagatctaacagcactggcccagacctggagtgtcttctcttactccaacctagctcccacatcctacacctcagatttgaatatggatagagctaggttggtctatggcttggtgactaacatagacatgaacatcggagcccttatctcaggtcatatttcttctattgctcagagtaactcctctaggctcagatttccagccttgatcactgccgagagcctaagcccgaccataaacttggcctacattaagaaaaactgttggaatgtggatgatctaacagttaacttcagaggggcaaggaaggcaagggttcgaccaactgatgttccttcttcttctactccaccagctccttccacttctactactcatataccaactcctccaggcctatctgctcaggactctcaacgctttaagtccatgcttcagagtcttcatcaaggacagattttgttaatgcagagtttgcaggttgtagctcctctaggatctattctgacagtggaacaattcatagagaaggtatcctggccaggaatcctaacttctctcgagagagaaggtgggggtccaagtgctcag

SEQ ID NO: 42021 - DNA, 433 bp, Glycine max
  Peptide Sequence Number=SeqID_133706
atggagaggagtatgattgatgctgccagtggtggaacccttggtgatatgacccctactgaggccaggaatttgattgagaagatggcttccaactcccaacaattcattgcaagaaatgatgctattgtccttagaggagtccataaggtggccatggattcatcttcatctgctgaaaataaaaagcttgaggtaaaattggatgccttggtcaacctagtaactcagcttgccatgaatcagaaatctgcatatgcacctgttgcaagagtgtgtggtctatattcttctgcagatcaccatacagatctctgtccttctttgcagcaatctggagtcaatgagcaacctgaagcttatgttgcaaacatttataatagaccccctcagcagcaaaatcaacaacaacaaaataattatgacctttcaa

SEQ ID NO: 42022 - DNA, 601 bp, Glycine max
  Peptide Sequence Number=SeqID_133707
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggatctgagatatatcggcaagaagcggctgttttggggaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 42023 - DNA, 639 bp, Glycine max
  Peptide Sequence Number=SeqID_133708
atgacggacgtgtggggtgctaataccttccccgtgcgtaaatacaactcccgagcctttcacttaaaagttcgtagatcgcgtcttttccggtttttccgacgttttcctcaaataaacgttggtggcgactccgcgtgtattccttttgtggaacacgcatcccgcgagtctcgcgtcgccctcccgccgaaagggccctatacccgggttcatgggaacataaggagtggaggtgaatctgtgatcatgctaggtctccgaccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccgatcgtcgccattttggccatgtatgacacgttcgaccggggatgtgaaaagagcagcgcaagaattgtttgttgtgcactggctctctatgtgtggctggtttcacacctttttttctccaagaaggtaggcccgtctatccgctacaaggtcaccgctcgtgcgtcgaaaaaggaaaggcgaattgggaccaactcttggctagcatggaggggcgtctgttaa

SEQ ID NO: 42024 - DNA, 860 bp, Glycine max
  Peptide Sequence Number=SeqID_133709
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgcaatgagctgacgatttctagctcaaatgtgcctagcgatgctgatgcaactgtagctactgcaactgatgaacttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42025 - DNA, 336 bp, Glycine max
  Peptide Sequence Number=SeqID_133710
caaattccaagatatgccaaagtcttgaaggagttgtgcactaataagcggaagcttaaaggaagtgaacggattagcatgggcagaaatgtctccgcattgagtgggaaatctgttcctcaaattcctgaaaatgcaaagatccagtcaactgatgtggtaattcatttagctaatagaagtgttgcctatcctgttggtttcatagaagatgtcttagttagagttggtgaactgattttccctgttgattttttatatcttgaatatggaagatggattttctcaaggatcagttcccatcattctaggcagaccctttatgaaaactgctag

SEQ ID NO: 42026 - DNA, 750 bp, Glycine max
  Peptide Sequence Number=SeqID_133711
atggctacctcaccaaaagaaacttcagctcctggttcaccctctgcaccatcaaaccaggaacgacctgaattcaatatccagcccatacagatgattcctggtcaagcccctgttcctgaaaaactggttcccaaacgacaacagggtgtgaagatttctgaaaaccctagcattgcaacaagtcctagggaagtagacccggagatggataagaagatccgcagtattgtgagtagcattttgaaagacgcctctgttcctgatgctggagaagatgttccaacatcctccaccccgaatgtttctgtgcctgatgttgagaaagatgttccaacatcttccgctccaaatgctgaagccctcccttcacccagtgaagaggaatcaacagaagaagatgatcaagccacagaagagacctctgcaccaaaggcaccagaacctgctccaggtgacctcattgacctagaagaggtagaatctgatgaggaacccattgccaacaaattggcacctggcattgcagaacgattacaaagccgaaaaggaaaaacccccattaagaggtctggacgaatcaagactatggcacagaaaaagagcactccaatcactcctaccacatccagaaggagcaaggttgcaatcccctccaagaagaggaaagaaatttcctcatctgattctgataatgatgtcgaactagatgtctcgacatcaaagagggccaagaaatctgggaaaaag

SEQ ID NO: 42027 - DNA, 429 bp, Glycine max
  Peptide Sequence Number=SeqID_133712
atgaccatgattacgccaagctcgaaattaaccctcactaaagggaacaaaagctggcatggtcagtgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42028 - DNA, 342 bp, Glycine max
  Peptide Sequence Number=SeqID_133713
tgccagtcattcggggttcccgtcacacctagtaaggtgatccgaccaccgatcacccgggccttcattgagaaatattgcacgcctaggcaggcacaggtcgatgcaccacaggccacagacgcactgccaccacctcatcaggcagatcatgctgggtcattaggcatggagcagtatctacagcacttgtttagggctgaggtcgcatggcccggagattggcccgaggcccaggcaggggaggcgcctgcaggatccccaggcgatgcagaggaggcccgcatggatgaggagatgatggatttgctcggtttcttgggagggagcggagccatgtga

SEQ ID NO: 42029 - DNA, 831 bp, Glycine max
  Peptide Sequence Number=SeqID_133714
aggatccccgcctgtgctcctttccttgtgagagattttggcgttcaaaatttcaaggttatacaaagggtccataaggcatggggaagcccgttaaggaaagataaagaacttaggggcattcgtaatggcatcattggaggttatcatgaatggctgaaagttcgtacacgaggtttagattggcttgccaagcttaagattatcaacgaagagaacttcgaagctccggaagaggatgaagaagtccgagctctgaaaaccgaactaggaaaagcgagacttgccaaagaaaaatttaagttggtcgctacagacgtttggaaagagtgttccgggttacaagaagaaaatgtagctaccgcaaaagcccttgaacaagaaaccaagagggctcgcaaggaacaacatggccgtgacaaattccgtgaagcattgtggggaagcaacagtgagctcaagcttcgaagggaagagagtgaccaatcacgagcacaaagcatggtcttaaaagaagagttagttgcttgctcaaggtccaaaaggaacttgactcagcgtttgtgcgagacagagaccaacatgttagctatcattaccaagtatcaagaagaactaagcctagccacccacgagcatagggtggcggacgagtatgcccaagtgtacgcggaaaaggaggctagaggaagggtgatcgactcgttactccaagcggcaaccatgtggatggaccgattcgctcttaccttgaacgggagtcaagaacttccccgattgctagccaaggccaaagcaatggcagacacctactccgcccccgattgctaa

SEQ ID NO: 42030 - DNA, 360 bp, Glycine max
  Peptide Sequence Number=SeqID_133715
atgacaagcagagaccaagtttggtcattctgcacccttgtatcatccagaggcggcgggcccgatgatacgcggagatacctttatgaggcggcgggcccgatgatacgcggagataccttatggttattcgcacccttttgtcatccagaggcggcgggcccgatgacaagcagagaccaagtttggtcattctgcacccttgtatcatccagaggcggcgggcccgatgatacgcggagataccttatggttattcacacccttttgtcatccagaggcggcgggcccgatgacaagcagagaccaagtttggtcattctgcacccttgtatcatccagaggcggcgggcccgatga

SEQ ID NO: 42031 - DNA, 249 bp, Glycine max
  Peptide Sequence Number=SeqID_133716
atgtcgcagaacttcacggattgcttaacgatgggtgtcaagttcctcgaagcagtcaagcaaaggttgcatgccatcaaacaatggtccccgaatgaaactagagcaatcaattcatggggctccggactcgatggtggaggatgcatgaacgacaatcaattcatggggctccgaataagatttaatggtggaggatgcacgaacaacgctaggcaatcaattcatggggctccgaataagatttaa

SEQ ID NO: 42032 - DNA, 255 bp, Glycine max
  Peptide Sequence Number=SeqID_133717
atgtcaggatttacacgcaattctcctcaaatttcagccagcccgtatcaattagacttcacactttatgcttcggggtcatacaatgctcaatggaatgccccagggctcctccacgataagcacacgttgcattcgagtcgtatcctcagaaaagtggagggggtcttccttattggaagtgccggtaaacagactttgtggttgattttcgaccgccctttgggtctaccggggggggggggcaaagaggag

SEQ ID NO: 42033 - DNA, 404 bp, Glycine max
  Peptide Sequence Number=SeqID_133718
atgagtcaatctcttccaagggctacacgtcctcaccatcagagggctacacgtcctcaccttcagaggactatacgtcctcaccttcgaggactacacgtcctcacctacagaggactatacgtcctcaccttcagaggactacacgtcctcaccttcagaggactatacatcctcaccatcagagggctgcacgtcctcaccttcagaggactacacgtcctcaccttcagaggactatacgtcctcaccttcagaggactacacatcctcacctttagaggactacaagtcctcgccttcagagggctgcacaccctagactttagaggactacatgtcctcaccatcagaggactacacgtcctcgcctttagaggacttcacgtcctcaccttcagagg

SEQ ID NO: 42034 - DNA, 342 bp, Glycine max
  Peptide Sequence Number=SeqID_133719
atgaccggacacgattggccacggattttgtttcctacttgcaggtacatggggacagatgcaagtggggatagggtcacgaccgaccggtcgttgccccttcccggcggttcaagtaggcaaacgctagcccgtaagggaggaggggacatggttaatgttcccctcaaaaaaaaatgtggcaggttagctcgcctgggcgagcaacccctgcacccaaattataaaaaacgagggaggggaacgttttggcatccaaaaacttcccccccccccccccctcattcaaaagataaagaacacgaaggcttgcggtttcttgctcccctaagccacttttga

SEQ ID NO: 42035 - DNA, 357 bp, Glycine max
  Peptide Sequence Number=SeqID_133720
atggtagcctggcccgggatccaaccttctcttcacagggaagatgaaggtcccacagcccagctacctcaacatgtggaggatgagtcatctgaggccaccatcccagagccatttgttataggagaagaggcagaggagacacaggctactttagagccttctgcaccagtggtgaacctaccctcacctcagcctgcagcagacccctccactcctcttctagagatgctagaggacccgactacaccagtcctggatatggacacttctcctccaactactctagtattgcatctgacagatgaggaggatgttcagacacaggacacccaggaccagtcacaggaattttga

SEQ ID NO: 42036 - DNA, 1017 bp, Glycine max
  Peptide Sequence Number=SeqID_133721
gagcgcgcaggtgccgaggcacgccaaggcggcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggtctcgttgggagcgtgcgtgcacgcaaagggtcgtcgatgggtccagacctgaccggctcgcacgtgattggtctcgagcgtgctcatccaccatttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 42037 - DNA, 450 bp, Glycine max
  Peptide Sequence Number=SeqID_133722
atggatctcattgaaaatatggttgcaagtaacattgctattttgagagatagagctcacattcctactaaaaagagtttattggagctaacctcccaagatgcattgttggcacaaaataagttattgtctaagcaacttgaggcattgactgaaacactaagatgtaccatctgtgggggagctcatgaatctggatgttgtatccctattgaagaacaacccactcatgaagttaattacatgggaaatcaaccaagaaacaattttaatgcgggaggattttctggattccaacatggtcagcaatacaatcaacaacaagggcaatggaggaaccaccctggaaatcaattcaatagagatcaaggtggaccatccacaaggccacaacaacaagggtgtagtctctatgatcgcacaacgaagttggaaaagactctagcttag

SEQ ID NO: 42038 - DNA, 466 bp, Glycine max
  Peptide Sequence Number=SeqID_133723
atgcttatgctagccagtcctttgaataaggctaagcatagttgctacgctaagctcttgttgctaagtgcgccctgtgcgctaagcctaagggtcattttgatggcctcaaagaagagaaaggcacctgccacaccttcccaggtccgatatgaccgatctaggttcacttctcctaaggcctgggaaagctttgaggaaggcaacattaatgttgccatagtaaaagaattctatgctaacctctatgatctagaggacaaatcaccaaagcaggtgagggtcagaggtcatttgataaaatttgatgaagacgccctcaacacattcctgaagacccctgtgatcattgaggagggggagacattactagcttactctagatttgcactcttgaggcctgatcctcaagagttggctgctaagctcttcatcccagggaggggattcgagcttaatgctgatg

SEQ ID NO: 42039 - DNA, 278 bp, Glycine max
  Peptide Sequence Number=SeqID_133724
atggtcattcccaagttcaaggtgctggactttgacaagtacaaggggactactcgctccaagaaccatctaaagattgaaaggatcaatgtgggtccgaaaagaggcaaatttgatcatcctactaggacgactgagaaaactggggcaaataaagagggtgaggatgagggagaaacccatgctgtgactgccattcctgtacgaccaagtttcccaccaacccaacaatatctttactcagccaataacaaaccttctccttacccaccacccag

SEQ ID NO: 42040 - DNA, 321 bp, Glycine max
  Peptide Sequence Number=SeqID_133725
atgtcgcacacttttccatcaccactgctgccacctcaacacccgctccttcctcttcctcccataatatcattctcaagtgcaacaaatccactgccacaccatgaagaaatcactccttggtcgatgaggaccaggagttggtcattggaggttttagtcccagaaagagaaatggcttcgacttctgcttcttcttttgagcgcaaggtttcaagatctagatctgttggatgtatcaacaaaagcttctctggggacttcttcgactgcatatctattgggtttggaggttgcactctcaagtgggtggagtcttag

SEQ ID NO: 42041 - DNA, 333 bp, Glycine max
  Peptide Sequence Number=SeqID_133726
ggatcgcacccacaaagacacccagtggacctgaagaagtccaacagggccctggggtttccagctctggttacgggcctctgtcagccctatagggcgcctttccccccagcaagctcaggccatcatgacatagggatcgtgcctgcaagacacctagtagacccgaagaaggccaacagggtcttggagttgccagctctaaatacgggtctctatcagttcaagggagtgcctattgcccccagcagggtcatcaggccccctattaaccaagctttcatcaagaagtactgcgcccccaggaaggcgcagggcgagacaccgcagtag

SEQ ID NO: 42042 - DNA, 724 bp, Glycine max
  Peptide Sequence Number=SeqID_133727
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggaggagccaaagcacgaccagatcgctgcaagtctgcgggggatgcaaccaatggctgtcgagcatccaaaggtgtaccaaacagccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42043 - DNA, 135 bp, Glycine max
  Peptide Sequence Number=SeqID_133728
ttcaaggcagaggtcgcatggcccagagattggccagaggcccgagcagaggctcccgacgaggcagatgaggcccgcaaggacgaggagatgaccaatttacttgatttcttaggagggagcggagccacatga

SEQ ID NO: 42044 - DNA, 339 bp, Glycine max
  Peptide Sequence Number=SeqID_133729
atgggtaaagtgaaggaggtacaagagtatatggaggccgacatggaggccatgaaagagcaaatggccgcaatgatggaggccatgatgagtgtgaagaagataatggaagccaatgcggttgcaattgccgctaccagtgttgttgctaaggtgaacccgacatccccatccgacatcaaccaaatgaatcatccaacctcagataaggtaggcaaagatttgggaagtacgggcggcccccattatgcgcaaagtcaaaacaagcatgcctccccaccatatggcttgccttccaactatacgccacccaatgtggcgtacactcccaataagaat

SEQ ID NO: 42045 - DNA, 1143 bp, Glycine max
  misc_feature (1139)..(1139): n is a, c, g, or t
  Peptide Sequence Number=SeqID_133730
atggggacaaatcaaaacggcaaaaggttttatcaagtcaaggttaaaagtctagatgtcactagcctcaaggaattaggacgattgatgggacctctccaaaggcaagccttccgcaaagtgtacgggaagattctagatttggccgcagcggaggtatttacggaagctgtcgtatccctcgcccaatactatgaccagctgttgaggtgtttcacgtttggggacttccaaatggtaccaactattgaagagtttgaggaaatattaggatgccctgttggggggagaaaaccgtatcttttctccggctttcttccttccttgagcaagattgcggctgtggttggtgattcagcaaaggagttggattgcacgaagcaaactcggaacggcgtagtgggcctgcctcggaaatacttggaaggtaaggcaagggatatggtgagccaagagaagtggggcccgtttgcagatattttagctttgctgatttttggggttgtcctcttcccgaacgtcgacggtttggtagacttagccgccattgatgctttcctcgcatatcaccatagcaaggaaagtccagtggtggctatcttggtagatttgtttgacacctttgaccggaggtgtgagaaaaacagtgcgcggattgtctgttgtttacccgctctctgtgtgtggttgatttcacacctattccaacaagacacgagacacccgtgtctgctccaaagatatcgctcatgcgccgaaaaaggaagagtcgattgggaccaacatttggctgggatagggggcagcgcgatcaattggtttcctcgttggaaggaaggcaaggaaggagttcttttctcgtgtggggactaccctaatattccattgatagggactagggggtgtattaattataatcccgcactcaccataagacaactagggtaccccatgaggggagcaccaaccgaagaaagtctctcgcctttccttgtgaggaacttaggcgcgcaaagtctcaaggcgatacaaagagtccacaaggcgtggagaagtctgttgaggaaagacaaggagcttaggggcatccgtaatggcgtcatcggaggttatcatggatggctaagaattcacacgcngagg

SEQ ID NO: 42046 - DNA, 336 bp, Glycine max
  Peptide Sequence Number=SeqID_133731
atgaagagagaaatctcctctatccctgattcaaattgtttgaggggacacatgtccctagacattgtctcgacatcaaagggacaagacatgctgcttcagaggtgctgtgtccaaggatgctctgattgccatgaactcacctcaggacacatgcaaaggtgctggaaattcctgtatcaaagacttgccttggaccacagagaagaagatggatgcggaatggatgatcaaaaggctcatcacgaagtggcattgatgactggagaagcagctgtcagcaagaagtatgaagcagctgaggaagaggttcattgtcaacattccctgaggtaa

SEQ ID NO: 42047 - DNA, 228 bp, Glycine max
  Peptide Sequence Number=SeqID_133732
atggagtcaggtgacatgcgggggtaccgtatggttatccgcacctttcgtcaaccagggccaaacgagctcgttgacgcacagagactaacatcgtcttctgcacctttttccatccagggacagcgagttaggtggtttttactctcctcgtccggagacattcaagcccaacaacacacgagattcttctctgctgggcggggacgatcaagttcgatggcgtag

SEQ ID NO: 42048 - DNA, 534 bp, Glycine max
  Peptide Sequence Number=SeqID_133733
atggtgggagaaatgttggtggcgaaagctataagtttggagagtagtagaaaaatcctacagttatataatgatgagatagcttggatgttatgggaattggctagggttcttggtctagaagggagtcgccttaatgatgaggatttggagacgattggaaaaaatttgtttaaggagaagctaaaacttctaaaaacaaaactctggggttggcatgtggaggtgttcgatggtttgggtgctaatataaattctaaagtggaggagctggaggtggtgaagacaaggttgtgtgtgagggttgaagatgtaggagggaggaggttgattctttctaaagaattttggagatcgttgaagaaatggcccaaaaatatagggttcatctatctctatgagatacaagcaaaaagcatgaaaataaaggttttggatgatagccaatgtatagtcattgggcgatactgcctcaacatccagtcctcagaagaaaagtgctttgacacttcgctcatagtacaaaggcaatga

SEQ ID NO: 42049 - DNA, 183 bp, Glycine max
  Peptide Sequence Number=SeqID_133734
atggggcaaaacacaccaaatgattatgatgatggatggctcaaattctcacaaagcacaattaaaagattaaaaacaattaaatcatcaaaagagaatcggacaagtgtaataaaagcaaagaaggagataggaaaagaaaaactccctaagtcatggtggaggaagagtagggtggagtaa

SEQ ID NO: 42050 - DNA, 210 bp, Glycine max
  Peptide Sequence Number=SeqID_133735
atgacgagagtgatgagcaaaatgacgacaactgacgaagtctatttcgttgaagcctttgggaagagacggcaccgtgaggcgccatttgggggaggagattccgattgtgaggtagctgaaggcgtcgccggcgacgggcatgtcaacgacaaactcagtgtattagaaggcggagagaagggtgcagaagccggcaatggcaattaa

SEQ ID NO: 42051 - DNA, 496 bp, Glycine max
  Peptide Sequence Number=SeqID_133736
atgagtcttcattcgtcatctagtgttaatggtgagggttctactcctaaggaccccttgtataagatattagatgagttgagatcccttaagttgtggaaagaaaaacaagagagaaaagaaaaaggtaaaaaaagagtggaagaaataagtcaagatgaaagagagaaaataagagaggaagaaagaagaaaaataatgaaagaaatgaaaagagaaaaacatgcctcctttagtagtcatgactcttgcaagagtttaagtgaagaacttagcgactattatagagggagccatagctcacatactaaacatcactcccaaagaagagaaaatgaaagaaagcctagagagtttaacattaaactcccatacttccatgggaaggacaatgaagaggcttacttagattgggaaataagggtagagcaaaaacttaaaagaaagcctactttaaaatcttatggctgtcattcttatccaaagaaagaccaag

SEQ ID NO: 42052 - DNA, 261 bp, Glycine max
  Peptide Sequence Number=SeqID_133737
atggattgcttcgtcatcctgctgattctcctctatcgcaacatgccccttttgcgggcgagcgaggcgaggctcacgggtgcgctttccaaaggaggaaagatgcgtggagtcgccaccaacgtttacttgtggaaaacgtcggaaaaaccgaaggtcgacaaaagcggggcttttgctcctacgtaccctccatcgaagaggaaatcagacctacgtagttctttcttaagagtgaatcaagcgattctttttacttga

SEQ ID NO: 42053 - DNA, 720 bp, Glycine max
  Peptide Sequence Number=SeqID_133738
cttcagacacagatccaaacagaaatcgccattggaaatccaagtgaaggagatgtgagggatgcaatagagaaggttttggctctagacaaggcttatccactccccttgttgggtggtgcaatgctcgaaaagtttccagcaaagtttgaagcagctagatggtggccggaaagtagattatcaagcaacgacgaagacaagataatggagattaagaacaacaataataatggatggaatgtggagttggaagaggaaatgagggaggttattgaagtgttgaagagaaaagacatggaagactatgagaggttagggaatattgcactgaagaaaaacaagggttttgctgtttcagcacctttgctcacaggaattgttgcactagggtctgtgttttcaggagatggattagttcctgcccttgctggggcgttggccacggtggttaatgcttttgagcatggagggcaagttggcatggtgtttgaaatgtacagaacctgtggtggattttttcagctgttggaggagacaattgaaaccgcaattgaagagaaagacttggacaaaagagaaaatggagagctatttgaaatgaagatggctttgcaattgggaagaagtgtgtcacagctgagagaacttgccacaaaatctgcttcatgtcgtattgaagggagggagatacatgaattcgccagcaaactcttctaa

SEQ ID NO: 42054 - DNA, 300 bp, Glycine max
  Peptide Sequence Number=SeqID_133739
gaggggctcttcccaccgcaaaatgcaagggttgtggttgtgggcgaaaccgagggccctccaaagtgtttggcatgggtataccaccaaatgcttgcccttcagtggcatatccgaggcaaggctcgaagtcatctagattgtggtggggaatttcatgtgtctcccccacggccagatgggggcatcgggttcacctcaacaatcatttgctctttcaaggcctccctatcggccttcatttgctcttgcacctcctctacttcacccattactctagctctagcacaggttcggtaa

SEQ ID NO: 42055 - DNA, 940 bp, Glycine max
  Peptide Sequence Number=SeqID_133740
atggcaattccattcaagacaaaagatgtcaacgaggaaataacctctaaagacattaagagcctaatggaacaggcaaactataccaacaaatacttacaagctttaggagaaaccataaaaactaaggtagttcctaaacaaaaatcaattgaggaaacttcgccaaaaatccccattgaaaaaccattattcaaacctttcaaagttagtgagaaggctaaaagaaaaattagggaacttagaaaaactaaatccttaattgaaggcgtaggtgacaaccatagtgaattactaaacaagattggtagtttacttaaagtcattccagataccccccaagcctcagaaaatacttccaaaatggtaacaagaagtacctccaaattaatcaatgttattaatgaagatagtgaccaaaactcagataacacaattgagataggatcagtgtcagaaaagaatataaatccaattaattccaaacactggaaaacaccctccaaattatattatcaacgtccaactgccccccgaccttctattagaagaaagagcgcagttaagacggatctcaatggaaaagtcattactaatgacgatgataaagagattcctgacgctgttaacacgttaatttttacaatagcccaacatttcattggagacccatccttgtggaaagacatgtctgtagaattattatcaaatcttaagtgtagaaccttagcagattttaggtggtataaagatactttcctaactagggtttacataagagaagatagtcaacaacctttttggaaagaaaaatttctagccggtcttcccagatcattaggagacaaagttagagataaaatccgtagtcaatctgtcaatggagacattccatatgaaaatttaagctatggtcaattaatttccctatgtccaaaag

SEQ ID NO: 42056 - DNA, 378 bp, Glycine max
  Peptide Sequence Number=SeqID_133741
atgggttttcacccaacaaaactcaatttcgtgcctagcgatgcggatgaggcgccactcgatgtttccatttgcctgcatgcctttggtattgtgggggtgtggttcgttttagtggtgtcaagtcttgcgaacgtgagggtgctgacgattggttcctgtgttgcctacctaccaaacggtattcgtgtggctaggtcagacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 42057 - DNA, 176 bp, Glycine max
  Peptide Sequence Number=SeqID_133742
atgggagtgcaaatagcaaccaggcccacttgggccctccagaagattcctccagaaggctgttgcttctggaggaagcaaccttgctcgcctgggcgagctgggaatttcgcgaaggtttcgaccgttcttcaacgttcttcattcgttcttcatcgttcttcgatcttcaacgg

SEQ ID NO: 42058 - DNA, 878 bp, Glycine max
  Peptide Sequence Number=SeqID_133743
atggtgaaagttgggacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcatcacccgcaagctgatccgccgacatccccacgtgttccccacgggcgacctgtatgcgccgctggacataccgcgcctgagcgaagagcagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42059 - DNA, 276 bp, Glycine max
  Peptide Sequence Number=SeqID_133744
atgggtgatcaagaggggacacaggaacagatgaaagccaacatgtcggcttcgaaggagaaaatggcttccatgatggaggccatgttaggaatgagaaaactcatggagaaaaacgtggccaccgctgccgctgttaattcggctgccgaagcagacccaactctcctagctaccgcgcaccatcctcccccaaacgcggtaggaagagaaaggagcacactagggcacagcagcaacccccatttgggatacaaccgggcggcttacccttaa

SEQ ID NO: 42060 - DNA, 354 bp, Glycine max
  Peptide Sequence Number=SeqID_133745
atgactcagtgtgtcgatggcagcagagccaagtttggtcaattctgcagcccgcggagataccttacggttatccgcacccctttgccattcagacacagtcgtgtccgatggcaagcagagaccaagtttggtcattctgcacccatgatacgcggagataccttatggttattcgcaccccttttgtcatccagaggcggcgggcccgatgacaagcagagaccaaagtttggtcattctgcacccatgatacgcggagataccttacggttatccgcacccctttgccattcagacacagtcgtgtccgatggcacgcagagaccaagtttggtcattctgcacccatga

SEQ ID NO: 42061 - DNA, 378 bp, Glycine max
  Peptide Sequence Number=SeqID_133746
atgaagcacttcactgacaccctcatcagtgccaacataagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagccttgaatggcgaatgggacgcgccctgtagcggcgcattaagcgcggcgggtgtggtggttacgcgcagcgtgaccgctacacttgccagcgctgatgtccggcggtgcttttgccgttacgcaccactccgtcagtag

SEQ ID NO: 42062 - DNA, 294 bp, Glycine max
  Peptide Sequence Number=SeqID_133747
atgggaaagttggatcatctagaggaaaggctcagggccattgaaggaggtgaagattatgcctttgctaacctaaaggagttgttcctagtacccaatatcatcacgcctcccaagttcaaggtgctggactttgacaagtacaaggggactacttgccctgagaaccatctgaagatgggggcatacgcaaaaggatgcaactacagaacatgtgcaaaaagggggcacaaatctttcaaagaatacgcccaaaggtggagagacctggcagctcaagtggcaccccaatga

SEQ ID NO: 42063 - DNA, 798 bp, Glycine max
  Peptide Sequence Number=SeqID_133748
atggtgttggaagagggccaggaatgcgagtatggccagaggaggaaccggtctgatgggttcgatgaggaggccatcgcccagctgctatgtataccggggcaagattttgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctggtgtacgccatcctgacacggatgagcatccatgtggctcggttgatcgctgatgccatatatatttttgcaggtatggcgcccactaggcaccctttggacccagataagtccaacagggccctgggattcctcgcactgatcaccggactctgccagtcgttcggagtccccgttgcacctaccaaggtgattcggccgcccatcacccgggctttttatttgagaagtactgtacccagagacaggctcagggtgatgctccacaggccgcaggcgcgcccccaccacctcatcaggcgggccaggctggggcatttgacatggagcaatgagtctttagcacgcagagccaggggcttcgctcccttttcatgcccttactccagaccagttcagggcagaggtttgcatggcccggagatttgtcccgaggcccaagcaggagaggcatccccagaagctcccggcgatggagaagatgtccacgaggatgaggagatggctgatttgcttgacttcttgggagggagtggagacacgtga

SEQ ID NO: 42064 - DNA, 449 bp, Glycine max
  Peptide Sequence Number=SeqID_133749
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggtgggcccgggcgactgtttaccaaaaacacaggtctccgcaaagtcgtaagaccatgtatgggggctgacgcctgcccagtgccggaag

SEQ ID NO: 42065 - DNA, 243 bp, Glycine max
  Peptide Sequence Number=SeqID_133750
atggttctaggaaaaccatggagtctcacaacttccttgaaaaatagttttgagatgtgggagatgtgggaagcatcatccaccttgtggcatggtataaagcgtgccatcttgctaaacctatccaccaccacaaagatagagtctacacctctttgggttctaggaagcccaaggacaaagtccattctaatgtctactcaaggtgcagaggggataggtaagggtgtgtatagcccatga

SEQ ID NO: 42066 - DNA, 225 bp, Glycine max
  Peptide Sequence Number=SeqID_133751
atggggaatcctaaaatgcacatctctgatatatctcaaagaattgcaacaaaagatcggggagtcaatagttttccaaaaagagatgccgctatattgaagagacatttagctcatttgaaatatcttggcggcattaaaaaatatatgacggggttacctgatattgtaataatcgtcgatcaacaagaagaaaagcttatacggctcttcgagaatgtataa

SEQ ID NO: 42067 - DNA, 51 bp, Glycine max
  Peptide Sequence Number=SeqID_133752
gaggagaaaattaccaaacgtttagcattccctcacgcttggcgccaatga

SEQ ID NO: 42068 - DNA, 190 bp, Glycine max
  Peptide Sequence Number=SeqID_133753
atggagaattggcgaacatcgctaggcaatgaattcgcggggtccagactcgatggtggaggacacatgaatagcgctaggcaacaaattcatggggctccgaaaaaaagtggagaatggagaattggcgaacagcgctacgcaataacttcgcggggctccagactcgttggtggaggacgcatgaaca

SEQ ID NO: 42069 - DNA, 159 bp, Glycine max
  Peptide Sequence Number=SeqID_133754
atggtccatgacatctttgtcaaggtgaaactggaagtaacaaggacattaacagtcctaaacatgtttggcagtaggcgaagcagcaataaatgggtttatgatcccaacatggttggctcatggtacctaacacatgcaactaagaatgcatcatga

SEQ ID NO: 42070 - DNA, 105 bp, Glycine max
  Peptide Sequence Number=SeqID_133755
atggagacgattgtaccagtcccacgggcagtggacatcgattactcacagatttttctgaagaactttgtccttgttctcaaagaatgtggtgcattgtgttag

SEQ ID NO: 42071 - DNA, 129 bp, Glycine max
  Peptide Sequence Number=SeqID_133756
atgtgtgcacaagaaatggctctgaaaaagctttccacgaagaggtctaggaaagacgccgcagtggaagggtccagtgccacccccgagtttgatagccaccgtttccggagcaccgagcaccagtag

SEQ ID NO: 42072 - DNA, 561 bp, Glycine max
  Peptide Sequence Number=SeqID_133757
aaaggaggggcagattgggaccgactcttagcaaacaaagaaggagcgtctgtcaactggttccctcgatggaaagaaggaagaaccagggttcttatttcgtgtgaaggatttccgaatgttcccttgatagggacaaggggttgcatcagttacaatcccgttcttgctataaggcagcttggctaccctatgagaggggtccgcaaggcaagggaggtggtgcaaaagatggataaagaacttaggggtagtaacaatgggcccatcggtggctaccgtaagtggttgaaagcccacgtgcaaggtttggattggctcccgagtttgagaaccgctaaaagggaggaagttgaggcaccggaggaagacgaagaggtgcatgcccttagggcagaactcgagcaagcccaaacagtcaaagaaaggttcaaatcagcagctctgaagatccgaaagaagaatgccaaactgagagatataaatatagcaaccaccaaagccttggaacaagagaccaagagggctcatagggaagagcacggccggaacaagttctga

SEQ ID NO: 42073 - DNA, 465 bp, Glycine max
  Peptide Sequence Number=SeqID_133758
atggtgttggtactacgtgggatgcatccagattttgatcatattcgtgatcaagtcttaattggcaaagaagttccttttctagagaatttaattacccgacttcttcgagtcccctcacaaaaaataggaggaaattcagttaatagtattgaaacttctgccatggtatctaatcgagtgggacgaggtggtatggaaaccgaggaggacaagctgaaagaggaggtcgccctcaatgttcttacttctgaaacatctgagataaagtttttgaaagctgactatcaagagtatctccagctaaaagctgccaaggaatctcaaacatcatcttctataagtggtcataactccattgcttgcattgcccaatctagtaataatcaaagtccatggatgattgattcagagttgcagcaacaggaatcagccatgtatcacccacttcttctttgtctttaa

SEQ ID NO: 42074 - DNA, 180 bp, Glycine max
  Peptide Sequence Number=SeqID_133759
atgaagagatgcatgatgcgatcaagaaaaccagacatgggactaccagtgacaatgcatcaccaaaagaggaaaactctagatgaggcttcactgttatcaagcgagtcagagacccagcatggccacagatcgacctccactccctatggctcacacaaacccgggtatagggcctaa

SEQ ID NO: 42075 - DNA, 246 bp, Glycine max
  Peptide Sequence Number=SeqID_133760
atgtatcagttggggtcgcgcccacaagacacccagtggacccggagaagtccaacagggccctgggtttctagctcgggttacgggcctctgtcagtcctacagggtgctcgtcccccccaggatcgcgcctgcaagacacctagtggacccggagaagtccaacagggtcttggggtttctagctctgattacgggcctttgtcagttctacgaagcgtctgtcgcccccaacaaggtcattag

SEQ ID NO: 42076 - DNA, 309 bp, Glycine max
  Peptide Sequence Number=SeqID_133761
atggaaaaatctgaaaagaaaaatcatagtgagaagaaactaaagaaagcatacatcacatgggatgaaaatgatttggaatcttctgatgattctgaaaatgaagagataaatctttgccttatggcaaaaagttacgaaagtgatgaagaggtgtctttgagaaagaagtggtacatagatagcggatgctcaaaacatatgactggagatgcatcaaattttacatatatatctccaaagaaaagcgggcatgccttaaacacagcctgcttagcgttagtcaactatgtgacaaaggctatctag

SEQ ID NO: 42077 - DNA, 312 bp, Glycine max
  Peptide Sequence Number=SeqID_133762
gcaatcaattcgtggggctccggactcgatggtggaggatgcatgaatgacattcaattcatgcggctccgaataagatttgatggtggaggacgtatgaacagcgctaggcaatcaatttgtggggctccagactcgatggtggaggatctcttggaaatcaattcgtggggctccggacttgatggtggaggatgcatgaatgacaatcaattcatggggctccagataagatttgatggtggaggacgcacgaacagcgctaggcaatcacttcgtggggctccggactcaatggtggaggatgcatga

SEQ ID NO: 42078 - DNA, 210 bp, Glycine max
  Peptide Sequence Number=SeqID_133763
atggcatttcttgaggttgttgaggttgctctaaagtttgagcattatcttcattactggagttgtgtcttgaatagtaataggtacagacttgtttacactgtaaataacaggttcttcctcaaagacaacattctttatgttctcttccttcctaaactcaacttcctcaagaaatctcgcatttcccgtctcgaaaaaggatcttaa

SEQ ID NO: 42079 - DNA, 372 bp, Glycine max
  Peptide Sequence Number=SeqID_133764
atgaagagagaatctcctctatccctgcattacaaactgtttgaggggacacatgtcccagacattgtctcgacattagggaaagctgcttcaggtgctgtgtccaaggatgctctgattgctgaactcaaggacacatgcaaggtgctggaagcaaccatcaaagccaccacagagaagaagatggagctggaacggctgatcaaaaggctctcagaaagcggcattgatgatggagaagcagctgagcaagaagatgaagcagctgaggaagaggtagaagcagccgaggaagaagaagaagctgctgaggaagaggaagatgcagcagaagctactgaatcagatgatgattctgaagccaccccatga

SEQ ID NO: 42080 - DNA, 282 bp, Glycine max
  Peptide Sequence Number=SeqID_133765
atgcctgctttttccacaaaaataccttctatcactgaagaaaacgaggtcgatgaagtatatgcaaattgtaatgatcatgatgaaggtctatgggagaacactcacatgatcatgggaacaccgccaaggtcccctccgcactcagatggtcattcagagcctacgtctaggaagagtaaacaatcaacacggctaagaaggttgactttaagaactttgcatcagcaaagaccaacagttaacgtcgaccctacaattgggagaggatcaggcccataa

SEQ ID NO: 42081 - DNA, 225 bp, Glycine max
  Peptide Sequence Number=SeqID_133766
atgttgtgcaaccttacggattacgtaatcatgccacttttgccttccggaacgttacggaactttacggattgcgcactaacaccttttaatttccagcatgtcacgaaacttcacggattgtgttacaacgcttttcttttggcttccggcatgtctcggaacttcacaaattgcctaacgatgggtgccaaatacatcgaagtggtcaaacgagggttgtag

SEQ ID NO: 42082 - DNA, 372 bp, Glycine max
  Peptide Sequence Number=SeqID_133767
atgtgtggcatctcttgtcaatgtcaggatttacacgcgattctcctcaaatttcagccagccccatatcaattagaccttgcaccttacgcttcagagccctacaatgctcaatggaacgccccggggcttctccgtgacaagcacacgttgcgtttgagtcgtattctcggaaaaatggaggttgatgaaccttggttggggttatggctaccattgaattatcaagtagacatgggagcaatgcggaagacagactttgtggttgttttagggatggcctttgtggataactgggcggtgggtaaggagaaggttggttattggctgagtaatgacattgttgggttggtgggaaacttggctgtatag

SEQ ID NO: 42083 - DNA, 444 bp, Glycine max
  Peptide Sequence Number=SeqID_133768
atggctccgaagaaactctccacgaagaggtctagaagagacgccacaggagagggatctagtgtcatcccagaggagaagcgtgtccagctcaaggaggatgagtatacggactttcaggaggagatagcttgcagacgttggacaccgctagtgactcccatggccaagttcgacccagagatagtcctagagttctatgctaatgcttggcccacggaggaaggagttcgggacatgcgctcgtgggtaaggggtcagtggattcccttcgatgcagatgccctcagccagttcctgggcgacccgctagttttggaggaaggccagcagtgtgagttcagccagaggaggaaccgggccaacggtttcgacgaggaagccatcgcccagctgttgtgcataccggggcaggatttcgctcggactattgtagggaggcag

SEQ ID NO: 42084 - DNA, 399 bp, Glycine max
  Peptide Sequence Number=SeqID_133769
atggagtataacattatgaacacgctccaacatatgaccatggtagctacagcctaccaaacctcccatgaatgttcgaaagaaaccattatagatattttggtggcaggattttccgaacaattaaaagctgaacacttcattagagacccatctctgtggaaagataggtgtgcagaattgttatcaaatcttaagtgtagaaccttagcagactttaggtggtacaaagatactttcctaacttgggtttacactagagaagatagccaacaacctttttggaaagaaaaatttctagccagtcttccaagatcattaggagacaaagttagagataaaatctgtagtcgatttgccaatggaggcatttcatatgaaagcttaagctatggttag

SEQ ID NO: 42085 - DNA, 507 bp, Glycine max
  Peptide Sequence Number=SeqID_133770
atgacgcagcaggctgtcgccgatgctctctttcgacgcggcgaaacgctcgcgatcccacggaatggtggcgcgagagaaatagagcgcgtagccctgcgcgtccatcacgaccttcaccgcgttggggttgaaagcctcttcggcgctctcgatcggcactgccagcgtcgccatgccggcctggctgcctgccagattatcagccacctgacgcacgatcaccggcgggatcagcggttcgtcgccctgcacgttaacgatgatctgatcgtcggcaaagccgtagtgcgcgatcacttccgccagacgctcggtgccggaatggtgatccgggctggtcatgcacacttcgccgccggcggcttccaccgctttggcgacttcagggtgatcggtcgccacgatgacgcggctggcgccggactcgcgggcgcgctccatcacgtgcaccaccatcggcttgccgtgaatatcggccagcggtttgcccggcaaacgggttga

SEQ ID NO: 42086 - DNA, 348 bp, Glycine max
  Peptide Sequence Number=SeqID_133771
atgagtgcaaatcagaggagtactgctccaccctttaaggaggaatttgcaactgtactaaggatgactcattccttaaatgatgctcaacctgtacctgcaacaccagcatcattttgcaatcctactaattgcaatattggttgtgacgatgttgttcagaaccaaaaaaatgagaatgaaaccccacctgcgacacaaaattcaaagccaaaacgaggaagacccttcaaaacgccacctgaatcgattaaaaattggtatgttatacgcaaagaacgaaagatcgccaacaggttcgatacggtaaatattacacatagtggacatagagatttatttttttaa

SEQ ID NO: 42087 - DNA, 355 bp, Glycine max
  Peptide Sequence Number=SeqID_133772
atgactaggggctatccaggtgatttacaaccctttgatcctgaaatagatagaacctttcatagattagttagacatagtgtgcatcctggtcattctgtgcattttgagtattttgagcattctgagtattctgttgttggtgattttgaatattctgattttgagcattcgactactaattttcatactgagaacatggctcaacctccacctcgtgagaggactcttagggaaatggctgcacttgatttcacttatgaaagcttgtgcattcaatatcctgatgagggtgttccatatgttctcaagactggactaatacatttgatgcccaagtttcatggtcttgcag

SEQ ID NO: 42088 - DNA, 598 bp, Glycine max
  Peptide Sequence Number=SeqID_133773
cggcggcgctggcacgcttcgcaggcttatgctgagagtaaactgcatgatgccatactggcgtttgccatcgcccggcgctggccgcaggtatacagcaacgcgctggagccaggctgggtgccgaccaaaatgggcggtgccggggcacccgacgatcttgatcaggcgcatcgtacccaggtgtggttagccaccgctgatgaggcacgggtcagcggagagtacttttatcaccgtcaggcgctggcggctaatccgcaggcgcgcaatccacggctgcagcagcagttgctggcgatatgcgccgatatcagcgacgctgccgtttcggcgcattatggcgggagcgttttttcaccaccgggatgtccatgcatgttgcctgttaaagcggttttactctcttttctctgtgtggtgttactgtcgctggcggccagcctggcgcaggcgacgcgcagcggtgagttcaccaccgaacgcggcggctgggcgacggcgcgccgtgattcggccgggctggcaccggatccgcagcgcttcgccagtgaggcgattgtgcaggtgtatgctgcgccgacctacggctggaaag

SEQ ID NO: 42089 - DNA, 288 bp, Glycine max
  Peptide Sequence Number=SeqID_133774
aagacacccagtgaacctgaagaagtccaacagggccctggggtttccagctctggttacgggcctctatcagtcctacagggtgcccgtacccccccggcaaggtcacgtcatcatagggatcgcgactgcaagacacctagtggacccgaagaagtccaacagggtcttggaattttctacggagtacctgtcacctccagcaagggcatcaggccccctactaatcgagctttcatcaagaagtactgcgcccccaaacgggcgcagggcgagacaccacagtag

SEQ ID NO: 42090 - DNA, 250 bp, Glycine max
  Peptide Sequence Number=SeqID_133775
atggcctcctatggtggtgagcatgatgaggacatgaccaagagcaagggcaaggatccacttgaaggacttggaggacgtatgacaagggctagagcaaggaaagccaaggaagctcttcaacaagtgctgtccatactattggaatacaagcccaagtttcaaggagaaaaatccaagggcccaactggcaacctaggcatcagccttttgggagaccaaatggtggctgacttgttggctgttgggg

SEQ ID NO: 42091 - DNA, 1277 bp, Glycine max
  Peptide Sequence Number=SeqID_133776
gtcgactctagaggatcccccgggctggctccccgtacgggaaaggcgataggtagcaacccacacgccaacggcggcctgttgattcgggagcttgacctgccggaggtcgatcaatacgcggtccccgtgggatctccgggcgcgatgaccgcagaagcaaccaaagtgctcggcgcctatcttcgcgatgtgatcgatctcaacccgaacaacttccggctaatgggccccgatgagacggcatccaatcgcttgtcgacggtctacgaacgcaccgacaaggtatggctggaacgtagcgaaaccaccgatgaacatttgggccccgagggccgggtgatggaagtactctccgaacacctgtgtcaggggtggcttgagggatatctcctcaccggacggcacggcctcttcaactgttacgaggccttcgcccatattgtcgactcaatgctcaaccagcatgccaaatggctttccagcagcacagaagttccgtggcgacagccgattgcttctttgaactatttactgacatcccatgtttggcgccaagaccacaatggcgcgtctcaccaagacccggggtttatcgatcacgtcgccaacaagcgcccggaggtagtgcgggtgtatctaccgcccgacgccaacacgctcttggcagtcaccgaccattgtctgcgtagcaggcactgcgtcaatgttgtggtggcgggtaaacaacctgccctgacctatttgagcatggaggcggcacgcgcacactgcgccagagggctgggcatctgggattgggcgagtaatgcgccgaacgagccggatgtcgtgctggcctgcgccggagatgtaccaacgctggaaaccttggcagccgcggacatcttgcgccggaggttgcccgagctcgcggtccgggtagtcaatatcgtggacatcatgcgcttgcaaccagcatctgagcatccacatggactgccccacagtgattttgacgcacttttcacccctgataaaccgatcatcttcgcctaccacggctatccctggttgatccaccgccttgcctaccgccataccaatcacgatcggatgcacgtacgcgggttcaaggatcggggcaccaccacaacaccttttgacatggtgatgctcaatgatctggaccgtttccaccttgtcatggatgttatcgacagggtcgaggggtctgggcagccgagccgcaaacctacggcaggaaatggtcgacgacccgaaatcgctgcctgccg

SEQ ID NO: 42092 - DNA, 381 bp, Glycine max
  Peptide Sequence Number=SeqID_133777
atgttattgcctagcgctgttcatgtgtcctccactttcgagtttggagctgtgtttcatgattgcctaagtgcggaccctcaaggcaatcctccattctcaacccttttccggagccccatgaattgcgttttcgttcatgtgtcctccaccttcaagtttggagtcatgcgtagtgattgcttagtgcaattctccattctcaaccctttttcggagccccatgaatgtcattgcctagcgctgttcatgtgtcctccattatcaagcgcgaagcctctgaagaaaaagagaaggagtagagacgagagtcgtcatcatggaaagggcaggacggacgaaatcagtgtcctatctttgctttcctcttatctccgatga

SEQ ID NO: 42093 - DNA, 135 bp, Glycine max
  Peptide Sequence Number=SeqID_133778
atgggaagctcaatggagccacaagaaaagaccattacctgcttcccttcatggatcaaatgcttgagagacttacagggcaatccttctactgtttcttggacacatactcaggttacaattagattgcagtag

SEQ ID NO: 42094 - DNA, 570 bp, Glycine max
  Peptide Sequence Number=SeqID_133779
atgccctcgcctttagaggactacacgtcctcgccttcagaggactacacgtcctcaccttcagaggactccacgtcctcaccttcagagggctgcacgccctcactttcaaagggctacatgccctcgccttcagagggctacatgccctcgccttcaaaagactacacgtcctcgccatcagagggctgcatgccctcgccttcagaggactacacgtcctcgccttcagaggactacacatcctcaccttcagaggactccacgtcctcgccttcagagggctacacgcactgggccactgggcgtggagcgctatctacaacatttggttcgccaatacatgagtgtctctatcggttcagcctcagtcagcaggggcagggtgtcgccccttttgtaagccctaccccagagcagtttgggactgaggtcacatggcctggaggctggcccgatgcccaggcaggagaggagcctgcaggatcccccagtgaggcggatgaatcccatatggatgaagatatgactgacctgctcggtttcttgggagggagcggagccacatga

SEQ ID NO: 42095 - DNA, 343 bp, Glycine max
  Peptide Sequence Number=SeqID_133780
gggttcccatgaaccctaagagaataaaggtcattcctgagtggcccactccaccaacaccactcattgagttggtgagaaaccatgttccttcatgggaagatgcccaggaaatgggtgttgagggaaggagcccagagtatgaagaaccttgggatttgaggtcaaatcctttccaaggtggagggaatgatgcaatcctatcccgcaagggcattagctctagcttctttagaaatcttctcaaggaaggttgtcgcaacctatccttcggcgggagggcgacgcgagactcgcgggatgcgtgttccacgaaaggaatacgcgcggagtcgccacctac

SEQ ID NO: 42096 - DNA, 1431 bp, Glycine max
  Peptide Sequence Number=SeqID_133781
ccgctgcacttgagaaagaacccgcccggctggtgccttccgccgttcaggaatctcagccgcagcctcacacctggcagaaaatgccgttctgggacaaagtgcgtccctgggcgagccagattacgcaaatcggtatggcggcctgcgtgtcgctggcggtgatcgtcggcgtgcagcagtacaaccagccttctgcgccatcgaacgcgtccgaatcgccggccttcaccacgctgccgatcatgggccaggcctcgccggtcagcctgggcgtcccggccgacagtttctccaccggcagcggccaacagcagcaggtgcaggaacagcgcaagcgcatcaacgccatgctgcaggactatgaactgcaacgtcgcctgcattcggatcagctgcagcttgagcaaggcaacccgcaacaggccgccattcaggttcccggaactcagtctttaggaatgcaacagcacctgctctattccagcatcgccccggcgcagccaactgcgtccggggcgttattgcaacagatgagcagcgccagccgttctctcaattacgagctcgcctacatcagcatcagcaagcagggaatcgagtcgttgcgctatcgccatgcggtgatcggcaacgtgccgctcggccagctgctgcatatggacggcccgcgccgcgaagtgttgcagcgcggcggcgggatcagctacttcgagcctggcctggagccgttcacgctcaccggcgatcacatcgtcgatgcgttgccggcgatcgtctatgccgatttcacccgcctggccaagtactacgactttatctccgtgggcagcacccgcatcgccgatcggccgtgtgaagtgctgcgcgtggtggcgcgcgacggttcccgctacagctatatcgtctggatggacgaggacaccaagctgccgctgcgggtggatctgctcgatcgcgacggcgaaacgctggagcaatatcgggtgatctccttcgcggtcggcgccgacgtgcagggcgcgatgcaggggctgctcaaagccaacctgccgccgctgctgtcgctgccggcggtagaaaacgtcaagctcagctggagcaccggctggctgccggccggggtggacgaggtggcgcgcaatcgccgaaaattgccgaacgtcgccgtgccggttgaatcccggctttacagcgacggcctgttcagcttatcggtcaacgtcagcccggcgggcagcggagccgggcagcaatactaccgtcaggggcgccgcaccattcagaccgaagtgcgcgcgggcaacgaaatcactatcgtgggcgaattgccgccgggtacggccaagcgcatcgccgacagcatttctttcaagggcgtagcgctgctgcgctgtgaacccaaggccggctgcggcagctgcaccgcgc

SEQ ID NO: 42097 - DNA, 707 bp, Glycine max
  Peptide Sequence Number=SeqID_133782
atgcaggaaatccaaaagaataatgactgtccccatttgctttcccgcgggggatatgatttgctagaaaagaagctgttagacgagaaaatcaagaaaaggcaacatgacgcattgatgactgaaaatccagcactcattgaggacctcccatctcccattcaaagacatgtcaagtggaagatggcacgcacgaaccgatatgggatgatgacatctaaggctgctagacaaattgctgataaaattgactcgttgaaagaacaagtgacacagggtgagtttgtcccccagggtcgtcaagatatacttaacacgaccataggaataccagatcatggaggtcgtgttcgtgcagctgggtctggggtcacaattagtcaatactatgggaggacatcacgtgcctcaactacctcatccatatcattcaccaaagaacagttagttgaaatagtagtgaccattagggaacaagtcaggaatgagattgaagaagaaaagaagcgaagtctacacgcttggaaaaacgagctgaaggatgccatcattactgacatatttaacggagataaggtctcagcaccggctaattttgacttaaatgtgttaggtgcacgcgtgagcactaaggagagcaatgctgaaattgttgtgaacccttctggggaagaacatgttggtcgtgtaacaccgcctatggggtt

SEQ ID NO: 42098 - DNA, 258 bp, Glycine max
  Peptide Sequence Number=SeqID_133783
ttgttgaaggaaggagctcaaagtattaagaaccttgggatcagaggtcaaatcctttccaagggggaggggatgatgcaatcctaccccccaagggtattggatagaagacttcaaaaggattgggctagagctgctaaagaaggccctagggttctcatgaacctcaggatgaatggtagtggaatggagaaggaagagagagaggagaccccacttcaaggagaagatgagtctagaagaagctcaccaccatag

SEQ ID NO: 42099 - DNA, 207 bp, Glycine max
  Peptide Sequence Number=SeqID_133784
atggcctatgccccattaggcaactctacaaagttccaaactccgttactgatgatcttcttcatgaatggattcctttgcttcttggaagatgaatggcagcggaaggagaaggaagagagagaggagacgccacttcaaggagaagatgagtctagaagaagctcaacaccatacgaggccatggataagagcttggaggaataa

SEQ ID NO: 42100 - DNA, 225 bp, Glycine max
  Peptide Sequence Number=SeqID_133785
atgaagccttgcttctacatgttcttccaccacctttgccttccccttaacgtttgcgggttgtgtcggcaggtcggggggtgcaaacacgcgaccgctgtgggtcacaccgctcagccccgtgatattggtttagctatcggccgagcgggtcgtggttggagccggagcttgggaggcctccctctggatgggggcgggcgctctaggctgtgcgggtgctga

SEQ ID NO: 42101 - DNA, 132 bp, Glycine max
  Peptide Sequence Number=SeqID_133786
atggctgtgatatctctcgggaagatctaccaacctcctttcccaaagtggtataaccccgatgcaacttgcgcataccatgggaaaatcccgggccactccacggaaaaatgcttggcccttaaatacaag

SEQ ID NO: 42102 - DNA, 417 bp, Glycine max
  Peptide Sequence Number=SeqID_133787
atgacccaagagctggtagcccgcggagacaccttacggttatccgcacctcgtcattcagtgaccccaagtgtgattgacgagcggaggccaatgtggtcatctgtgccctttccggagatgtcagcattttccgatggagacttttcaagtctcacaaaggcggcgggcccgatgatacgcggagataccttacggttattcgcacccttttgtcatccagaggcaagcagagaccaagtttggtcattctgcacccttgtatcatccagaggcggcgggcccgatgatacgcggagataccttacggttattcgcacccttttgtcatccagaggcggcgggcccgatgacaagcaaagaccaagtttggtcattctgcacccttgtatcatccagaggcggcgggcccgatga

SEQ ID NO: 42103 - DNA, 282 bp, Glycine max
  Peptide Sequence Number=SeqID_133788
atggatactcgggttacaattagctattgcagtacagcaagaaaagacagcttactcacattgtgttttgtatcccatgaaatccattcgggttatgtaagcgcactttccaagatagtaatttacctgatggccttaaatattatgctgactgggagtcaccctggtcatgctgaatatggcatacattttttaaaggtcattcagagtgcagataacatctcaactggttcggagatgtgtgacaagatgaggaggctaaggatattgtgttgcaattga

SEQ ID NO: 42104 - DNA, 219 bp, Glycine max
  Peptide Sequence Number=SeqID_133789
atgccttccaaggttattttgatgatgccaaagaatcaagagttaagcaaagattcaagaatcaagtttcaagtttcaagtttcaagattcaagattcaagtttcaagtttcaagattcaagattcaagtttcaagatttaagaatcaagtttcaaagatcaagattcaagactcaagattcaagaatcaagagaagactcaatcaagataagtattaa

SEQ ID NO: 42105 - DNA, 375 bp, Glycine max
  Peptide Sequence Number=SeqID_133790
atggagagaagtatgatagatgctgccagtggtggagcccttggagacatgacccctgctgaagccagaaatttaattgagaagatggattccaagtccctgcaatttagtgccagaaatgatgctattgtcattagaggagtgcatgaagtagccacaaattcatcttcatcgggtgagactaagaagcttgaagtttatgctgcaaacatctacaacagacctcctcaacctcagcagcaaaatcagccacaacagaacaattatgacctctccaacaacagaccatatgttcctccaccaatccagcagcaacaacagcaacagcccaataaacaacaaacagttgatgatgcaatcctccctaggaaatga

SEQ ID NO: 42106 - DNA, 549 bp, Glycine max
  Peptide Sequence Number=SeqID_133791
atgaaagaaagtccgagctctaaagttagagttagggaagggcgagactcgcccaaggagaagttcaaatcagctgctacacacatccggaaggagtgcacccgatgcacgaattgtctgttgtttacccgctcttgtgtgtggttagtttcacacctattccaacaagacacaagacacccgtgtccgcttcaaagctatcgctcatgcgccgaaaaaggaagagtcgattgggaccaacatttggctggaataggaggcaacgcaatcaattggtttcctcgttggaagaaaggcaaggaaggagttctcttctcgtgtggggactaccctaatgttccattgatagggactaggggttgtattaattataatcccgcacttgccataagacagctagggtaccccatgaggggagcgccaaccgaagaaagtctctcgcctttccttgtgagggatctaggcgctcaaagtctcaaggtgatacaaagagtccacaaggcatggagaagtccgttgaagaaagacaaggagcttagaggcatctga

SEQ ID NO: 42107 - DNA, 447 bp, Glycine max
  Peptide Sequence Number=SeqID_133792
atgacgttgctacttagcaacattctgcccaacgaccacaatgccgatctccccttgcggaagtatcagttgggatcgcgcccacaagacacccagtggacccggagaagtccaacagggcctcggggtttccagctctggttatgggcctttgtcagtcctacagggtgcccgtccccccagcaagggatcgcgcctgcaagacacccagtggacccgaagaagtccaacagggtcctggggtttgcatctctaattacgggcctctgtcagttctacggagtgtccatcgcccccagcaaggtcatcaggccccctattaaccggactttcatcgagaagtattgcgcccctaagcaggcgcatggcaaggcatcacagcagtgggcaacaggcgcaccgccaccacctctagagttcacctcagctcatccacaaaaaggttag

SEQ ID NO: 42108 - DNA, 113 bp, Glycine max
  Peptide Sequence Number=SeqID_133793
ggagtgatggctggacgaaatggtcgtgcgatagcggatgcccttccagccttagcacaggctatagggaatccaaatagaagagaagctggtggagttgttgagtaccgggg

SEQ ID NO: 42109 - DNA, 405 bp, Glycine max
  Peptide Sequence Number=SeqID_133794
atggtctctccagagtctgctagggttgagacagtccagtgtcgtggaccgtacgtacgcctgcaatgggtacatgatatatatcagcgccgatgccaggcaggtcattggacagttgcggctcacgtatatcttcttcacctactgggttgcactctgtttgctaacaagagtgcaaccaatgtccacgttgtctacttgcaggcccttggtgacctcagtatgacagagaggtacgcttggggagtggctgctttggtttatatgtacgaccatctgaacgatgcatctatgagccacagccgacagcttggcggttacatcacactgctgcagtgctggatttatgagcactttccctcggtcgcggagtccactgctgatcaggactacggcgaggcttct

SEQ ID NO: 42110 - DNA, 345 bp, Glycine max
  Peptide Sequence Number=SeqID_133795
atggtcagtacagagtctgtgatcaccaatttaaattggtgtttattggggttactgttgtttgctggatttgcagatattgtggctggccagtttgaacctgggctattggttgatgttattggtgttgtggaggaggttgtctttcgccaagtttcaggaaaaggtagaagggtagtctttaaactaaatgacttgagtcagcaattgctatcttgcactttgtgggatgattattgcttgcagtttttaaagttcttagatgattatgaaggtgatggcccaattacagttctattgacccatggtagaataaaggaagctcagggtatatccttatcttga

SEQ ID NO: 42111 - DNA, 228 bp, Glycine max
  Peptide Sequence Number=SeqID_133796
atgtctaaagcacgtcaaaagggggtacggaaagaaaatagaggaggagcttgccacccagctcgcccaggtgagccaggttgcttcctccagaagcaaccgccttctggaggaatattctggaaggcccaagtgggcctgaaactcacggattgcgtaacaatacttccttttgatttccgacatgttatggaatttcacggattgcgtaacaatgcttccttttga

SEQ ID NO: 42112 - DNA, 298 bp, Glycine max
  Peptide Sequence Number=SeqID_133797
gaaatggccccgaggaagcttgcctcaaaagagatccaggaaggataagacggccgaaggaactagttccgctcctgagtatgacagtcaccgttttaggagcgctgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgtgatctacgaacttttaagtgaaaggtttgggagttgtatttatgcacggggaaggtattag

SEQ ID NO: 42113 - DNA, 285 bp, Glycine max
  Peptide Sequence Number=SeqID_133798
atggcttacacccacattccggtgaaagttgaaaatcctggtgagatttacacacaattctcctcaaatttcagccagcatcaattagacctcgcaccctacacttcagagccctacaatgctcaatggaacgccccggggcttctccgtgacaagcacacgttgcgttcgagtcgtattctcggagaaatggaggttgatgaaccttggctagggttatggctaccattgaattatcaagtggtcttcgtcattggaagtgcggtagacagactttgtggttga

SEQ ID NO: 42114 - DNA, 627 bp, Glycine max
  Peptide Sequence Number=SeqID_133799
atgaggggttgcattaactacaatcctgcactttccataagacagttagggtaccccatgaggggatcaccgacgaaagaaagcctgtctcctttccttgtgagagattttggcgtgcaaaatttcaaggttatacaaagtgtccataaggcgtgggaaaccccgttaaggaaagataaagaacttaggggcattcgtaatggcatcattggtggttatcatgaatggctgaaagttcgtacacgggacgttcggaaagagtgtgccgggttacgagaagaaaatgcagctaccgcaagggcccttgaacaagaaaccaagagggctcgcaaggaagagcatggccgtgacaaatttcgtggagctttatggggtagcaacagtgagctcaagcttcgaagggaagagagagaccaatcacgagcacatagcatggtcttcaaagaggagttagctgcttgctcaaggtccaaaagaagcttgtctcagcgtttatgcgagacagagaccaacatgttagccatcgtcagcaagtaccaagaagagctaagtctagccacggcctacgagcataaagtggcggacgagtatgcccgagtgttcacggaaaaggaggccagaggaaag

SEQ ID NO: 42115 - DNA, 537 bp, Glycine max
  Peptide Sequence Number=SeqID_133800
atgcagagaaggccttttgcaggtgttttgattcccatagacttggaaattaacgcaacttgcaggaaaaggaatgcagaaaggaataggatgtttttgcaggacattgaggcagcagcaattcaggaagaacctctatcttctgaggcatcttctagattttcaaaacaaggggaatctcacatagtattatttgaagccaatatcatggctgatgagccaagaaaccccttgaagattactctagctcaagtgtaccgcagttctttactagcattgtgtggccggagggaggcaaaaagatggctccattcatttaaaggtaacaatgttaagacttgggatgaagtggttgaaaaattcttgaagaaatacttcccagagtccaagacaattgaaggaaaaactgccatctcatcctttcatcaatttctagatgagtccttgagtgaggctttggaaagattttgtgggttactaagcctactcatggattttcagaacgaatccagctcaatattttcattaacgggttaa

SEQ ID NO: 42116 - DNA, 257 bp, Glycine max
  misc_feature (252)..(252): n is a, c, g, or t
  Peptide Sequence Number=SeqID_133801
atgtgtcatcttgctaaacctatccaccaccacaaagataaagtctacacccctctaggtcctaggaagcccaaggacaaagtccatacttatatctacccaagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcanaggcg

SEQ ID NO: 42117 - DNA, 354 bp, Glycine max
  Peptide Sequence Number=SeqID_133802
atgacaaaattgaagaagaccttgtctcctaaaactaaggcagttgcaccaaagtggattgaagtaaagagtcacgttcaaactgactgttatgaatgtggatattacataatgcattggatctggaacatcataaccagcgacataaagagtgattggtccatgcaacaatttagtgcagctatagtaccaccaagcttgccactgcagcagttaagtgaacaaatgaagtgtccacagtcattggatggttgcttggtagagatgatattatcatttgaccttgcttttgctttgattccgctcctaaagttcagtagcagcaaagtgactagcagcacaagcattgaagag

SEQ ID NO: 42118 - DNA, 324 bp, Glycine max
  Peptide Sequence Number=SeqID_133803
atggagaatgagtcatctgaggccaccatcctagagccatttgatataggagaagaggcagaggagacacaggtgagacaagtagctgctaccactcttgagcgatcccttgaggctacttcagagccttctgcaccagtggtaaacctaccctcacctcaacctgcagtagacccctccaatcctcttctacagatgctagaggacccaactacaccagtcctagctgtggacacttctcctcccactactccagtgcttcagttgacagatgagagggatggtcagacacaggacacacaggaccagtcacaggaattttga

SEQ ID NO: 42119 - DNA, 807 bp, Glycine max
  Peptide Sequence Number=SeqID_133804
gaggccatcgcccatttgctatgtataccggggcaggattttgcccggactgctgccgggagacgggtgcggatcatgcacaccaacatgaccaccttgactcagatctggatgactttgctgctcagcaacatccagcccagcgatcataattccgacctccccctgccgaagtgtcagctggtgtatgccatcctgacacggatgagcattcacgtggctcagttaatcgctgatgccatctatctatttgcaggtatggcgcctaccaggcaccctctggacccggataagtccaacagggctctgggatttcccgccttgatcacaggactctgccagttgttcggagtccccgtcgcacctagcaaggtgattcggtcgcccatcacccgagcttttattgagaagtattgcgcacagagacaggcccagggggatgctccgcaggccacagacgcgccgccacctcatcaggctggtccagccggatcgtttgatacggagcagtatttgcggcatttggttcgccagcaggcagccaaccaccgggctcatgtacaaacccatgattgtctttaccagatgagcctcagcctgcagagccagggttttacttcttttccatgccctactccgaaccagttcagggcagaggtcgcatggcctggagattggcctgaggcccgggcaggagaggcgccagcagtggcaccagcagaggctcccgacaaggaaaatgaggcccgcgaggatgaggagatgaccgatttacttgatttcttaggagggagcggggccacatga

SEQ ID NO: 42120 - DNA, 586 bp, Glycine max
  Peptide Sequence Number=SeqID_133805
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42121 - DNA, 174 bp, Glycine max
  Peptide Sequence Number=SeqID_133806
atgtcagccagtgatcatgtcattctacgagacaaaacccatcaacccacgaagaaaagcttgatagagctatcatcacatgacggtttattggcacagaacaagtttctttctaagcaacttgagattttaacaaaaacactcggttacagggtaccgagctcgaattcgtaa

SEQ ID NO: 42122 - DNA, 415 bp, Glycine max
  Peptide Sequence Number=SeqID_133807
gttgcagggtgtgccatttgtggtggagctcacaattctggctgctgtatccccaatgaagaaccagctcatgaagtcaattatatggggaaccagccaaggaaaaatttcaatgcatgtggatattccgggtttcaacatggccagccatataattcacagcagggacagtggaggaatcaccctgttggcggataggccgtcaagcagctttagtgctaacactgagaagaatctgaaggaagaatgtaaagttgtaatgacaaggagcagaatgacagttcaggctaatgaaggtagagctgaagagaaggaggagggatataaacaacagtcggcagctgagccagcactagaactagtgtctgactttgttgaacttgaggaagttgtggaagatgaagatgaccaatag

SEQ ID NO: 42123 - DNA, 660 bp, Glycine max
  Peptide Sequence Number=SeqID_133808
atgccggttaaatcagaagtgtgcgatacgcgcacctggcttgagcacaacaagggctactgcaacagccgccagctgcacaaaaccatcgtcagtgacaaagggcgcgcggtgtttaacggcctgattaacgtggcgcagcacgccattaaaaccgacgggcagatgaccaataacaacctgctcctgggccgcctggcggaggtggacaccaaaccgcagctggagatctatgccgacgacgtgaaatgcagccatggcgccacggtcggaaggatcgatgacgagcagatgttctacctgcgttcccgcggtattgaccagcaggcggcgcagaagatgattatctatgcgtttgccgccgaactgacggaagcgctgcacgatgtcaacgggctgccgctggcctatctggacagcgccgccagcgcgcagaagccgaatcaggtggtggatgcggaggcggagttctatcgccacggttacgctgccgtgcatcgggggatccataccctgagcgcggaagccacccagcgcatggagaacgtgcgcacgcaggtggccgcctttctcaatgcccgctcgcccgaagagctggtgtttgtgcgcggcacaaccgaggggattaaccttgtcgccaacagctggggcaacgcccag

SEQ ID NO: 42124 - DNA, 222 bp, Glycine max
  Peptide Sequence Number=SeqID_133809
atggatcaagctggcgaggaaaggaagttgcaactgagtgagttagatgaaatccgcctagagaagcctacgagaatgccaattgagatcaaaagcgactccacaaacaagagcttcaaggtcaatggacatcgacttaagccattcctcacgaacccttctttagtggacgtagtggtggaagagacttccttactccaccctactcttcctccaccatga

SEQ ID NO: 42125 - DNA, 222 bp, Glycine max
  Peptide Sequence Number=SeqID_133810
atggtgatgagcttcttcttgactcagcttctcctcgaagtggcgtctccaatcatctttcttccttccccattccgcttccatgatcttcaagaagcaaaggactccattgatgaagaagatccaaggcctacaagctccacatggagctacatcatgtggtatcaagagcatcttcatctaggttctatcattttttcattcataatattcttgtgctga

SEQ ID NO: 42126 - DNA, 672 bp, Glycine max
  Peptide Sequence Number=SeqID_133811
aagaaaaagaaggatagtaaggccttgtcttcaaaggccaaggggaaggaaacggaggaaaaggattcctcaaagaagattgttaagaaggaaaattattttacaacaaaaggtgatattaaaatagcactccttcttaaaaaatctttctaccttctcctatcaagggaaacatcccttagcaccgctatacctcttgagcttgaggttattcctcaagtaaaggagttgttggatgagggtattactaggcaccaaatccctatgataggtggtatgatgaatatgttgagtggtacaacactcttttgtaaaatcactcatgcacccaacatcttcatggtttgtgtacatagggattcattaggtagtgatcaagggcttcccatggaccctaagagaataaaggtcattcctgagtggcctactccaccaacaccactcattgagttggtgaggaactatgttctcttatgggaagatggccaggaaaaaggttttcagtccttaccgtactctaagttacccaacatcactaatacatatgtttttactcctcttacatgtgatgaggaaagaatcaatgagtttcaacagcctctagatttgaggtcaaatccttttcaagggggagggagtgatgcaatcctaccccccaagggcattggatag

SEQ ID NO: 42127 - DNA, 156 bp, Glycine max
  Peptide Sequence Number=SeqID_133812
atggaccctaagagaataaaggtcattcctgagtggcctactccaccaagtgttgaggaaagaattaatgagtttcaagaaccttgggatttgaggtcaaatccttttcaagggggagggaatgatgcaatcctaccccgcaagggtataggatag

SEQ ID NO: 42128 - DNA, 210 bp, Glycine max
  Peptide Sequence Number=SeqID_133813
atggcctttgtggataactgggtggtgggtaaggaggaggtttgttattggctgagtaatgacattgttgggatgactaaatttgccttggggcagacccacatcgatcctttcactggcaaagaccaaatcctcaaagctttgaaggttctccacctttgggcgtattctttgaaagatttgtgccccctttttgcacatgttctgtag

SEQ ID NO: 42129 - DNA, 379 bp, Glycine max
  Peptide Sequence Number=SeqID_133814
atggagacttttcaagtctcacaagttatccagaactacgtaggtcatgtgacgtgcacccttgtatcatccagaggcggcgggcccgatgatacgcggagataccttacggagaccaagtttggtcattctgcacccttgtatcatccagaggcggcgggcccgatgatacgcggagataccttacggttattcgcacccttttgtcatccagaggcggcgggcccgatgacaagcagagaccaaatttggtcattctacacccttgtatcatccagaggcggcgggcccgatgatacgcggaaataccttacggttatccgcacccttgtgtcatccagaggcggcgggcccgatgatacgcggaaatacccgagtg

SEQ ID NO: 42130 - DNA, 177 bp, Glycine max
  Peptide Sequence Number=SeqID_133815
atgtcgattattgtattttgtattcaattcctgaataataatgggatgatgtctaataggaaatgttcgatcggcgtcatccggctaaaggcccaagtggagaaggacgaaggcccaagtggagaaggacaaagcccccgagtggagaaggatgaaggcccaagtggagaaggatga

SEQ ID NO: 42131 - DNA, 189 bp, Glycine max
  Peptide Sequence Number=SeqID_133816
atggctgttgattacggcggcaccgaccatcccacccacgatggcaatcagggcataggaaacaacagaacgcatagaaactctccggcatgcactgcgcgcgagttgaaaaatagctggccggaaaaaccagcagtcaccagggaaagggatgcacagcagatgacagcgcctcatcgtgtgggttaa

SEQ ID NO: 42132 - DNA, 808 bp, Glycine max
  Peptide Sequence Number=SeqID_133817
gacgccgccgcaccaccggggcgccgccggcgcggatcgacggcggatggcaggagatcctcgacctgatggcggatcagggtcgccgccccgatccgctgctgacccgcgccgagacggccgcgcggctggatgccgagatcccggcgatgggcgcgccgctcctggcgagccgcgcggaccgtgcggtgttcgggccggatgatctggcggaggacgtcgccgaggagtactggacgcatgtcatggcggcgcgacgtagcatgtcggctgcggaagcgggtgcgggcacgcgcgcgggcccgggcacgggccgagcggcgcgcggtgacgctgcgccgaggacgctcgtccctgcgcggcactgcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 42133 - DNA, 738 bp, Glycine max
  Peptide Sequence Number=SeqID_133818
atgaaaagagaaaaatatgtctcctatagtagtcataactcttgcaagagcctaagtaaagaacttcgtgactattatgaaggaaggcataggtcacatcttagacctcactcccatagaagagaaaaggaaagaaagcctcaagaggctaacattaacctcccatacttccatgggaaggacaatgtagaggctaacttagtttgggaaataagggtagagcaacaacttaaaaagaagtctacatcaaaatcttatggctctcactcttatccaaagaaagaccatggtcgaggcatcttaggggtgacaccttcaaagcccaaagatgataaggggaagacaatagaaaagcaagtccctaaggttagtatgcaagagaaaactagctctataaagtgctttaaatgtcttggaaaaggatacattacttctcaatgccccaccacaaaaaccatgattatgaggggccaagatatttatagtagccaagataaggctactacttcaccttcctttagtgaaagtgaaaaagcaaaaggggaagaatctagtgaagaaatctacccccaagaagaaggacaaccattagtggttaaagagaagtgtaaggaggcacttgctagcattgccacccctcttgggcttgagtttattcctcaagaaaagaagttgttggatgagggtttgcttcgcaagagcttaaatccttgtgctttgttgggacccattaggtag

SEQ ID NO: 42134 - DNA, 318 bp, Glycine max
  Peptide Sequence Number=SeqID_133819
atgactaggggcagtccaggtgatttacaaccctttgatcctgaaatagatagaacctttcatagattagttaggcatagtgtgcatcctgatcattctgtgcattttgagcattctgagtattttgttgctggtgattctgaatattctgattttgagcattcaactactaattttcataatgagaacatggctcaacctccacctcatgagaggactcttaggtggatggttgcacctgatttcacttatgaaagcttgtgcattcaagactggactaatacatttgctggccaagtttcatggtcttgtaggtga

SEQ ID NO: 42135 - DNA, 264 bp, Glycine max
  Peptide Sequence Number=SeqID_133820
atggcgaggacgtatagtcctctaaaggtgagggcgtgtagccctacaaaggtgaaggcacatgaccctttgacggcgaggacgtgtagtcctctgaagttgaaggtacatgaccctttgaaggcgaggacgtgtagtcctctgaaggtgaagtcctctcaaggtgataggtacaagtacccaagggtccacccttatgagaaagcaagagatcgactcatcgagagggccggtcatcccaaatccacaagatttggacattag

SEQ ID NO: 42136 - DNA, 192 bp, Glycine max
  Peptide Sequence Number=SeqID_133821
atggcatatcagcttgctacttcaagaaaaattacagtatctttgacaaagaagtggtacatagatagcggatgctcaaaacatatgactggagatgcatcagattttacacatatatctccaaagaaaagcgggcatgtgttacatatggtgacaactataaaggtagaattcttggagtgggtcaaatag

SEQ ID NO: 42137 - DNA, 321 bp, Glycine max
  Peptide Sequence Number=SeqID_133822
atgatgaacggagatcaatggatgtatgacattataatatctgaagaagttgatttaaatgatgaaaatgaagacgaaggtggtgtgaatgaagaagaacatgttgattgttctgatgcctttaatacttctcagtgggttcaattagtcgcttatgaaattggatttgttgcggtgattatgaggtcaggcataaacactggagtggtcagtataggtgtaggaataaaggttttgttagaagagatattgacagtaggaaatgtgggtgtccctttaaatttcgtgagaaatcagtggttggaggccaaggttggatga

SEQ ID NO: 42138 - DNA, 324 bp, Glycine max
  Peptide Sequence Number=SeqID_133823
atggggctccgaataagatttgatggtggaggatgcacgaacagcgctaggcaatcaattcctggggctccggacttgatggcaatcaattcatggggctccggactcgatggtggaggattcatgaatggcaatcaattcatggggctccgaataagatttgatggtggaggatgcacgaacagcgctaggcaatcaattcgtggggctccggacttgatggcaatcaattcgtgggactccggatttgatggtggaggatgcatgaacagcgctaggcaatcaattcatggggctccggacttgatggtggaggatgcatga

SEQ ID NO: 42139 - DNA, 1032 bp, Glycine max
  Peptide Sequence Number=SeqID_133824
atgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatacctagcagcaatcgacgctttccttgcctaccaccatagcaaggaaagtccggtggaacgaggggttgtattaactaacaatcccgcgctcgctataagacaactagggtaccccatgaggggagcaccgacggaagaaagcatgtctccattccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaagagcgagttaggaaaggcaaaactcgccaaggagaagttcaagttggctgctacacacgttcggaaggagtgtgccgggttacgggaagagaatgcaattaccgcaagagcccttgaacaagagaccaagagggctcgcaaggaagagtatggccggaacaaatttcgcggagctctatggggtagcgatagtgaactcaagttgcgaagggaagaaagggaccagtcgcgagcacatagcatggttctgaaagaggagttgattgcttgttcaaggtccaaaagaagcttgtctcagcgtttatgcgagacagaggccaacatgttagctatcatcgccaagtaccaagaagagttaggtctagccacggcccacgagcatagaatcgcggatgagtatgctcaagtgtatgcggaaaaagaggctagaggaagg

SEQ ID NO: 42140 - DNA, 345 bp, Glycine max
  Peptide Sequence Number=SeqID_133825
atgtatacaatagaatttcaaaaacgagggctacctcatgtccatttgttgctttttttacatcctgataacaaatacccttcctcagatgaaattgatcaaattatatcagcagagataccttcccaacaagatgatctagaactatttatcagaaaataccaagcgcatatcaatattgaatggtgtaaccaaagcacttctatcaaatatttatttaagtacatcaacaagggatatgatagagtgattgctattttgattgatgaagataatgatcaaactgagaatggtgacactcataatgatgagatcaaagaatatctagattacaggtattgttaa

SEQ ID NO: 42141 - DNA, 132 bp, Glycine max
  Peptide Sequence Number=SeqID_133826
atgtcacattcaatgacagcggaatggagaaggaagaaagatggttggagacgtcacttcaaggagaagatgagtcaaaaagaagatcaccaccataggaagccaagccaaaatttcactaattatgattag

SEQ ID NO: 42142 - DNA, 501 bp, Glycine max
  Peptide Sequence Number=SeqID_133827
atggtgaaagttggaacctcttacgtgccgatcaacgtctcatttcgccaaaagttggcccagtgtgcttcggtatcaacagggagcatccaggattatctttattctgaagtgaggaaatcgttccgatcacagattggagtatttattcggcgcaatagcgcccgctttccattcgggaaacctgtcaggtgcgcaactgttaatgaaggccaacgcgcgggcgagagtgcgggcctcttcgctattacgggcgtaaggcggagtgtgcatactggcttactatgttgggtaactgagagggtgttcccagtcgaatgcgttcatgtgcaggagaaaaaagcgacggtgccagtcagaatatgtaatacgatcactataggattggatccaccgcggtggcggccgctcactgactcgctacctcgggctgcggaattcgagcggaaatgcttaaaggatttgctggaagagcatcggaagatacttaacaggaagtga

SEQ ID NO: 42143 - DNA, 455 bp, Glycine max
  Peptide Sequence Number=SeqID_133828
atgccaatcaggatccccgacgaattaccggcagtgaattttttgcgtaatgagaatgtctttgtcatgacctcatcgcgcgccagtgttcaggagattcgtccgcttaaagtgttgatccttaacctgatgcctaaaaaaattgaaaccgagaaccagtttctgcgcctgctctctaactcgccgctgcagatcgatgttcagctattacgcatcgacagccgcgagtcgcgcaacacgccaagcgagcatctgaacaacttctactgcaacttcgacgatatcgccaacgataactttgacggcctgattgtcaccggtgcgccgctggggctggttgatttcaatgatgttgcctactggccacagattcagcgcgtgctgcactgggcgaaagagcacgtcacttctaccctgttcgtttgctgggcggtgcaggcggcgcttaacatcct

SEQ ID NO: 42144 - DNA, 195 bp, Glycine max
  Peptide Sequence Number=SeqID_133829
atggcaaggtttttgcatggtctcaatagggagattcaagacattgtagagttgcaccactatgcctctgtggaagatctcattcatcaagctatcaaggactatggttgtattggggtaatgggaatatcattagtgcttcttcttctagttcttctagtgagagtgaaagtgaatgtgatgtacagcccctga

SEQ ID NO: 42145 - DNA, 507 bp, Glycine max
  Peptide Sequence Number=SeqID_133830
atgacattgaccatcccagagcttttcttgaggccttatcaggttatatgggatgccatcgtgttcggggttgttaatccagatttccccctctacataaagcacgaagacctctccgaaatcgcacacggtggtcaatgtctcagcatatcagtgttacagttgtggattctgcatctcactgaaacatgtatgcgagtggggaattctgatatctatggattcctcgagccacagtccattcagaggtctgggcaatcgcagtttgagtctgaaagttacataaagagttggatgcagagttcacaacgcgatgtctatcttggagcctacctaaatggtgctattaagggtcttgatgatgctccacagcctaaatcaaaggcttctgctaggtggattgtcgtcaagtgtaatagacaaaaaggaagtactgagtgcggctactatgtgatgcactggatgtccaccatcattttaggaacttttaggaataattgggaagcg

SEQ ID NO: 42146 - DNA, 300 bp, Glycine max
  Peptide Sequence Number=SeqID_133831
ggagcttgggagaccctcgaaggcaacacgaggtgccgattttggggcacgattcgatttacggctacttcattggtgcatccagatgaacccgtgcgcacgctccagcgtactgtggagtggatactacccacgcctacaccataccgtctagtggagccagtccaagtgatcgagggtgatgaggacccactccctgaggtggattctcccgaggacgtcatgtcggcatctgaggcagactctacggaggatagtggtcctggagagatggcgatcagtggaggctcttcatcatag

SEQ ID NO: 42147 - DNA, 381 bp, Glycine max
  Peptide Sequence Number=SeqID_133832
atgggcacgtacagtgaatgggatgaagaaaagaaactggacttcttaactagagagttgaaagggaagagaccactggttcctcccagtatagaggtgagattgttatacatagcaaagctttacaagctctatatccaagcttccaaggagatcactttacaaaaaaagatgagagagaaagagagagagagagggagagagacagagagagggcgcgagagaaggagagtgacaaacagagacagaagaaatgagagatggagcgaaacagacacggcgaggacgagtgtgaagcagtatcgaaacacggcgaggactagcacaaacagaagaactccaaacggttccccttcaaggagatggaggagtatggattga

SEQ ID NO: 42148 - DNA, 341 bp, Glycine max
  Peptide Sequence Number=SeqID_133833
tcgttcggagtccccgtcgcacctaccaaggtgattcggccgcctatcacccgggcttttattgagaagtactgtacccagagacaggcagccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagggacacccccagaagctcccggcgatggagaagaagcccacgaggatgaggagatggctgatttgcttgacttcttgggagggagtggagacac

SEQ ID NO: 42149 - DNA, 126 bp, Glycine max
  Peptide Sequence Number=SeqID_133834
atggaaacaacgatgatggaggcgactgaatggtggtgcggcagcgctggcaatggtagtgacgataacaatggtggaatggtggtggtggcgacaacaatggtggagaggtggaatagtaggtag

SEQ ID NO: 42150 - DNA, 487 bp, Glycine max
  Peptide Sequence Number=SeqID_133835
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatacttgaaggtgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 42151 - DNA, 363 bp, Glycine max
  Peptide Sequence Number=SeqID_133836
atgacgactctttgcaaatccaaaggaaggaaatccgaacatttccataaggattacctaaagtgcaagtcttggttcgaaaagaaaagtgagcttaatgctcgtagattccttacaatccaaaccataagcccaaatgagaagtttattttcatggggaatgaagtgaaagttccagtgaaaatagttgagacttattgtttaaaacgcaacactggacatcatttagatttacaggaaactccttatgaaaaacaagcaaaacatacaaagaaaggagctacaagaagcactcagcttcttgaaattgtgcatactgatatttgtggaccttttgatgttagttctttcggaaaggaatga

SEQ ID NO: 42152 - DNA, 854 bp, Glycine max
  Peptide Sequence Number=SeqID_133837
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagttccaaatcccagtactggaatcgtaatgccgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 42153 - DNA, 177 bp, Glycine max
  Peptide Sequence Number=SeqID_133838
atggccaggaaaggggtgttgaggaaagaatccatgagttccaagaacctctggattagaggtcaaatccttttcaaggggaagggaatgatacaatcctacccccaagggcattggatagaagactccaagaagattgggccaaagatgcaagagaaggccctagggttctcatga

SEQ ID NO: 42154 - DNA, 426 bp, Glycine max
  Peptide Sequence Number=SeqID_133839
atgattatgaggggtcaagacatttatagtagtcaagaggagactacttcttccctttcctctagtggaagtgaagatgaagtaaggggtgaagagtctggtgaggaagtctacccccacgaagaaggtgacctcctaatggttagaaggctccttggaggtattatgaggcaccaaatccctatggtaggtagtatgatgaatatgttgagtggtgcaacccttctttgtaaaatcactcatgcacccaacatcttcatgatttgtgtacatagggactcattaggtagtgatcaagggcttcccatggaccctaagagaataaaggtcattcctgagtggcctactccaccaagtataagggtacctagagtagtttttgtattaggatttttcagcccttgtattttagggcacctagactag

SEQ ID NO: 42155 - DNA, 990 bp, Glycine max
  Peptide Sequence Number=SeqID_133840
ctgattgtgctggccggcaaccatgattcggtcgccacgctgaatgaatcgcgcgagctgctggcctgcctcaatacccgcgtcattaccagcgccacgcccggcggcgagcagcaggtgctgacgctgcaacagcgcgacggcacgccgggggcgctgctgtgcgccattccctatctgcgtccgcgcgatattctgcgcagccaggcgggtcagtccggacgcgataagcagctgtcgctgctgcaggcgattgagcagcactatcagcactgttatgccgccgccgtggcgcagcgcgaagccatgggcagtacgctgccgatcatcgccaccgggcatctcactactgtgggcgtcagcaagagcgattcagtgcgtgatatctacatcggcacgctggacgcctttccggcgcaggctttcccgcctgccgactacattgcgctgggccacatccatcgtgcgcagcgcatcgccgacagcgatcacatccgctacagcggttcgccgattgcgctcagttttgatgaactggggcgtgagaaaagcgtattcctgctggaatttagcacccggctggagtccgtcacaccgctggttattccgtcattccagccgatgcagatgttaaaaggcgccatggcggagattgaacagcagctgaccgcgtttcacacctatgaaggcgatctgccggtgtggctggatatcgaaatcactactcaggagtacctgagcgacctgcagcgccgcatcgaacagcttaccgacgcgctgccggttgaggtgctgctggtgcgccgcagccgcgatcagcgtcagcgcagcctggcgcggctggaaaacgaaaccctgagcgaactgaaagttgaagaggtatttgcccgccggctggcgctggaggagcagctggaggatgaacagcgcgcgcagttaacgcagctgtttcgcagcacgctggcgacgctggaggatccgggcgcatga

SEQ ID NO: 42156 - DNA, 288 bp, Glycine max
  Peptide Sequence Number=SeqID_133841
atggtggtcatcctgcccaaggaacacctagttgtctggttttgttcattgcataacaggccagacaactaccttaaggggattattaatagtgctatcaaaggtcttgatgatgcttcacagcctaaatcaaaggcttctgctaggtggattgtcgtcaaggcacgaacttttaggaataattgggaagcgtattttaactatcctagaccattggagccagagagattaaaagcattgtggatccagtgggcacaaatttatctccgagttagagatcaggcctag

SEQ ID NO: 42157 - DNA, 228 bp, Glycine max
  Peptide Sequence Number=SeqID_133842
atggcctctggtaatcgattaccaaggatcgcgatggctgcgcaattaatccatgaccgagtggagatggagtgcctagaaggagtttgggagaccttcgaaggcaatgcaaggtgccgattccggggcacgattcgattcacggctacttcattggtacatccagagaaaccagcacgcacgcttcagtgcactgtggagtggatattacctacacctactccatag

SEQ ID NO: 42158 - DNA, 687 bp, Glycine max
  Peptide Sequence Number=SeqID_133843
agaggaagtgaggcactagaggaagacgaagaggtgcaggcccttagggcggaactcgagcaagcccaaacagttaaagaaaggttcaaatcagcagctctgaaaatccgaaaggagaataccgaactgagagatgtaaatgtggctaccaccaaagtcttggaacgagaaaccaagagggcttgtagggaagaacacggccggaacaaattccgaggggctttgtggggcaacaacagcgagcttaagctccggagagaggaaagggaccaatcacgagtagatagtctgatcttgaaagatgagttgaaggtttgctcaaagtccaaaagaaacctgtctcagcggttatgcgagacagaggccaacatgttagctatcgccagcgagtaccaagaagaattaaatctagccacggcccacgagcaaaaagtggtagacgagtatgcccgagtgtatgcggaaaaggaggctggaggaagggtgatcgactcgttacatcaagaagcaacaatgtggatggaccgatttgctcttaccttgaatgggagtcaagaacttccccgattgctagccaaggccaaagcaatggcgaacacctactccgctctcgaggagatccacagacttctcagctattgtcagcatatgatagacttgatggcccatatgattagaaaccgctag

SEQ ID NO: 42159 - DNA, 631 bp, Glycine max
  Peptide Sequence Number=SeqID_133844
cctcaccattagaggactacaggtcctcgccttcagaggactacacgtccttgccttcagaggactgcacgtcctcaccttcaaagggctacatgccctcccctttagaggactacgcgtcctcgccttcagaggactgcacgtcctcgccttcagagggctacacgccctcgccatcagaagactgcacgtcctcgccttcagagggctacatgccctcgccatcagaggactgcacgtccttgccttcatagggctacacgccctcacctttagaggactacacgtcctcggcttcagagggctacatgccctcgccatcagaggaatgcacgtcctcgccttcgtagggctacacacccttgaaggacaacacgtcctcgcctccaaaggaggactacacatcctcgccttcagaggactacacgtcctcgccttcaagaggactacacgtcctcgccttcagaggactacaagccctcccttcagaggactacacgtcctcgccacttcagaggactacacgtcctctgccatcagagggctgcacacctctcaccttcagagtgactaccatcctcaccttcaagagaatttagcacgtcctcattcccttcagaggatgctctaa

SEQ ID NO: 42160 - DNA, 237 bp, Glycine max
  Peptide Sequence Number=SeqID_133845
atgagggacggcaagaggtcttcatacgtcattaggattggggtgaattctggagttggcctcgggggaaagttccttatcgcgttggaaccggcgccaaagtgggcgttgccggccgggcgagtcggggttggagctggagcttggggggcctccctctggatgggtgcgggaactctaggttatacgggtgctgaattggaagagtccccggcgcgagctgagaagctcaaatga

SEQ ID NO: 42161 - DNA, 254 bp, Glycine max
  Peptide Sequence Number=SeqID_133846
atagaacctttcatagattagttaggcatagtgtgcatcctggtcattctgtgcattgtgagcattctgagcattctattgagggtgattccgaatattctgattttgagcagtccactactaatttttatactgagaacatggctcaacctccacctcgtgagaggactcttagggaaatggctacacctgacttcacatcattgttgcatgtgtatcatggaaataatgtgggacatcccctttatccctga

SEQ ID NO: 42162 - DNA, 710 bp, Glycine max
  Peptide Sequence Number=SeqID_133847
ccttaaggagttgggacggttgatggcacctttccaaaggcaagccttccgcaaagtgtacggaaagattttagatttgaccgcagcagaggtatttacggaagctattgtatccctcacccaatactatgaccagccattgagatgcttcaccaagattgcaactgtggtcggagattcggcaagagagttggatcgtatgaagcaaactcgaaatggcttagtgggcctaccgcggaaatacttggaaggcaaggcaagagatatggcaagtcaagaagagtgggtcctgtttgcagatatactagctttgctaatctttggggctgtcctctttccgagcgtggacggtgcgagaagaacagcgcacggatcatctgctgcttaccctctctttgtgtgtggcagcacaatcaactggtttcctcgatggaaggaaggaaagaagggagttcttttctcatgtggggactaccctaacgttccgttgatagggacgaggggttgtattaactataatcccgcacttgtcataagaccgctagggtaccccatgaggggagcaccaacggaagagagcctctcacctttccttgtgagagattttggcgcgcaaagtctcaaggttgtacaaagagtccacaaggcgtggaaaagtccgttgaggaaagataaagaacttaggggcatccgtaatggcatcatcagtg

SEQ ID NO: 42163 - DNA, 321 bp, Glycine max
  Peptide Sequence Number=SeqID_133848
atggctatgcgacacgggggagaccgaattagatcaatacaggaggggtcgaccaaagtgaggaagagcacgatgggagttgacaatgacgcgtgtcacttcctatgtattgtcaagtacaacaatgttgtgtcatgctttaattttgcatcagagatgcattgttacttgtcataccctaatttcgtccggggattattacgtgatgacatgcaacctttggttagtcgctttgagatacttggcgtcctttgttgcacaataaatgaagtcccaagacgtgtcagaaatcaaaaggaagcaggcttgcgcgatccgtga

SEQ ID NO: 42164 - DNA, 213 bp, Glycine max
  Peptide Sequence Number=SeqID_133849
atggcggcagcggcacctgatgaagcagacgttgataatggttatgtagcaattgctgataagttggagagactactgaacctaaggatcatgaccgaaggaacaaaaacctatactattgctgaagaatgtctgagcatcacaagaagctacattggccaaccaactgtaggtcacagatcgaggcgtaggcggcatacgagtggtcattga

SEQ ID NO: 42165 - DNA, 402 bp, Glycine max
  Peptide Sequence Number=SeqID_133850
atggggctcagcttcacgggaatctgttgcggagccactggagacggcagcagaagaaacacgaaaccaaacctcggagcaaccgacagcccaaacggcacaacgaacatgtccgccaaagagaacacgaaagtcgggggagaaggggctgcagtagtgtctcagctgcgtaggcgccaaagagaacacgaaagaaatatcacgtgtccaccacgtgctaccactgacgatacaaagacaggtctggtgacaagaccgtctttgtatggtggagaccatctttgtatggtaatcaagaagatcacgtgtccgccacgtgaaaccagtaactctacaaagatgggtctcaggacaagaccgtctttgtatggtaatcatcaaaagcacgtgtccgccacgtga

SEQ ID NO: 42166 - DNA, 1239 bp, Glycine max
  Peptide Sequence Number=SeqID_133851
atgtctgtggagctgccttggtcaatgaggaccttggacaccatgaaattggcgatcacgatggagacaaccatggggtcgtcctggttgataggcttgatgcctcttaagtctttgttcgtgaaggttatgggaggaaggcttcttggtgattgtatgtcaacacagttgatgtcgatatctaggatggcatggaggcaagcttgttttcctgctcttgttgatgttgacgttcgtgtctttgctagtgatgcctttgtcttcctctttcttctactttgtccctccttctatcagtatcatgacttctgtgctagtcctcttggtggcctaggaggaagtggcggaggtagctttatgggtacttctgcgttgaaagcctcctttagaatagtggttcgattggccatctgggtctcgcttttcatccatgttgctaggaggcttcttgcacaaactatcagtgaacttgccaggtcacagggcaagcaacttgagttgaaacgctcgacaaaggtgtcaaatttgtcgatggacattggagggagtcccccacaccatgtcaatgatgctcctttgagggccattgggaagacgcgacacaagattgcgtcgtcgttggtgcagagattagccttggtgaagaatgcatctaaatgttcgtctaggtcggtagctctatcatatcgctctaagttaagcggtttcaaacctaaggggttggagctctctaaagatgtcttgtatctgaggctagatcacatgctaaccaatggtgaaaagaggccacgaggggctgttacggtggcagaggtgcaagttttagctgtagcaaaatctttcagtatgccaagcggtgacgataccaataccattgctggtggtgttggtggcaatagcagtgttagtaatattagtggtgatggtaataatggtgataaagatgatagtaacagcagtggcaatactaataatagtggtgacagtgacaacgatggtggtagtgtcggtgtcaatgatagtgataacaataatgataatgttgatgttggggacgacaaggatattagtgctaatggtgatgatagtggtgttggtgctagtggtgtcgtaaaaaatagcgatgtctacaatgccggtttcaaaagaccgtgtttgaatgtcgttcattctaagacgatctctccacatgaagaccgtcttaggaataacgttcattctaagacggtcacgacgtga

SEQ ID NO: 42167 - DNA, 474 bp, Glycine max
  Peptide Sequence Number=SeqID_133852
atggtgaagctggagttcaatagatttccttcagctgtgaattggacactgatcataaagcatcaaatagcagttcagtttagtagaaaactatcgtttcttgtcataattaagaggtggtgcctggtgtgtttcctacctggtacacttgctattggtgccactaaaggccttacaaagaaacaggcaatgaaaaacaatatgctgaactttgaagacctacaatatttgaaggaattatatcatcagttgcatgccttagacagatttgatcaacattatcggcgcaagcttcaagaacaggacaattcaaatgctacagaaagagctagtagacatcatccattttctatacttggagatagatacatcaagcatttggtagttgtggttaatgaaccggactcaggcatttatactcctagggacactgtgcctaacactgaggagctgatcgaggatccagaagtctga

SEQ ID NO: 42168 - DNA, 318 bp, Glycine max
  Peptide Sequence Number=SeqID_133853
atgatactagcgtctttgtccaaattcctcccaaagcttgcggagaaggtgaggccattctactggctacttcagataattgattcattcttgtgggatgacaccactggttttgagttgactgaagccaagagtacccctgctcctttacctttcaatagcagaagaggccatcagctcagccctcgtccaagaagatgggaagcaccaaagacccatctattttgtcatacttttagagtcaccaagtcattatcaagaagaaccaccctatcaggcaactattgtgaaagcctaagctggcaggaagaatggtag

SEQ ID NO: 42169 - DNA, 174 bp, Glycine max
  Peptide Sequence Number=SeqID_133854
atggcggaaaatcttcacggaattacccacgaaaacgtttcggacgcgttacggaagcgcctcgacgaaaatgagggaggaacttgccacccagctcgcccaagtgagctaggttgcttcctccagaagcaaccgccttctggaggaacatcctggaaggcccaagtgggcctg

SEQ ID NO: 42170 - DNA, 255 bp, Glycine max
  Peptide Sequence Number=SeqID_133855
atgcgtaaatctaaccggcaagtgtaccgagtcgtgcaagggcaggagggattactgaaggtactggacacggttttggagaactacaattgtttctccgtgcaaagtgttttggagaatgtcaagaagaaagagcaggtgttggatgatttcggggcaagggaggtttcacttattgatttggagttagggaagaagaaggagatgatggagggatggttccatgttattatttgttatttgtatattgaataa

SEQ ID NO: 42171 - DNA, 588 bp, Glycine max
  Peptide Sequence Number=SeqID_133856
atgaatgatcaattggtggcgaggtttaatcggtgttttatagttgtggtggcgtcacgggagatcggtgatgcggtccacgttactgaggatggcctcgttagctggcatggtggtggtgatgaagccagcgtcaatgccgacagagcagtcgatgaggatgaagtcgggggccttgccgccgaatccgagggggagtttgtagcgaggtttggagatgcagaggagttcaaagttggaccagcgcttgtcacggacgagggcttagtcgacacagcagtcaccattcaggacctcaatcatggtgtagttgataaggttctcgaggtcgaggaggaggtcaaggttgcggaggctgacgtcggcgtcgatggcgaccacggagaagccgagacaggcgagggagaggccggtgttggaggtggtggtggtcttgcccacaccatccttgttggaggtgatgacagcgacgtggggtatgatcctcccatgaatgcttgtcaaaagagcatcattgttgggctgatgaaggacctagatgagttgttggaaaggggtattgatgttgtgggtataggcctgacttag

SEQ ID NO: 42172 - DNA, 395 bp, Glycine max
  Peptide Sequence Number=SeqID_133857
gaggaaacgacaaggaagggcgaccgctgaaaatcgtaacggtgaatgagagtgaaaataggagttaccaacgaggacaaagtgtgggggaaggaaagtcgatgcaaagagaagaagaggacaaaaccaccatgccagatctggaaaaagaaaccatggaaaaaggaggaaggggagtggatcttagatctggaaaaagaaacgatgttgagggtgaaactgtatctcgcgatggtggcaccaacaaggaggagatgaagtggttgtcttcaaagtcgcaatcgttagagaaaaagtctttggctggagatgggaaagcgaatattctcgttgtcattcaccttgatttcctcagaatatatacaacgtatatgcctgataaaaagcttaactga

SEQ ID NO: 42173 - DNA, 606 bp, Glycine max
  Peptide Sequence Number=SeqID_133858
atggcggaagaattatcaacggtgattattccacaattgcaagctagttccacaaagaaacgtccttcgaagaacgaaaattggtgcctcgaggactacctcctcctcattcactctcgccaaacgcttcatctcaccatcaatcaactcaatcaggttttcgttcgagaaaaactgctaaaacgtttgtggattagtgcgcagaaggtgctggtagacgcggtggagtcgctggatctggttgatctgccgcggtcgacggtgcaagagagcatgtcggcattcgcagctgtggcgctggaggacgtggtggtggatctgggcgagttgaactggcaggaatgctgcgtcacctccgtcgagaagatcagcttctccaacgggcagagcgtcttccctggttgctccaatcagagcctccacgtcgtgagccactcgcagtcgcaggctcagaaagagaacaggatcgacgaaacccgtgacctaatccctgaggctttcagaagaagcctgaaaccaacgaagatggtgccaaagcggaagaggagcaacgctcgtgactctgttgcatctactgtggattccgcttctctcgcttcgtgctga

SEQ ID NO: 42174 - DNA, 255 bp, Glycine max
  Peptide Sequence Number=SeqID_133859
atgggttttcgtttacccggtatcagaaaagcattatttgcagcaaatctagcatcttcaaaagctgtggatacaccaaagggccatcttgcagtctatgttgcggtctgtgattcctttatcatacttgaaccaatcttcattccaggacttgttgagtcaagcgaggagtttggatatgatcattccatgggtggcctcacaattccatgcagtgaagatgtcttccagtgcataacttcttacttgaattga

SEQ ID NO: 42175 - DNA, 291 bp, Glycine max
  Peptide Sequence Number=SeqID_133860
atggcccattacggaattggattgcagagtcccttagcaattatatatgcactatttcttggagcaacagaaaactatgggtttccacatactcggtattattgggctacagtttctataaaccaaggagccaccaagaagcttgaagtagcaaaaggctatcttgcagtctatgttggagataagattggacggttcatgattccagtatcatacttgaaccaacctgcatttcaagacttagtcaagcagaagaagaattcggatatgatcatccaactggcggtctaa

SEQ ID NO: 42176 - DNA, 281 bp, Glycine max
  Peptide Sequence Number=SeqID_133861
gtagaagctgccccacatacggaggaacctatgagcctggacaatgtataagccaacaggacacctctcgagaagtaaactatataggcatacctaattgcggattccagggttacaaccaggggaactcatccggattccaccaaggggcagcaggattcaatcacgggccaccgggattcaatgaaggaagaaacttcatgcaaggttcagggtcgaggaatcagggaaaccaatataaggagcaaaggaaccaacaaccataccaaccgccttactag

SEQ ID NO: 42177 - DNA, 312 bp, Glycine max
  Peptide Sequence Number=SeqID_133862
atgggttttcgtcttcctggtttcagaaaggcgtccttttcttcaaaccaagcatcttctaaagttgaggatgtcccaaagggttaccttgcagtctatgttggagagaaaatgaagcggtttgttatccccatgtcatacttgaaacaaccttcctttcaagatttgttgaatcaagctgaagaagaatttgggtatgaccatccaatgggtggtctcacaataccatgcaaggaggatgagttcttaagctaccagcttataccagggtttaagtgcagtaaatttgttggagatattgaccaaccttga

SEQ ID NO: 42178 - DNA, 1269 bp, Glycine max
  Peptide Sequence Number=SeqID_133863
atgatgcacgtgcttagccggcaacccgtgctaagcacgctcatgcatctgggcgaacgcgctaagtgcccacccttggcgctaagcgcatgccagcagcagcatgaagggggcgctaaataccaggataacattcagctccggaacatccttccggagaggaatgtagagcttggaccagggatgtttgatgagttcctacaggaactccagaggcacagatgggaccaggttttgacccgacttccagagaagcaaattgatgttgctctagtgaaggagttttactccaacctatatgatccagaggaccacagtccgaagttttgtagggttcaaggacaggtcgtgtggtttgatgctgagatgattaacgacttcctcgacaccccggatttgacgacactcgctcagacatggagtgtactttcttattttaaccttgcccctacttctcacacctatgatattaatgttgacagggcccgactcatctatggtttggtgatgaagatggacctggacgagggtagcctcatttctcttcagatcaatcagatcacccagtccaacacttctagtcctgtgatcaaccttgccgacattaagaagaactgctggaaccccgccgatccatctatcacatttcaggggacccgtcgcacacgcaccagagcttcggcgtcggcatcagaggcccctcttccatcccagcctcccctcttggccttcttcccagcaaccacggcctccacttccattcacctcagcacctccagacatgcatggacagatgctcagatggatctgccactcacgactccagaggcctatcgtcagttggtcgcctggccaggagaccagccctccactgacaggggggaagagccttctagagtcgccgctactgaggatcctgctgttgatgaagacctcatggatgacttggctggctctgattggggcccatgggttcaaacacttgagatgccactgatccttggagaaacactgaatggaaaggttagcttgatggaacaaggtcataactggtacgctgaatacttgcttaagtcccggcccagcccaacacgcgtgctaagcgcgcgtcacgcgctaagagtgcaaggcagtacaggcgctaagcgaggtgttaagctcgaagatgcagaatccgttaagcacgcgatccagcagaaacacacgctaagcctgcaactcgcgctaagcgcgattacgaaggcccaaagcccacttcagcagctataa

SEQ ID NO: 42179 - DNA, 276 bp, Glycine max
  Peptide Sequence Number=SeqID_133864
atgggttttcgtttacctagaatccagaagacatcattttctgcaaacaaattagcatcttcaaaagtcatggatgtgccgaagggctatgttgcagtctatgttggagagaaaatgaggcggtttgtgattcctgtatcatacttgaaccaaccttcattccaggacttgttaagtcaagctgaggaagattttggatatcatcatccaatgggcggcctcacaattccatgctgtgaagatgtattccagcatataacttcttgcttgaattga

SEQ ID NO: 42180 - DNA, 636 bp, Glycine max
  Peptide Sequence Number=SeqID_133865
atgattgttatcggcggtaactacttaaatatattattgcaggattatctgaaagcccctgcaaccacagacttggcatataatgcaattctggaacatactattgcagagagggagcgcagtgatatttcatcattgcgatggctctggtatttgaatttgtctgagtgctacttgttggacggaatgccaaaggggattgagaacctgacttggcttgggggatttgtattaagtagtcctagcaagactccctgcagaatatcagatattgctgcaaaattggaaagactagtgcgacttagcatacgtataggaagtggggccgtgatccaagatggcgagtttgaaagcttgaaaatgttgtcaattcttaagcatctaaaaatatcatggggtgtatttgacacaagtttgaaaaagttgcatcttgaaggctttcctggccaaaatattccagaatggttgaagcctagcaaactacctcaagaattggaattgagacagctacatataacaggaggaaaactcaaaagtttggatcatggtgaaaataatgattggggtgtggagatcgtgtatctcaagtacctaaaagatttggatgttgacttgggacatttgcgaaagttgtga

SEQ ID NO: 42181 - DNA, 630 bp, Glycine max
  Peptide Sequence Number=SeqID_133866
atgggttttcgcttacctggcatcagaaagtcattatttgcagaaaatcaagcatcttcaaaagcggaggatgcaccaaagggctatcttgcagtctatgttggagagaaaatgaagcggtttgtgattcctgtttcatacttgaaccaacctttattccaggacttgttgagtgaagctgaggaagagtttggctataatcatcccatggaccacctattgggtgctcatacccgaattcttcctcagcttgattcaacacatcttgaaaggaaggtttgctcaagcatgatatgggataacaaactgcttcattttcactccaacatagactgcaaggtagcctttggcacctccacggcttttgaaggtgctaatttgtttgcagcaaccgatgtcttcctgatgccagcttcaccgttcccgcggatgctcactactacaaaaagcagattctacatcggtcaaagtaagctatctacgtcgggcccaccaccgtctttgttccagatgtcgttgtatgtcgacaacaacgacatcgtagcaccgtcgttgttcggatccatttcaacattggtatccataacagccgtcgttgttaggatccatttcaacgtcgggtatccatag

SEQ ID NO: 42182 - DNA, 387 bp, Glycine max
  Peptide Sequence Number=SeqID_133867
atggagaaagatttcgatacacatttaaattgcctctcttccaatttgacagatggctttgtgttattagaaagggagggtaaatgcagagacctcttccaagagtgggtagcattgggtagacatgtacaaattcacaactccaagagcctgaaaatctactgtcctgtgacatctattttgcctaaaacaccgcattttgacgaaacatacagtttatggctcatccattaccatgatgcaaatcaattcgcatatcaagtcaatggatgtttggcagccaccatggacaacaatgtgaagggaagcctactatggcggcaccatagggcgcaatggcatgtttatgtagcagaaatttggatttcagccatccaccattcataa

SEQ ID NO: 42183 - DNA, 276 bp, Glycine max
  Peptide Sequence Number=SeqID_133868
atgggtttttgtttacctggaatccggaagacatcattttctgcaaacaaattagcatcttcaaaagtcatggatgtgccgaagggctatgttgcagtctatgttggagagaaaatgaggcggtttgtgattcctgtatcatacttgaaccaaccttcattccaggacttgttaagtcaagctgagaaagattttggatatcatcatccaatgggcggcctcacaattccatgcagtgacgatgtattccagcatataacttcttgcttgaattga

SEQ ID NO: 42184 - DNA, 519 bp, Glycine max
  Peptide Sequence Number=SeqID_133869
atggctttcttggcttctcaagtcacatgtcgcactctccaagatgcatccatgtatgagaggcacgaggaatggatgagtcgttatggcaaggtgtataaggacccttgggaacgggaaaagcgtttcaggatattcaaggaaaatatgaattacattgaaacctccaagaatgccgccattaaaccttacaagctagtcattaatcaatttgcagacctcaacaacgaggagttcattgcaccccaaaatatattcaaggggatgatcatttgtcgtcttctttctcgtaaatacaccttctctttttcgttcattgtcttcttcctccatccaagattttgttgggcattttatgatgttgcttcgacggaaggaattcttgcactgacggctggaaaattgatctctttgtcagaacaagaacttgttgattgtgacacaaagggtgtggaccaaggttgtgagggtgaccttatggatgatgctttctgtaacaccctctaccctcacaaataa

SEQ ID NO: 42185 - DNA, 261 bp, Glycine max
  Peptide Sequence Number=SeqID_133870
atgcctcacaatgggcaagtcaggtcacgctcactaagtgaaatcatagggagaccagtcagggtcacgctgttctgcgaaaatgctctaaccatgtggaatcggcatagacttacaagagcactcaaaccggataacccccaaggcctacactccgaagatgcacctcaagtgattaactcgtcaggttcccacagtggatctcatcacaactcatcgtgcattaactcatcgctcttaaagggtcttacagttgtgtaa

SEQ ID NO: 42186 - DNA, 408 bp, Glycine max
  Peptide Sequence Number=SeqID_133871
atggctgttacactttcaaattcatcattcaaaatcttggagtcaagatgccaattggaggatgttcctgccaacaatgagaaggcactgcaaaaagttgtggccaatcaaccagtttctatagctattgatgcgtgtgactctgactttcagttttacaagaggggtgtcttcactggttcatgtggaactgagttggatcatggtgtcactattgtgggatatggtgttagtcatgatgggactcaatattggttggttaagaactcgtgggaaactgagtggaactctaatagagcaattggagtaggagttctagagaacgtcagaaacgtcaccattgataatgaagaacacttgagcgactacatcgagataagagatgagttacttatgcttggcggttag

SEQ ID NO: 42187 - DNA, 693 bp, Glycine max
  Peptide Sequence Number=SeqID_133872
atggctttcttggcttctcaagtcacatgtcgcactctccaagatgcatccatgtatgagaggcacgaggaatggatgagttgttatggcaaggtgtataaggaccctcgggaacgggaaaagcgtttcaggatattcaaggaaaatatgaattacattgaaacctccaagaatgccgccattaaaccttacaagctagtcattaatcaatttgcagacctcaacaacgaggatcacaagaaaggagcagttacacctgtcaaggaccaaggtcattgtggattttgttgggcgttttatgatgttgcttcgactgaaggaattcttgcactgacggctggaaaattgatctctttgtcagaacaagaacttgttgattgtgacagaggtcaagatgccaattacccttataagggtgttgatggaaaatgcaatgcaaatgaagaagccaaccctgctgctactattactggaataccatgggtttccgcatacatggtattattaggtgggcttcgtcccaagcaacctcatcaagggttgccaaaaggctatcttgcagtctatgttggagataagatgagacgtgaagcagaagaacaatttggatatgttcatccaatgggtggtctagcaatacaatgcgaggaggatgagttcctaaacgttacctatcacttgaataagctgtaa

SEQ ID NO: 42188 - DNA, 156 bp, Glycine max
  Peptide Sequence Number=SeqID_133873
atgaaggcatcccgacagagcaaccacgaagagaagtctcgcgccctaaacaccttgaagactacgtggccgttattctgttatcgcaaggtagttgctgccattgcaagccatagcaatgtaagacccgtgtataaaaggaaagctcactcatga

SEQ ID NO: 42189 - DNA, 207 bp, Glycine max
  Peptide Sequence Number=SeqID_133874
atgacttcgtacggaggccttgaacaacttggcgcaagttatggccaatcagggaggcagtggaggagcaactgtgtatcatggtttagatcgctttcagaggaacaacccacctaccttcaaggaggaaaggagatggagttcctcgagctgaaacaggggagtatgacggtggcagagtatgcagcgaggtttgagaacctctaa

SEQ ID NO: 42190 - DNA, 231 bp, Glycine max
  Peptide Sequence Number=SeqID_133875
atgggttttcgtcttcctggtaccagaaaggcatcatttgctgcaaaccaagcatcttcagaagttgcggatgtcccaaagggttaccttgcagtctttgttggagagaaaatgaagcggcttgttatccccatttcatacttgaaccaaccttcctttcaagatttgttgaatcaagctgaggaagaatttgggtatgaccatccaatgggtagtctcacaataccatga

SEQ ID NO: 42191 - DNA, 822 bp, Glycine max
  Peptide Sequence Number=SeqID_133876
atggttcatgattcccgtatcatacttgaaccaacctgcatttcaagacttagtcaagcagaagaagaattcggatatgatcatccaactggcggtctaatgatggataatatccttcgtattcgagaccgaaggggtctccgtgaagaaagcgataaagcgagagagataaacatatgcatgatatcacgtaatccttctagaagcttggtttatggatattcctcttgggccgaagctgatgatctgcatggtctgcatcgtggttcgtatcaatacagctgtctggaaaatgcaccttgtcctcaaggtggaaaggtctgttacttggttgatggggccatgatgaggcttgaggagggagcagtggaaaacatcatggattttagaggaagggggaagggccaatcgtttgaggtaaacccagtcaccaaccttgtacgtgacgtcatggcgctggcacgtggtgagaagatcccagagttcctaacgtgtagaaagctcgtggtcaactgctttgacctaagacgtcctgggaacatagggtgtcatgcctgtggaggaatggatggacatattatagcaccattctgcaagggaaagttgggtgcctgcaatggtgaagagttcgcgccaaaattgtccaatgaagatgggatcacggtccgagatgaggctgcggggaaaaccgtggagtttgcataccatattaaggaagagagtggcaaccttatgggcggaataagctggcttcagggtgccaaagtgagcccctttggtgaaatgatcgaccacgacaaggatagtggtgtagccatgtga

SEQ ID NO: 42192 - DNA, 717 bp, Glycine max
  Peptide Sequence Number=SeqID_133877
atggaaaggaaaagtgggtttgatgggtttgtgtttggtggtgtcttaactctaaccaagaaagcaattgaatctgttaggactaaacttagatgttcaaggataaatgtgaatcacaatggttataagtgcttgttctcttctgggaaaattttcatttcaaaagatgttattttcaatgaaaatcagtctccttatcctgccctcttctcctcttctacttctagttccacacctactgagttcatttcaaccacgttaactgtcattgattcagtttgtcatcctcctcttaattctaatccttcttcctcatcctctattgagggtccccactcttcaccttctgttaaggcttccagaattcatccttccttgtttcttgttcatactgaacccaagttagttaaagaagctcttcaagaatcaaagtggtttgctgctatgacttgtggaagcaatgccttccaagattactttgatgatgccaaagaatcaagagttaagcaaattccaaagtttcaagatacaagattcaagaatcaagtttcaagaatcaagtttcaagaatcaagattcaagattcaagattcaagaatcaagtttcaagaatcaagtttcaagattcaagatcaagattcaagactcaagattcaagaatcaagagaagcctcaatcaagataagtactaaaaacgtttttcaaaacattgagtag

SEQ ID NO: 42193 - DNA, 510 bp, Glycine max
  Peptide Sequence Number=SeqID_133878
atggcctcacggaaacgccaagcttcacttcagagacaacttgtcacatatatcaagacaatactctcggaaaagcaaatagacatcgctctggtcaaagaattctactcaaacatctatgacccagaggatggagctccaaaatattgcaagagaggaacatttggcatactcctagtacttgcacacatacccagaccaccaagcgattgcggtaaccttatgcacacccggaagagggttcttcctgaatgccgacggggccccatggaatctatggaaggatcttactacactcgatcaaatatggagcatggacatggacatggacttgggcagcttcatttcccaatgttgatcacagcattgtctgatgctcagggggtcgtttctgacaccttaacctatgagtcactaagccctattattaaaatggcctacataaagaaaaactattgcaaccctgtgttcgacggccgacaagtgcaccgaatcgcgcacgtagtataa

SEQ ID NO: 42194 - DNA, 639 bp, Glycine max
  Peptide Sequence Number=SeqID_133879
atggacagagccaagttggtttatggcttggtaacccacatggatatgaacattggcaccctaatctcaggtcaaatctcttctattgcccagagtaactcctctaggctcgattttccagccttgatcactgccctttgcagagttaaaggagttacctttgacagtctgacttatgagagcctgagcccagccattaacttggcctacattaagaaaaattgttggaatgtggatgatctgataagcatgcaggttgtggcttcaccaggaactatcttgacagttgagcagttcatagagaaggtagcttggcctggaactcagccttctcttctgaggaaaggtggagatcccagtgctcaggtacctcagcaggtaggagtgacacaggtaaggcaggaggctgctactccaaagaggtcaccacagatttcaccagatccaccctcgtcagtggtggatcaatcttctcctcagcagctagcagaccccccttcaccagtgcatgagatgccaataaacccttctactccatttctagagattctagaggaccctaccacactagtcctgggactgactaccactcctccagccactcttgtgctacattttacagatgaggagggcacttag

SEQ ID NO: 42195 - DNA, 366 bp, Glycine max
  Peptide Sequence Number=SeqID_133880
atgaaaaaacaacttaaccaacgtttagttcttgaagaactacgtaggtctgatttccttaccacaattgaggaatacgtaggagcaagggaaacacccttgttgtcgtcccttgtgacggatgcgtggggtgctaataccttccctgtgcgtaaatacaactcccgaacctttcacttaaagttcgtagaccacgccttttccggttttttccgatgttttcctcgaataaacgttggtggcgactccgcgcattttccttccttggaagacgcacccgtgagtctcgcgtcgccctcccgccaaagggtaggttgcgacaccaaaaaagcacaaacgaagaagtctttcgacttcctcttttaa

SEQ ID NO: 42196 - DNA, 600 bp, Glycine max
  Peptide Sequence Number=SeqID_133881
atggcagaatcatctaagaagcgcaaagattcaacttcaaccaccactattgcaggccaacgccgccacgacacttccggtgactctaccgcaccacccaatccctccatttcctctccacattccttaactctattttcctccgatgaacaatgtcaaagtcaaggtgtacctttgaagggcactttggttgatgattggaagcatatttattcaaatcatgatgcccgcaaaatggtttgcaataaaaatactgatatgattgttcgattgcttgctgatgatgaacctattgttatggttaaacattcttttggtattggagctgctattgttgccttctttggttatcagaatgatatggatggtcagtgggtgtggaaacacgaccttccaccaactgttcctgatgaatgtacaccctcaccaccaccacaaagggattcctcctcttcattgttgcatgatgttctaagtgaacttcaggatccacgggcctttgtaggtgatcgttttgacgctatggattcatgcatcacacgtcttgaggatgatatgagcttcattcaccgatgctttgaccctccggtagattcgtag

SEQ ID NO: 42197 - DNA, 900 bp, Glycine max
  Peptide Sequence Number=SeqID_133882
atgattaaggattggtctttcctcaaagaaagacgggttcagctagtagagggagagtatgcagaattccaggcggaggttgcaaaaaggcattggacccagctgacggatcctatggctaagtatgaccctgagatagtcatggagttttatgcaaatgtctggcccactgaagaaggacttatggataagtgttcctgggtgtggggccaatggatcccatatgacgaagatgctatcaaccaattcttggggcatccgttgatcttagaagagggacaacattgtgaatatgttgaaagaagaaaccaagtctcaagttttgatgaagaggccataggccaactactgtgctccccgggacatgattttgcacggagcgtagcagggaggcaggtacagatcatacgcactagcatgaccactttaactcagatctggatgacgcttctgctcagcaacatccttcccagtgaccataattctgatctcccgctgcctaaatgccagttggtctaccctatcctgacccagatcagtgttcatgtagcacaacttatctcggatgccatctaccaatttgtaggtattgcacctccgagacacccagtggacccagggaagtccaacatggcattgggatttctagcattgatcacaagcctctgccaattctacggggtactggtcacgcccacaaagctcatccggccccccattaacagtgccaggaccccaacccttacccgtggcctactcccgagcagttcagagccactgttgcatagcctgaggacaggcctaattttcaggggggcaggtcccacagaggcccaagaagatgaagacaaagctgaggaggatggagatatggcaaatgtgatggattttttcctttga

SEQ ID NO: 42198 - DNA, 741 bp, Glycine max
  Peptide Sequence Number=SeqID_133883
atggcggcggtgttgcggcggcttcgagacctgcagtcctcggcagggaataagatctgcgtggactggtcccaaaagaaccctcagtgggcctccgtctcctacggcgtcttcatcgtcggcgaggtacaggtcgacgaaggatatctacacacaatcgcagctggaggcgtcagccgcgaacaaggagggattcttcacgcggaagatggcggagaacgagtcgcggccggaggggctgccgccctcacagggagggaagggattgggaaattgtctttggtcgctgcctctgcggctaatgttgttcaggctggcacgaaggagttcacttccaaggaagctactgttgatttgccttatgttgcctttgcagtaaggccaaatcttggagtttgggaatttcactatgctagatatgtcgcagtcaacgaaactaatggccgagcactcttttattggttctatgaggccatgaccaagcctcaagacaatccattagtgttgtggcttaatggaggtcttgggtgttcttctgtgggatatggagcaacacaagacattggcccatttttagtggacaccgatggcaggggccttaaattcaataacttttcatggaacaaaggtagcaagatcgaagtgatgatgacaatggtgatgcggtggaatgatggtgatgatggtggtggaggtggtggtgaaaatgtgatgatgacagtgacgatggtagtaggatag

SEQ ID NO: 42199 - DNA, 270 bp, Glycine max
  Peptide Sequence Number=SeqID_133884
atggcatccttcagccagatgcagtcccagcttcaatcacagatgcaatcacagggacttgcactgcctccggagcctgaggttagtccctcagctgctcgtgttagcacaaaggggagttgtgttgatccctcaccgaccgatcaagagacaggtgactcagacaaatgcgggctgtacatcgaagaaaatccttcccgcctggttgccctaagaagagtttatgagggatccatagctgttcacaacatccctttgttgcatggccag

SEQ ID NO: 42200 - DNA, 849 bp, Glycine max
  Peptide Sequence Number=SeqID_133885
atggctcaaaagacttgttcaagagattatcaaggtcattggtattttgttaacaccactggttttaaaggcaattggtcatacgatttgaatgcattgttgatgtggaaaggttcagaacaaatgttcggggataatggattatcacttttaaaaagcattgatctctcaagcaatcacttttcagaagaaattcccatggaaatagagaatttatttggattggtttccttgaatttgtcaagaaaccatttgactaggaaaattccttcaaatattggaaagttaacatcacttgactttctcgatttgtcaagaaaccaactagttgattcaattccttcgagtcttactaaaattgatcgactctctgtgctagatttatcacataacaaggtatcaggagaaattccaatcggcacacaattacagagtttcgatgcctcaagttatgaagataatattgatctctgtggaccgccacttcaaaaattgtgtattaatggggatccagaacaagatcccatagttaaactttatgaggataaattgcttttcactagtgaattttacatcagtatttcatcaattggatttgtcatgagcttttggggcgtgtttggcaaaatcctaataaagcattcttggagacatgcttatttcatgttcttaagcaatttatcaaatgctatttatgtcatgacagcagtgaaagttttcaagtatgccatagaggatagcagagaaaatctggattatagttgccagcttgttgatggggaaagatgcaaagagccacttttgaaggtgacaaggcatctctcacagttggatttggagagagaataa

SEQ ID NO: 42201 - DNA, 880 bp, Glycine max
  Peptide Sequence Number=SeqID_133886
atggttaagttcgagaggcctactccaaagattgaaggtcttgtggctgccagcggactaaaggtgactatcaccttgaatgatgtggtgtcattgctacatttgcctatcgtaggggcgttccttagcttcgagcaacttcatgtcgacgacattattgatatattggtggaattactcgatgttagcgctgcagaggcaagagctaagacaatccaatgtcatggctcttatagtgggacttacgcttggggtgctgctgcacttgtgcacgtgtatgataatttaaatgaggtgtcaaagagcatggcaaggcagcttgcaggatatatcactatgttacagtgttggatctacaagcatttcttgtttgttagttccaccctagctgccaaggatgataacaagaggagactgcatgcatgccgatggacctctggcaaggcactacccgtgtcgatagaatttgagatcatctccttattttccggccatctcaaatggggtcccttgatggtcattcatcgatcggagaggtttggtgactacattgcacctataggacaaatttgtgtagtgcctgaccaatgttcgttagattacatggagtggttgtacatgattttgcatccatttatgactctagcaccgccaggggatcctcctagagttccaccgcaaccagtggcgacaacaacacctgatgaagcagacgttgatgtgcatcgtcctggacatgcagtggatggttatgtagtaattgctgataagttggaaagactactgaacctcaggatcctgaccgaaggaacagaagtctatactgttgctgaagaatatttgagcatcgcaagaagctacattggtcaactaactgtag

SEQ ID NO: 42202 - DNA, 66 bp, Glycine max
  Peptide Sequence Number=SeqID_133887
atgaaatcgcccaaggcgtatggatcaagcaacttgaagaacttcgccaatgtgatcatggaactc

SEQ ID NO: 42203 - DNA, 225 bp, Glycine max
  Peptide Sequence Number=SeqID_133888
atggcagaagaagatgcactttctcttgacaacattaaaggtggtgtatgtgctgagtacaccaatgctgatgtttatggaagacgaaactctggatcaaataaggaagcgttcgaaatgggagaacgacgattacatttgtcgtggacacattctgaacggaattatgggactctcttgaatccaagtatatggcagaagatgcctcaagtaacaaattcttag

SEQ ID NO: 42204 - DNA, 504 bp, Glycine max
  Peptide Sequence Number=SeqID_133889
atggtttttttttttgtgcaatcaaaattggagtatccaatacctggaaccttgctactgttcatattgaagggatataattttactccctggatttgggttccaacaaatccaagaggtgcagaaagattacctcctgggatagtaaatgcagaatcaaacttatttttgcgtagattatggggtcttcccatgtctcacaagctttttctgatcataggggccactaaagcccgcgagttatctctcttggccacacctttgactgcagaggcagctgagaggttgtgtttcgcaaaccatatcgttgaagaggctcaattgttgaagaaaagcagggaagttgcagatgccattgtgaaaattaaccaagacttggttttgaggtacaaggcggtcatcaatgatggcctcaagctggatcttggccgcacactttctcttgaaaaggcccaccataacaacgatgtttgtctctgtcataacatgttgaatggtgcttag

SEQ ID NO: 42205 - DNA, 324 bp, Glycine max
  Peptide Sequence Number=SeqID_133890
atgttcttctacaagaacaaatatgggttccaatgtcgatgcaaggaaagtaatgtcgaaggcctccacgaaggcataagtgtcagtgtcggcgacgacgatgcctttagatccaacagaaaagagggaggagagggggccatggaaggaggagatgggggattagagggcgcgacaaagaagaaggaagggtggagaaggggcatgacgaggggaggtgaggatgggagatggcagaaaagagtaaagaaagaagggaggggaaagttggcagaggaaaaagaaagaaaatggggaggcaggagaggggagccgaggaagtga

SEQ ID NO: 42206 - DNA, 1224 bp, Glycine max
  Peptide Sequence Number=SeqID_133891
atggcaaagggccaaggggagctcagactgtggagattatcaagagggggcgttcaccttgagtgttggccagtaacagccaacacacaccacctttgttgcaaaggagcatcctcctggggtcatccagtcttgttcctcctcttcttcggccttaacttcttcaatgtctatggtgggagtttggagcatctcctggatgatagtcttgagagagacattgtcaaggcctttgaggatgattcatgccccgcttccctttacattggacgcaccatcaacgtagaggctccaccaggttcgtattggatatcaaactctgaaaagttctacagactaggccaccatctttcctacgagtttaggctttcacaaaacctgcttgatggggtagttcattttggctaccagttgatgactctggaaattgagagttggtgtttcctttcctcttgtatgagggctgagctaatggctttgttagctactaagagatacaagagtaggggtactcctaacctggagagcttcgggaggaacctagacagggatgccagctaccattcagtttctagacttctaggatccgaaaaactttcctccgcctaccctgaaagcatatttttcagggttgacgctaatgctatacttgcggagttccccaaagacttcttccaggctgaagggcatgaccttgtagcagaaattgtcatctttagtgatgaatgttgttttttcctcgtctggagtgtgcatcctgatttggttttatctggagacgtcgactatacgccggtgctcaaggttggtgaggtccctacactgctcgggtttaggttcgagttgcagcttgacgagcttttcgatggtcagggcttcgattggagaccctttgtctatgctcatgacttgagtaccttcaacagttgtggggtgaggcttggcaggctccctggtggaaggatagggtgttaccttcaggctctctacatagcactgtcgtgcttgcttttgatctgccctgacggttacaatctccctgatctaacctctggtccatactctctcgcctgcaaagccaaggaatggaccggcatgagggtggatagtgtttggggagacctcaagcctctagaaaacaaccacggggtcgtcctggttgatggggttgatacccttgaagtccttatccgtgaaagtgataggagggagacttcgttgtaa

SEQ ID NO: 42207 - DNA, 255 bp, Glycine max
  Peptide Sequence Number=SeqID_133892
atgccctttaagcatgcttatctgagtcatggttctagtgttgatgagaatgaatcgttattccttgatgtaagaagacagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 42208 - DNA, 702 bp, Glycine max
  Peptide Sequence Number=SeqID_133893
atggctgaagatcaacctcatagagtcactcttgaggactactcaagctctactgccaagagatggctacacttattcaagggaaacagtttgaagacttgggatgagtttcccgatgaatcattgagtgaagccttagaacgattctgtagcttgctgcggaaaactccaactcacggattctccgagcctatccagctaaatatcttcattgatgggttgaggccacaatcaaagcagttacttgacgtttccgctgagggaaaaattaagttgaagactccagaagaggcaattgaattaattgaaaacatggctgctagtgatcacgcaattttgcgtgacaggacacacattcccaccaagagaagtttgttacagattgcactatttgtggttgagctcacgaatctggctgttgtattcctattgaagacacaacatgtgaagagaactcaccctggtaatcaattcaacaaagaccatggtgggccatccaataggccagcacagcaagggcctaatctctatgagaggacaacaaagctggaagagactctcactcaattcatggaggtttctatgtcaaatcacaagagcacggagtcggccatcaagaatcttgagattcaggctgtcatgaccaggggtaggagagctattctagttgaagatgagggtaggttggttgctgaaaactaa

SEQ ID NO: 42209 - DNA, 933 bp, Glycine max
  Peptide Sequence Number=SeqID_133894
atggcccgcaccaagaaaaatgggcaaatgacatctgaggcagcaaaggaaattgctgaaaagattgattctttgaaggagcaagcgtcacagggttcctttgtcccccatggacgtgaggatgtcctcgctgctgctattgggctaccagaacaccctggtcatgtgcgtgctgctagagccggtgtgaccatcaagcaatactttggattggctccacagacctttcgcacttctttctccatggctccagaagaacttgagcagctggaggagtcgatcacagaaaaaggacttacactacctccgaagcctaaggttcgtccctcagccgcttgtgtcagcacaaaggggagttgtgttgatccctcatcgaccgatccagacacgggtttgcagaggtgtggcaaaacctgcaggctgatgtggatcaattatttaatgcctaatttgaagataggtacattttcaaaagaggaggaaaatgtcatcattgaacttcatgcagtgctagggaacagtgcacctagatctattgacatggatgttctattttttcttcttctcagatggcctcaaattgcagcactaaggccagggaggacagacaatgaaataaataatctgtggaattcttgcttaaagaagaaactgaggcaaagaggaatacaccctgtgacacacaacccactgtcaaaggttgagaatagagatgagggcaaaacaaggaggcaagaattatcccatgaactaaacctcctgaattctgagagcttcaactcagatgaagggtcctatgagcagagaccatcatcaattgcccccaaagcctatgacatggaaggctgttgcatctccaagattaataacacaaaaaatgataccaacttgatgcccaattgctccaacaaagacatgttcctagacagctaa

SEQ ID NO: 42210 - DNA, 213 bp, Glycine max
  Peptide Sequence Number=SeqID_133895
atggagtgcaacatctatggtgtaaaaataaaatctgatagtcctgcagagaaaggagctggaaaaatagatgtggatgcaggtgggacagatataataggtgctggagctgaggaagggggaacctcagaagatgggggagcctcagacctcttccctttggccttgcgctaccctctgaaagtaactgagaggtcatctaggttccagtag

SEQ ID NO: 42211 - DNA, 168 bp, Glycine max
  Peptide Sequence Number=SeqID_133896
atggcctgcaccaagaaaactgggcaaatgacgtctgaggcagcaaaggaaattgttgagaagattgatctcctaactgctgccattgggcgaccagaacaccttggtcgtgagcgtgctgctggagtcggtgtgaccatcaagcaatactttggattggctccatga

SEQ ID NO: 42212 - DNA, 2076 bp, Glycine max
  Peptide Sequence Number=SeqID_133897
atgacgccaaaaggcgcttacttcgctaacatcgcggctatcgttgcggctttcgccgtctccttcgtggtctcctcgattctgctgaaaaccagcaaagtaaaagaagaagacgacatcgaagcaacccagcgcatgaaagacatgaaagcgcagtcaaaaggccaggccgttgccggttcaccggtggtagccgatgccagcagcgttgacgtcagccacgtgcgcaaaatcatcgtcgcctgtgatgccggtatgggctccagcgcgatgggcgcaggcgtgctgcgcaagaaggtgcaggatgcgggcctgagcaatatctctgtgaccaacagcgcgattaactcgctgccgggcgatgttgatctggtgattactcaccgcgatctgaccgaacgtgcgatgcgtcaggcgccacaggcgcagcacatctcgctgaacaacttcctcgacagcgcgctgtataccaacctgactgagcgtctggtggcggcgaaccgcagcgaagcccaccgtgaaacggtgcagaccgcgctggcagacagctatgacgacggcagcgcgcacctgttcaaactgggcgctgacaacgtgttcctcggcctgagcgccagcaataaagagcaggcgattcgctttgccggcgagcagctggtgaaaggcggctacgtgcagccggaatatgttgaagcgatgctggcgcgcgagcagctgacgccaacctacctcggtgaatccatcgctgtgccgcacggcaccgtcgaagccaaagaccgcgtgctgaaaaccggcgtggtattctgccagtatccggccggcgtgcagtttggcgatgagccggacgaagtcgcgcgactggtgattggtaacatcggccgtgggtttatcggtaagctgctggcggatgccggtatcgaactggtgtttgctgatgtgaatcaggtggtgcttgatgcccttaacgcccgtcatgagtatccggttcacgtggtgggcgagcaggcgcaggttgaaatcgttaccggcgtaagcgcggtgaacagcaccagcgacgacatcgtcacgctgattgctgaggttgatatcgttaccacggcggttggtccgcagatccttgagcgcatcgcgggcagcgtggcgcagggtctggccaaacgcagtgacaacggtaatgtccgtccgctgaatatcatcgcctgtgaaaacatggtgcgcggcaccagccagctgaagcagcacgtactgaaggcgctgccgcagcagtatcatgcgtgggttgaagagcatgttggctttgtcgattcggcagttgaccgcatcgtgccgccatctgaagccggcagcaccgatccgctggaagttaccgtagaaaccttcagcgagtggatcgtcgacaaaacccagtttaaaggcgcgctgccggacattcctggcatggagctgaccgataacctgatggcattcgtcgagcgcaagctatttaccctcaacaccggtcacgccattaccgcttatctcggccagctcgccggtcacgccaccattcgcgaagccattctcgaccagaaagtacgtgccgtggtgcagggcgcgatgcaggagagcggcgcggtgctgatcaagcgttatggtttcgatgcggagaaacatgccgcgtatatccagaaaatcctgacgcgtttcgaaaacccgtacctgaaagatgacgtcgagcgcgtgggccgtcagccgctgcgcaagctgagcgccggcgatcgcctgatcaagccgacgctgggcacgctggagtatcagctgccgcacgccagcctggtgcagggcattgctgccgcgatgcactatcgcagcgaagccgatccgcaggcgcaggagctggcgtcactgatcgcacagaaaggcccacaggcggcgctggcggagatttccggcctagatgccaatagcgaagtggtgagctcagtggcaataatggaagagaagcaggcttttgaaaaccgggtgcttgagcggctgaacgccggtcgttcggtgagaagcttcctgatcgccgctgtcgaactgctggcggaagca

SEQ ID NO: 42213 - DNA, 279 bp, Glycine max
  Peptide Sequence Number=SeqID_133898
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgcctgcagtgtcgacgccgatgcctgcctga

SEQ ID NO: 42214 - DNA, 252 bp, Glycine max
  Peptide Sequence Number=SeqID_133899
atgggacttgatgatactccacaacctaaatccaaggctggtgctaggtggattgttgttaagaccaaaattaaaggaatcactgagttcggttattacgtcatgcactggatgtccatgataatcttaggaactttcaggaataattgggaaacgtattttaatgatgttagaccattggaagcagagagattgaaggcgtttcacatccagtgggcacagtattatctcaaagttagagatctcacttag

SEQ ID NO: 42215 - DNA, 53 bp, Glycine max
  Peptide Sequence Number=SeqID_133900
gaaaacgtcggaaaaaccggaaaagacgagatctacgatctttttattgaaag

SEQ ID NO: 42216 - DNA, 871 bp, Glycine max
  Peptide Sequence Number=SeqID_133901
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacaccgttttcccatctacgatttttcctcccgtatcgtagaagccactacctttgatgcggtcgtaattgagaagttcggtgtagagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccg

SEQ ID NO: 42217 - DNA, 516 bp, Glycine max
  Peptide Sequence Number=SeqID_133902
tggtctgcagatccagagggacaatattcaactcgcagtgcctatgatctgataggagaagaagcaagagatagcagtgaggaggaatgttttgagaagctttggaggataaaggctgccgacaagacaaaacttgcagagaagacagatacaggtcacaaattcactttgtcctctctgcagaacccaacaagaggatgcatcccatcttttctttcactgcagcaaagttccaaagctgaacccaataagaggcttggaataatgatcagcagggggaacatcctcaacattcagcagaaactaaatgaggtggagaatctagcctctcatcaaattttgtctgatcaagagcttaaggacagaaactctcttcagcaggagttatggaatgcttcaaataggaactactctgaccactaccctattattatgaaatctaagagaatcgactggggtccaaagcctttcaaggttattgatacttggctcaataacaaggagtaccagaaagtg

SEQ ID NO: 42218 - DNA, 423 bp, Glycine max
  Peptide Sequence Number=SeqID_133903
gaactgtcataccctaatttcgtccggggacctttgcttgatgacatgcgacctttctttggtccttgtgaggcccacttgggccctccaggcccacttgggccctccagaatattcctccagaaggctgttgcttctggaggaagcaacctggctcgcctgggcgagctgggcggcaaccacctcccctattttgctataaataggggaggaagtgaagaagaaaagggttcagcccctttggcacttctctcttctttcgaatttgcttggaaaaattgtttctgtgaagaaaatctaagcccgaggcgctttccgaaacgtttccgtaacgttttccgtgaagaatttcgcaaaggtttcgaccgtttcttcgacgtttcttcatttcggttcttcatcggtcttcggatctttcaacgg

SEQ ID NO: 42219 - DNA, 568 bp, Glycine max
  Peptide Sequence Number=SeqID_133904
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcggctaatccgcctcacgagggtcacccaacggcacgtgcctttggggggccgaggccccctactgctg

SEQ ID NO: 42220 - DNA, 252 bp, Glycine max
  Peptide Sequence Number=SeqID_133905
atggttcttggggcaagtagtccccttgtacttgtcaaagtccagcaccttaaacatgggaatgaccatgttcgggaggggctcttcccatcgcaaaatgcaagggttttggttgtgggcgaaactaagggccctccaaagtgtttggcatgggtaccaccaactgcttgccctccagtggcatatccgaggcaaggctcgaagtcggctagattgtggtggggaatttcatgtgtctcccccacgatttaa

SEQ ID NO: 42221 - DNA, 216 bp, Glycine max
  Peptide Sequence Number=SeqID_133906
atggaatggaatcttctagctcactccagacatcttgtcaaagatcccaatggtcagattgtggaaaagtgtcttgtgaagctgcagaccaaacttcgagaagatccaacggttaacgaatacggggaagcgtttttaccgagacagcttcatgtagcttcctcaagaagcttcattaagaggcttcttcaagaagcttccccgtggcttctttga

SEQ ID NO: 42222 - DNA, 510 bp, Glycine max
  Peptide Sequence Number=SeqID_133907
atgaaattcactaccggaagccatttaccgatacagttattatgcaccgttggaagaacaccagatggaataataaacttacttgaacgcactatgtctcgtattcatgacgcgatcctgtattataatgggaaatggaacatgccactgcagaacaaatttgttggatgcgcattcacaggaaaaaatcctaagaaatttcaaattccttcaacatgtatcatcgatgaactgaagaatttaatcaagcaagttgcacctaaagggattccccctcttggaattcacgaatcacaaatggtaagacgattgtttttccgccaaccagctcggtttgagtattcaaatacggttataaaatatgaaataaatgagctgatcaccaacgaagaactgctgaaggtgttagtacaatcaaactactggaaaaaatatgtgccaatagaaattttagctgtctttactaaatatgttgaagacaaggtcagtgggacgtcgctaaacaactga

SEQ ID NO: 42223 - DNA, 542 bp, Glycine max
  Peptide Sequence Number=SeqID_133908
caaaaggggaagaatctagtgaagaaatctacccccaagaagaaggacaacctttaatagttaaggaggagtgtaaggaggtaagtgtctcctccaagaggttagctaagaaggaaagtcattttgaaataaaggcaattattaaagaaaattaccctcttagacaacctccacattttcccctttgtaaaaagacacttgttagcattgccacacctcttaggcttgagtttattcctcaagtaaagaagttgttggatgagggtttgttggtgcccaaaataggtattattaggcatcaaatccctaaaataggtggtatgatgaatgttttgagtggtgcaaccctctattgtcaaatcactcgtgcacccaacatcttcatgatttgtgtacatagggactcattaggtagtgatcaaggggttcccatgaaccctaagagaataaaggtcattcctgagtggcccactccaccaacacctctcattgagttggtgttgattaaaaaagcccagagtttcaagaagctcaggatttga

SEQ ID NO: 42224 - DNA, 657 bp, Glycine max
  Peptide Sequence Number=SeqID_133909
atgcctaagtgccagctggtgtacgccatcctgacacggatgagcatccatgtggctcagttgatcgctgatcccatctatatttttgcaggtatggcgcccactaggcaccctttggacccagataagtccaacagggccctgggattccccgcactgatcacaggactctgccagtcgttcggagtccccgttgcacctaccaagagacaggctcagggtgatgccccacaggccgcaggcgcgccaccaccacctcatcaggctggccaggttggggcatttgacatagagcagtatttacggcatttggttcgccagcaggcggccaaccaccgagcacatgtacggacccatgactgtctgtaccagatgagccttagcatgcagagccagggcttcgcttctttttcatgccctactccagaccagttcagggcagaggtagcatggcccggagattgcccgaggcccaagcaggagaggcaccccaggaagctcccggcgatggagaagaagcccacgaggatgaggagatggccgatttgcttgacttcttgggagggagtggagatacgtgactgggagatccccagattcatgttttctttcatatttcttttgtcatttttattctatgttattgttttgacttga

SEQ ID NO: 42225 - DNA, 336 bp, Glycine max
  Peptide Sequence Number=SeqID_133910
atggtccatgacatcttcgtcaaggtgaaactggaagtaacaggaacatcgacagccctaaatgtgtttggcagtagacgaagcagcaatgtaacacgatccatcttttgccctaatttttgcaagatggttacttccatacttcaacttgactcgatgaaccttttcgtaaaagcaagagcttggttcaaccccataacccaaggaatggcaactttgatcgccaatacttcatcaacatttcatagggatgaaagactcgggaatacgcatgctatgcatggaaaatgtaattatgagattgagacgcccgaagaaacatcctttcttagttaa

SEQ ID NO: 42226 - DNA, 540 bp, Glycine max
  Peptide Sequence Number=SeqID_133911
atgattaacgatgccttcgaaaccctccaccgagatatcatgtgctacatgggcatcgttaaggacctttatcaacagcgcacgatgaggctcggagtttatgagcagttcaagcaaagagatccttgctggagttttattcagttgctcgactaccttaaacttgctttgttggatgagccgaaggaactcatgagcctcttccaaagtcaccgtctttccttgaagaccctctttcttttcagccccttttaccaccggagaatctacttctttcgagggggtggctacgtctgtgggctcttggaccatgggcgctttccccttatagggcaactccaccgagtgaggggaagcgaacacccgaccactgcgggttacgccactgagaccggtgatgttggtcaccttggccgacagggagtcaacttcggttgcaactctctccccaaatgcgggaggggtatacttccacggaacaaccttattgctttgatatgcaaacggcgcccggcttgggcgctgtccggggatatatga

SEQ ID NO: 42227 - DNA, 177 bp, Glycine max
  Peptide Sequence Number=SeqID_133912
gggcaggatcatcttgagctaccttctggggtagagacaaagctagaacagcagaaaccaatcaaggtacatagggacggatgcaagtggggatggggtcacgatcgaccgatcgttgccccttttttgcgccaaacaagcagagaacgtcacgcaaggcagcccagtatcctttga

SEQ ID NO: 42228 - DNA, 567 bp, Glycine max
  Peptide Sequence Number=SeqID_133913
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggagattcaacattcaatttcgagtgtctcgatatcgtacgggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42229 - DNA, 492 bp, Glycine max
  Peptide Sequence Number=SeqID_133914
ggccctgggatttccagcgttgatcacgggcctctgccagtcatttggggttcccatcgcacctagtaaggtgattcgaccaccgatcacccgggccttcattgagaagtattgcacgcctagacaggcgcagggtgatgcatcgcaggccgcagatgcaccgccaccacctcaccaggctgatccagctgggtcatttggcatggagcggtatttacagcacttggttcgccagcaggcggccaaccacagggggcatgtgcagacccatgagtgtctctaccagctcagcctcagtctgcagagccaaggtttcgctccttttccgtgccctactccggatcattttagggctgaggttgcatggcccgaagattggctcgaggaccagacagagaaggcacctgcagaggctcccggtgatccagaggacgcccgcatggatgaggagatgaccgatttactcggtttcttgggaagaatcggagccac

SEQ ID NO: 42230 - DNA, 833 bp, Glycine max
  Peptide Sequence Number=SeqID_133915
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatacctcgatatatgctcaagtcggacaacccaatcaaagtggatcccaacaaactcttgaaatcaaacattcaattccttgatgaaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42231 - DNA, 96 bp, Glycine max
  Peptide Sequence Number=SeqID_133916
atggagtttagtggcaggcagagataccttgtggtcattcgcacctttagtcaatcgaggcttactctagagacattcaagcctgacgacgcatga

SEQ ID NO: 42232 - DNA, 219 bp, Glycine max
  Peptide Sequence Number=SeqID_133917
gacgatgttcctaaaggaaaactctacaaggttccggaatttcaacaaaattatcgacaaatgaagaaagcactaacgcaacagtccaaacaaaatctccgcatgccaccggactcttgggtcacggtaacaaaaggtggggtggtcgacaaaagcagggcttttgctcctacgtatcctcaatttgtgatgaggaactcagatctacgtagttcttga

SEQ ID NO: 42233 - DNA, 309 bp, Glycine max
  Peptide Sequence Number=SeqID_133918
atggttacctgcaccttttgtcaaccgggggcaaacgagcccgttgacgcgcagagacgaacatcgtctcctgcaccttttgtcgtcctgacccgtgaagattacctcgtggttacccacacctttcgtcaaccaggggcaaacgagcccgttgacgcgaagaaattgacattgtcttctacactctttgccatccagggacatcgagtcaggtgccaggcggagataccttatggtcatccacgcctttcgtcaaccgaggggaacgactttgatggtatcaggatgatattggtcgttcggtgctga

SEQ ID NO: 42234 - DNA, 306 bp, Glycine max
  Peptide Sequence Number=SeqID_133919
atgatattgcacaagattagaaggcctaactctctaaaaatcatccccagtggagtcgccaactgtcgcaacctacccttcggtgggagggcaacgcgtgactcgcgggatgcatcttccaagaaaggaatacgcgcggagtttccaccaacgtttattcgaggaaaacgtcggaaaaatcggaaaagacatggtctacgaactttgagtgtgaaaggttcgggagttgtatttacgcacggggaagggtgtttcccttgctcctacgtattcctcaattgtggtaaggaaatcagacctacgtag

SEQ ID NO: 42235 - DNA, 773 bp, Glycine max
  Peptide Sequence Number=SeqID_133920
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatatcagctctatattggttgtatatcagccttgatagttctagatcagttctgtattggttatagatcagttgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42236 - DNA, 213 bp, Glycine max
  Peptide Sequence Number=SeqID_133921
atgtcacttcatggtagaacaaggtatagtttaaggcatatcatttccagtaagggcatacagggttttatatgcgctttatcaaggattttagcaaagtggcccttccactggacaccggctgaaaccattcctcacaaatctctactcaatggatgtagtggtggaggagacctccttacttcaccctacttctcttctgccatgacttag

SEQ ID NO: 42237 - DNA, 258 bp, Glycine max
  Peptide Sequence Number=SeqID_133922
atgactaaagcacgtcaaaagggggtacgaaaagtaaatgaaatgaaaatacaagtacgcgagacaagcggggaccaccaaaggaaaatgagggaggagcttgccacccagctcacccagaaccttacggattacgtaatcatccattttttggctttcagaatgttacagaacctcatggattgcgtaacaatgcttccttttgatttccggcatgttacggaacctcacggattgtgtaacaatgcttccttttga

SEQ ID NO: 42238 - DNA, 294 bp, Glycine max
  Peptide Sequence Number=SeqID_133923
atggctggaaacaatccttatggtttggtaggaataatcagaatcaaagtccagagcacttgttgggttaaagatttttttgttgctaaatgttacggcctaaatgctgaactattgaccctacttgttcggatgggtgttcaccccaaagtgttcccggaccgcatgcatacatacagattgtcctcggctcgggctgaggagtgtccacatgagttcgttgaggtgtctacacaggttcgaaagacgctcttttatattctgtcgagagttcggattgctccacctaagtag

SEQ ID NO: 42239 - DNA, 404 bp, Glycine max
  Peptide Sequence Number=SeqID_133924
atgaaaagagaaaaacatgtctcctatagtagtcataactcttgcaagagcctaagtgaagaacttcgtgactattatgaaggaaggcataggtcacatcttagacctcactcccataggagagaaaatgaaagaaagcctcaagaggttaacattaaactcccatacttccatgggaaggacaatgtagaggccaatttagattgggaaataagggtagagcaacaacttaaaaggaagtctacttcaaaatcttatggctctcactcttatccaaagaaagaccaaggtcaaggaatcttaggggtgagaccttctaagcccaaagatgataagtgtcataccctaatttcgtccggggacctttgctcgatgacgtgtgaccattctttggtcctcgtgag

SEQ ID NO: 42240 - DNA, 836 bp, Glycine max
  Peptide Sequence Number=SeqID_133925
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgataaaattcagcagttcctctgactcttttgggttcatacctgccgctggttcgtcaagtaataacagtttcggctctgttgcaagtgctcttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42241 - DNA, 884 bp, Glycine max
  Peptide Sequence Number=SeqID_133926
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaggacaccgtggcatttttctgctgcttctttgtgggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42242 - DNA, 225 bp, Glycine max
  Peptide Sequence Number=SeqID_133927
atgggctcagaaatctaccctaaggttcatgagaaccctagagccttcttcagcagctctagcccaatcttcttggagcctcttgctcatggttctagtgattggtcccttcctagggaggattgcatcatccccttaaaagtggtgctgactccatactcttctgggagggaatctatccttcctaagatggagccaaacccaatcaccctcattaagaactag

SEQ ID NO: 42243 - DNA, 449 bp, Glycine max
  Peptide Sequence Number=SeqID_133928
atgggggatcccatcagcagactctccttccctggtaggcgcattgttgtcactcaaatcatatgctgctctaaatcagttggaatatttgtctctttgctaaaagcatgtttgcattttagtggagaaaacaccgagactttttcaagtctcacaagttatccagaactacgtaggtctgaattcctcattggaggatacgtaggagcaagagcctcgcttttgtcgaccataccgccttttgttgccatgactcaagagctggtagcccgcggagactccttacggttatccgcacctcgtcattcagtgaccccaagtgtgattgacaagcagagaccaagtttggtcattctgcacccaagatacgcggagataccttacggttatctgcacccctttgctaggcagacacagttgtgtccgatggcaagcagagaccaagtttg

SEQ ID NO: 42244 - DNA, 408 bp, Glycine max
  Peptide Sequence Number=SeqID_133929
atgccgatctccccctgcgaaagtatcggttggtctgtgccatcccaacataggggtcgcgcccacaagacaaccagtggatccggaggagcccaacagggccctggggtttccagctcgggttacgggcctctattagtcctacagggtgcccgtcccccccagcaagggatcgcgcccgcaagacacccagtggacccgaagaagtccaacagggtcttggagttgccagctctgattacgggcctctatcaattctacggagtgtctgtcgcccccagcaagcactgcgcccccaggcaggcgcagggcgaaacaccacagcagcctggggatggccggcagcgggcaacagacgcaccgccaccacctctagagttcacctcagctcatccacaaaaaggttag

SEQ ID NO: 42245 - DNA, 240 bp, Glycine max
  Peptide Sequence Number=SeqID_133930
atgactaaagcatgtcaaaagggggtacggaaagaaaataggggaggagtttgcaacccagctcgcccaggttgcttcctccagaagcaaccgccttctggaggaacatcttcgaaggcccaagtgggcctgaacctcatggattgcgtaacaatgcttccttttgatttctggcatgttacggaacttcacgtattgtgcaacaaagggtgccaaatacctcgaagcggtcaaacaaag

SEQ ID NO: 42246 - DNA, 649 bp, Glycine max
  Peptide Sequence Number=SeqID_133931
atgagaggcaccgtgcatgagcctcaagtgaacataggggccgatcaaaaaggactacacgtcctcgccaacagagggctgcacgccctcaccttaagaggactgtgtgtcctcactttcagaggactgcatgtcctcaccttcagagggctacacgccctcgccatcaaaggactgcgtgtcctcaccttcagagggctacacgccctcgccatcagaggactgcatgtcctcaccttcagagggttacacgccctcgccatcagaggactgcatgtcctcaccttcgtagggctacactccctcacctttagaggactacacgtcctcgccaacagagggctgcacgccctcaccttgagaggactacacgtcctcgccaacgtagggctacacgccctcacctttagaggactacacgtcctcgccaacagagggctgcacgccctcacctttagaggactacacatcctcaccttcagaggactccacgtcctcaccttgagaggattacacgtcctcgccttgagaggactacacgtcctcgccttgagaggactacatgtcctcaccatcagagggctgcacgccctcacctccagaggactacacgtcctcgccttgagagggctacccgccctcgccttgg

SEQ ID NO: 42247 - DNA, 234 bp, Glycine max
  Peptide Sequence Number=SeqID_133932
atgtgtgtgtgtttcttgatttcagaagttgtcatcatcaaaaagggggagattgtagaagcaaagcttcatggtgaatcaaagatgattcaaaggtgttttgatgataacaatgatgatgacaaaggtgatgacaaaaagctcaaagatcaatcaaagaataactcaagtgaatcaaagatcaatcaaagaacaactcaagtgaatcaagaacaattcaagagttcaagataa

SEQ ID NO: 42248 - DNA, 471 bp, Glycine max
  Peptide Sequence Number=SeqID_133933
atggctagatcaccgggtttcgggttctgtttcactcccctcgccggggttcttttcgcctttccctcacggtactggttcactatcggtcagtcaggagtatttagccttggaggatggtccccccatgttcagacaggataccacgtgtcccgccctactcgtcggactcacagctcatgcatcttcgtgtacggggctgtcacccggtcctgggctgctccccgttcgctcgccgctactgggggaatctcggttgatttcttttcctcggggtacttagatgtttcagttcccccggttcgcctcgttaacctatgtattcagttaacgataatgcacaagtgcattgggtttccccattcggacatcgacggctgtagcggttcatatcaccttaccgtcgcttttcgcagattagcacgtccttcatcgcctctgactgccagggcatccaccgtgtacgcttag

SEQ ID NO: 42249 - DNA, 682 bp, Glycine max
  Peptide Sequence Number=SeqID_133934
gttgcaggatgtaccatctgtgggggagctcatgaatctggatgttgtattcctattgaagaacaccccactcatgaagtcaattacatgggaaatcagcccagaaacaacttttaatgcaggaggattttctggattccaacatggccagcaatataatcaacagcatggacaatggaggaaccaccctagaaatcatttcaatagatatcaaggtggaccatccacaaggccacaacaacaagggcctagtctctatgatcgcacaacaaagctggaagagactctagctcaatttatgcaggtttctatgtccaatcaaaagagcacagagtccaccataaagaatcttgaggtccaagtgggacagcttgcaaagcaattggcggatagatcatcaagcaattttacagctaatatagagaaaaatcccaaggaggaatgtaaagctgtgatgactagaagtagaatggcaatccaaggagatgatagtgaagctgaaaagaagatggaggaacataaacaacagctggcacctaagccaacacttgaacctatttctgattttgtagaacttgaaaagattaatgaggagactaaagatgataaggaagaagagacaccaataaaagagaaagaaaaagaaagaacaaaagaagaaaaagaaaaggaaaaaaagtga

SEQ ID NO: 42250 - DNA, 511 bp, Glycine max
  Peptide Sequence Number=SeqID_133935
atgcaaagaagatcttttgtagatgatttgacccccattgatttggatattaacgccacttgtagaaggcataatcaggagagaattagaaattttttgcaggacttagaggtagcagcaattcgagaggaaaaacctcaatcttctgaggcatcttctagttttcctattgcagaacattctcatttagatcatagtgaagactacatcatggctgaaaagccaagaagagttactctggaagattattcaagttctaatgtgccacaatttttcaccagcattgcacaaccagaagttcaagcacaaaccattacttatccaccatcattgattcagaataatttgtttcatggattaccaaatgaagagccatttccacacttagccacttacatagaaatatgcaatactattaggttggctggagtgcctaaagatgcaatccgactaagcttgttttcattttctttatcaggagaagccaagaggtggcttcattcattcaaag

SEQ ID NO: 42251 - DNA, 423 bp, Glycine max
  Peptide Sequence Number=SeqID_133936
ccctgggatttgacggcgaacttaaaaagccacctacagacgctttacgcccaatcattccggataacgcttgcatcctctgtcttaccgcggctgctggcacagagttagccgatgcttattccccggataccgtcattgcttcttctccgggaaaagaagttcatgaccctcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggcatgccgccagcgttcatcctgaaccaggatcgaactctccatgagattcctagttgcattacttatagcttccctg

SEQ ID NO: 42252 - DNA, 282 bp, Glycine max
  Peptide Sequence Number=SeqID_133937
atgacttttatagcccagtctaacacttctagacttgggtttcctgctctgatcaccgcattatttagagccagaggggttgtctttgatagccttacttttgagtgccttagcccggtcattaacttggccaacatcaagaagaactgttgcaatcccgaggatctaacagtttctatccaaggggctaagagggcgagggaaaggccagctgagcttccttccacttctgcagctcctactccagcatccacttcagcagctccttttgtcccagcttag

SEQ ID NO: 42253 - DNA, 582 bp, Glycine max
  Peptide Sequence Number=SeqID_133938
atggcttccaactcccaacaattcagtgcaagaaatgatgctattgtccttagaggagtccatgaggtggccacagattcatcttcatctactgaaaataaaaagcttgaaggaaaacttgatgccttggtcaacctagtaactcaacttgccatgaatcagaaatctgcatttgcacctgttgcaagatcacaacaaagacaacaagcaactgaggcccctcctcaaccttccttagaagagttagtgaggcaaatgaccatccagaatatgcaatttcagcaagagacaaccttcattcagagtctgacaaatcagatggggcagatggctactcagttgaaccaagctcaatcccaaaattctggcaaattgccttcccaaactgtgcagaatccaaaaaatgtgagtgccatcaccttgaggtctggcaaccaaattcaagtgccttcaccagtagcagcacctgcacttaaacctttcaagcttcattctacacttgaaaaagaagatgagatagtttcacaaaagaggaagcttcctgatcagggaccttcttctagtagttctaacttgcaatag

SEQ ID NO: 42254 - DNA, 240 bp, Glycine max
  Peptide Sequence Number=SeqID_133939
atgcccaacattgtgaatttaatgtatttcaacttcaatttcaacgaggcttgtgcgcttagcgagaatcatgcactaagcgaggcactcagcccgcttagcgagttgggagaatctggagtagaatctgagaagcatttgcgcgctcagcgcgtcatcagctcgctcaacgaggtgtttatctcttcctgcgctaagcgcacccagctcactcagcagatattcactaactcgcgctaa

SEQ ID NO: 42255 - DNA, 1123 bp, Glycine max
  Peptide Sequence Number=SeqID_133940
atccagaagaagcaaggttgctatcccctccaagaagaggaaagaaatttcctcatccgattctgataaggatgtcgaactagatgtctcgacatctaagaaggccaagacttcagggaaaaaggtgcctggaaatgtccctgatgcaccattggacaacatctctttccactccattggcaatgttgaaaagtggaaatatgtgtatcaacgcagacttgcggttgagagagaactgggaagagatgccttggattgcaaggagatcatggacctcatcaaggctgctggactgctgaagactgtcagcaagttgggagattgctatgaaggcttagtcagggaattcattgtcaacattccctctgacatatctaacagaaaaagtgatgagtatcaaaaggtgtttgtcagaggaaagtgtgttaaattctcccctgctgtgattaacaaatatctgggcagacctactgatggagtgatagatattgatgtttctgagcatcaaattgccaaggaaatcactgccaaacgagtccagcattggccaaagaaagggaagctttcagcaggaaagctaagtgtgaagtatgccattctgcacaggattggagctgcaaactgggttcccaccaatcatacttccactgttgccacagaatcttttgctatcaaattacacattgccttccctactgtattatgtggcattatgttgagtcagcatcccaatatgttaaactacactgactctgtgatgaagagagaatctcctctatccgtgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatgcagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 42256 - DNA, 839 bp, Glycine max
  Peptide Sequence Number=SeqID_133941
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatcctattgatggcctgtattgatctgtcccattcaatgatgcaatctattgtctaccttgtttttaatgccatggactctgaaccatggcatttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42257 - DNA, 453 bp, Glycine max
  Peptide Sequence Number=SeqID_133942
atggtgaaagttggaacctcttacgtgccgatcaacgtctcattttcgccaaaagttggcccagggcttcccggtatcaacagttggacactccgtggcgcattatttattgcgcattcgagcggtatgaaattggggttatccgctcacaattcgcacacaagcataccgagccggacatcagcggcaagtgtaaagccggggtccgacgctgagctaaccaccacacccgccgcgttaattgcgttgccgctcaggctgcccgctttccaggcgctaaaggcggagtgtgcatacggcgattatatgttgggtaactgtgccagggtgttccagtcgaatgcgttggcgaattggagctccaccgtcggtcgtgcggccgctctagaactagtggatccccacggggcaggaattcgatccgacttcagggatcgcgaagtctatacacaa

SEQ ID NO: 42258 - DNA, 479 bp, Glycine max
  Peptide Sequence Number=SeqID_133943
cttccgattccattccaatgacaagagatctgaatgggagaagcttgactaccagctctgcgctgcccaagaaatttttgccaatgatatccaaagcctgtttgacgcaaccatgaaggttacagccctcaagcaaactagtcatgacatgattgctcatgtgggtaaggctcgggctgccgtggaagagctgaggaagttccttgtagctgattcattggaagaagtgaacaggaaacttgataagttctacatggtccttattctgaggagcctacattcagactttgattatgttcgtgatcaagtacttgctagggaccaagttccatctatggattctttcatcactagacttctccgcgtgcctcatttattgaaggatgagaatcttgccgatggcgtggagacgtcagccatggttgcgtctcgaggaagaggagacagccacaacaacagaggaggtcgcagtggaaggg

SEQ ID NO: 42259 - DNA, 432 bp, Glycine max
  Peptide Sequence Number=SeqID_133944
atggcagcacaattcatccatgaacgagtggagatggagtgcctagagggagtttgggagaccctcgaaggcaatgcgaggtgccgatttcgtggcacgatccgactcacggctacttcgttggtacatccagaggaaccaacatgcacgcttcagcgcactgtggagtggatattacctacacctactccatatctactagtggagccagtccaagtgattgaggtgacgtcatctgaggaagaccccgaggaggacccagaggagctacctcctgagcctgctgtggatgctcttgactttctagagggtgatgaggacccactccctgaggtggattctcccgaggacgtcatgtcggcatttgaggcaggctctatggaggagagcggtcccagagggatagcgactagtggaggttcttcatcatag

SEQ ID NO: 42260 - DNA, 324 bp, Glycine max
  Peptide Sequence Number=SeqID_133945
atggtcaggatgacaaaaggtatagaagacgatgttagtctccccgcgtcaacgggctcgtttgcccctggtttacgaaaggtgtcgataaccataaggacgacaaaaggtgcagaagatgatttagtcagacgacaaaaggtgcagaagacgatgttagtctccgcgcgtcaacggggtcgtttgcccttggttcgaacgaaaggtgcggataaccataaggtaaccccgcatgtgagcctgacttcacaggtcaggacgacaaaaggtggagaagatgatgttagtctctgggcatcatttggctcgtttgcccatggttga

SEQ ID NO: 42261 - DNA, 186 bp, Glycine max
  Peptide Sequence Number=SeqID_133946
atgacaattccaaagactccaaaatccttaaggataggtgattcagtttttcaaaggctgtatgagcttcaaaacaaggaaagggaaacatatggctcaacaagggctatcaaaggaattaattcaaggacgcatcaacaagaatcaagcaaggctattgtgcaagcaatcaatggggcaaaatag

SEQ ID NO: 42262 - DNA, 396 bp, Glycine max
  Peptide Sequence Number=SeqID_133947
atgtattacgggactcaatcagacatccgagtaaaaagttattgtcgtttgaatttgctgagagcttcaacattcaattccgagcgtctcgatatattacgggactcattcagacatccgagtaaaaggttattgtcgtttgaattagctctgaggttcagaattcaatttcgagcgtctcaacgattacgggactcaatcagacatccgagcaaaaagttattgtcgtttgaattagctcagagcttcagaatcaatttcgagcgtatcgatgtattacgggactcaatcagacatccgagcaaaacattattgtcgtttgaatttgctcagagcttcagaattccatttcgatcgtctcgatatattacgggactcaatcagatatccgagtaa

SEQ ID NO: 42263 - DNA, 492 bp, Glycine max
  Peptide Sequence Number=SeqID_133948
atgcaacaacctattctcagatgtccttcgcaacccctgaatattcatgacataacgctgaaagacaaacaagatgaaaattgggggcaactgttcgccccaatgatcagtcaatggaataatcgagctgattttagggtcaatggttatcctcgacaagaggacctattgagctttaactcggactacatggtctggctgaagttgcggagacattacattgatgatctcatgtcttatgtggagaagatagcgatcttatccgaagagcaagagaggatcactgaacctctggcacatggtccaacatcagagcatcaatttccagcacaagagtttcacattctccagccaagtgttgaaactcaaggcataggcaggcgaaagatggttgttgaagcagaagaatattcccaacaaatgacggagcgtgtccatggaatgtattacacgccaccaacattttctcagtatctgacacagatgtattag

SEQ ID NO: 42264 - DNA, 156 bp, Glycine max
  Peptide Sequence Number=SeqID_133949
atggggtttatagggagcatagtgatcgtgaataccgagaaaatatttggagggagtcctctttccaaatgtggatgggttggtggacctggcaacgatcgacgttttttctcgcctatcataaccacaaggaaagtccggttgtcgctatgctag

SEQ ID NO: 42265 - DNA, 590 bp, Glycine max
  Peptide Sequence Number=SeqID_133950
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaaccccatacctgtcgggacccgaaagatggtgaactatgcctgagcggggcgaagccagaggaaactctggtggaggcccgcagcgatactgacgtgcaaatcgatagctggagcccgcgggcgaggtctatcgggccgcgccatggaatcgagagctccaagtgggccatttttggtaagcagaactggcgatgcgggatgaacccggaagctggacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 42266 - DNA, 261 bp, Glycine max
  Peptide Sequence Number=SeqID_133951
atggtcaatgtgctcgccactctagcatccatgttccagctgaccccacatggagactttccgtacattgaattcagatgtcatggcaagcccacacattgctgcctgatagaagatgagcaagatgacaaagagtacccacgtgaggcttccgaaaacgacaagagaacgttacgaaggttagtgatgttcgccctccgggatactacttgtttgtgtgggtgcgaaatctaccggcaagtgcaccagatcgtcaagtaa

SEQ ID NO: 42267 - DNA, 807 bp, Glycine max
  Peptide Sequence Number=SeqID_133952
atgaagcaaactcggaacgacgtagtaggcctgccgcggaagtacttggaaggcaaggcaagggacatggcaagtcaagagaagtggggcccgtttgcggatacactagctttgctgatttttggggttgtcttctttccgaacatggacggtttggtggacttagccgcaattgatgctttccttgcatatcaccatagcaaggaaagtccagtgatggctatcttggcagacttatttgatacctttgaccgaaggtgcgagaaaaacagtgtacgaattgtctgttgcttacccgctctctggacgaagggttgtattaactataatcccgcacttgccataagacagttaggacaccccatgaggggagcgccaacagaagagagtctctcgcctttccttgtgaaggatttaggcgcgcaaagtctcaaggttatacaaagagttcacaaggcgtggagaagtccgttgaggaaagacaaagagcttaggggcatccgtaatggcgtcatcggtggttatcatggatggctaaaagttcatacgcgagggttagattggctctccaagttgaaagttatcaatgaggagaacttcgaagctccggaggaagatgaagaagtccaagctctaaaattagagctagggaaggcaagactcgccaaagaaaagttcaagtcagccgctacacacatccggaaagagtgcactgagttacaagaggaaaacgcggccactgcaagagcccttgaacaagaaaccaaaagggcccgcaaggaggaacatggccgagataaattttga

SEQ ID NO: 42268 - DNA, 1146 bp, Glycine max
  Peptide Sequence Number=SeqID_133953
ggggtcgccgcatttgcccctacggctgcgctggcggtcgcaacaacttttggtacagcatccacgggtaccgctattgctacgttaagcggagctgccgcaacaaatgcagccctggcatggctcggcggcggcgcactggctgcgggtggcggtggcatgtcagcaggaagcgcactactggctctggcgggtccaataggctgggggattggtgctgtaggcatcgctggcggaaccttactagcccgtcgcaaaaacggtaaaatcattgatgaagcacaacaggaagagcgccaggttcgcgcaaaaaccagcgaacttcgcgtgatggaacgtggtgcgcaagaactcaagatgctcacatccgagcactatcatgttggcgaccagcttatcggcagcgcggttaacgccattaatcagacccgcattgatagtgaactgttaaaactatcgcagcaggatcgtgcatttgagttggctggcgaacaaatgcaaaaggtgcgtgatttcatcgcgtcaccgggtaacatcctgggctcaatgagcaccaaacacggtgaaattgctgagcaggtagaagttggcgtgcgcaatgctcgccaggcaatagaagaaagggttcaggatgcctctgatcttagcgccacgtttgtcggagtgggtcgaaccgctccggcggattatatgatagatggcgttgacgtgcagtcaaagtttatcaacggagttaataataacctgaaccatgtccttcagcacatggaaacctatcccaattttacccagggagaatccttttaccatatccccaaagactcctggcaaacgattcaggatgttattgatgggaagccggtggagggcttgagcgaaaaaacaatacaagctatcagggataaagttgcagaaattgaaagtacaacgggaagatcctttaatgatgtcgtgcgtcctggagtttctgattacaaagatgttcagtggggaaaaattgacgaaacgcttgataaacatgatcaggaattagcggaacagaacgaggcaaaaaaatcagaaattattgacgatcaccaaccctccctaagtgaaggcatgcgtgcaaccgcaatgggagccgctttcggtggaaccttgctctga

SEQ ID NO: 42269 - DNA, 264 bp, Glycine max
  Peptide Sequence Number=SeqID_133954
atggagcgttatctacagcacttggttcgccagcaggcggccaaccaccatgggcaggtgcagatacatgagtgtctctaccggttcagccttagtcagcaggggcagggttccgctccttttgcttgccttactccggagcagtttggggctgaggtcgcatggcccggagactggcccgaggcccaggcaggagaggagcctgcaagatcccccagtgaggaagaggaggcccgtatggatgaagatatgactgattgctcg

SEQ ID NO: 42270 - DNA, 1259 bp, Glycine max
  Peptide Sequence Number=SeqID_133955
atgaagcaaactcggaacggcgtagtgggccagccgcggaaatacttggatggcaaggcaagggatatggcaagccaagagaagtgggtcccgtttgcggatatactagctttgctgatttttggggttgtcctctttccgaacgtggacggcttggtggacttagccgcgatcgatgctttccttgcctatcaccatagcaaggagagcccagtggtggctatcttggcagacttatttgatacctttgaccgaaggtgcgagaaaaacaacgcacggattgtctgttgcttgcccgctctctgtgtgtggttggttttgcacctattccaacaagacataagacacctgtgtccgcttcaaagttatcgctcgtgcgtcgaaaaaagtagagttgattgggaccaacacttggttgggataggaggcaatgcgatcaattggtttcctcgatggaaggaaggaaaggagggagttcttttctcgtgtggggactaccctaatgttccgttgatagggacgaggggttgtatcaactataatcccgcacttgccataagacagctaggataccccatgaggggagcgccaacagaagagagtctctcgcctttccttgtgagagattttggcgcgcaaagtctcaaagttatacaaagagtccacaaggcgtggagaagtccgttgaggaaagacaaagagcttaggggcatccgtaatggcgtcatcggtggttatcatggatggctaagagttcatacgcgagggttagattggctccccaaattgaaagttatcaatgaggagaacttcgaagctccagaggaagatgaagaagtccaagctctaaaattagagctagggaaggcaagactcgccaaagaaaagttcaagtcagccgctacgaacatccagaaagagtgcactgagttacgagaggaaaacgcggccactgcaagagcccttgaacaagaaaccaaaagggcccgcaaggaggaacatggccgagataaattccgaggagctttgtggggtagcaacaatgagctcaagctccggagagaggaaagagaccattcacgggtgcatggcatgatcttaaaagaagagttagctgcttgcgcaagatccaagaggagtttggctcaacacttggaagccacggagcaaagcatgctagctatcatagggcagtacaaggaagagttaaaccagtctgtgacccatgaacaaaagctagttgaggatttcgcatacgt

SEQ ID NO: 42271 - DNA, 270 bp, Glycine max
  Peptide Sequence Number=SeqID_133956
atgactgaagcacgtcaaaagggggtacggaaactttcgaagaagttaacggattgcgcaaaaacacctcctttcgatctccgtcacattacggaatttcacggatcgcggcgttacatgttccaaggttcagaagtggagggagttgagagaactaagaaagaagaagaagaaagaagaggaaacaaaaccgaggtgctatcggatcatgattgtgatcaatctctacattgttcctcgttcagtgttcttcgcgctaccgtcggttag

SEQ ID NO: 42272 - DNA, 312 bp, Glycine max
  Peptide Sequence Number=SeqID_133957
atgaagagatacatgatgcgaccaagaaacaagccagagcgagtttactctgtgctcctaattcaggaacctaatggaaaggatccaaaagtaatacattgtggcgatagggactatcagcgacaatgcatcactaaaagaggaaaactccagatgaggcttcactgttatcaagcgaatcggagacccagcatgaccgcagatcgacctccacttcttatgcctcacatagacccgggtatagggcctgatatctcaacgtgtgtgcaaagctgtaggtgccatgtgtgcatagaacaaaaatatttctaa

SEQ ID NO: 42273 - DNA, 47 bp, Glycine max
  Peptide Sequence Number=SeqID_133958
gcgaggatgtgagccctctgatggtgaggacatatagtcctctaaag

SEQ ID NO: 42274 - DNA, 93 bp, Glycine max
  Peptide Sequence Number=SeqID_133959
atgggtgagaactttttgatcgacccctatgtttcacttgaggctcatgcacggtgcccctcattgcccccagtgagggaacctattgcgtga

SEQ ID NO: 42275 - DNA, 411 bp, Glycine max
  Peptide Sequence Number=SeqID_133960
atggggaagaagaagctagagttaggttttgaagaccagaaaattgattttgacttgtttgttgaagacaagcctgctccagaacacaatgttttcttgcaagtaatgggagaaggtcaaaaggttctgaaggtgagaaccaaaatgaacttgctgtataatctgaacattggagcatatcagcctccctttgaatgtccctttgctaaacgcctgcttctcgctaagcgcataatcgttcatgtgctaagccacgagattcaaccgcttagcgcacaaccctggcatatgaggctgattaattccactaagctagccaagctaagcgacagattgatcgctgagcgatggcttcccttggctaagcgagacctagtgtcgccaagcgtaattcattacggccagaattaa

SEQ ID NO: 42276 - DNA, 279 bp, Glycine max
  Peptide Sequence Number=SeqID_133961
atggcattagcgcgtgacttttgtaaggaaacaacccatggggggttttggtttagaataggtagcaaaatacctttggcaatttacactttgggtatgatagcaaaatacttggatgtattagaaataccaagatgtgcacatgtgcaatttttggtaccccaaatgcttggagtatgcatgtatgtgaatttagccaaggagatgtgtgtgatgaatggcaccgaggaagcttgcctcaaagaggtccaggaaggacaaggcggccgaaggaactag

SEQ ID NO: 42277 - DNA, 231 bp, Glycine max
  Peptide Sequence Number=SeqID_133962
atgtcgctgcatgttctttatctttatgtgttttctggatttcccccagggattccccgtctactgggcatgatcatcttgagctaccttctggggcagagacaaaacatggacagcagaaaccaatcaaggtacttaggaacggatgcaagtggggatggggtcacgaccgatcgatcgttgccccttctctgcgctaagcaagcagagaacgtcgtgcaaggcagccca

SEQ ID NO: 42278 - DNA, 698 bp, Glycine max
  Peptide Sequence Number=SeqID_133963
gacacgctttacggcgcccttaccgaactcgtgctagagctagagtaatgggtgaagcagaggaggtgcaagagaagatgaaggccgacatggaggccatgaaagagaaaatggccacaatgatggaggccatgatgagcgtgaagaagataatggaagccaatgcggttgcaattgccgctaccagcgttgttgctaaggtgaacccgacgtccccatccggcatcaaccaaatgaatcatccaacctcagatatggtaggcaaagatttgggaagtacgggcggcccccatgatgtgcaaattcaaaacgagcacgccttcccgccatatggcttgcctctcaactatacgccacccaatgttgcgtacactcccaataagaatgtcaataactccactcctatacccattgagagccagcaaccccaaactgatcatgcacatggcaagcagttggtggtataccctttgaaaacacttcggaaggccctcagtatcacccccagctacacctctgcattccacaacaatgaagattatgcctttgctaacctaaaagagttgttcatagaacccaatatcattacccctcccaagttcaaggtgctggactttgacaagtatagaggggactacttgccccaagaaccatctaaagatgtattatcggaagatgggggcatgcgcaaaaaatga

SEQ ID NO: 42279 - DNA, 711 bp, Glycine max
  Peptide Sequence Number=SeqID_133964
gtagaaggatgccccacatgtgcaggaacccatgagcctggccagtgtgtaagccaacaggatacttctcgagaagtaaactatatgggcgtaccaaatcgcggattccagggctacaaccaggggaactcatctggattccaccaagggggggcaggattcaatcatgggccaccaggattcaatcaaggaaggaacttcacgcaaggttcagggtggaggaatcagggaaaccagtacaaggagcagaggaatcaacaaccataccaaccgccataccaacatcctagtcagggccccaaccagcaagacaagcccaccaacatagaagaactcttgctgcaatttatccaggagacacggtcccatcagaagagcacggatgcagccattcggaatctggaagttcaaatgggccaattggcacaagacaaagctgaacggcccactcgaactttcggggctaacacagagaagaatccaaaggaagaatgcaaggccgtgctgactcgagggcaaaagaaagcacaggaggaaggtaaggttgaagaagaagaccagacagaggaagataggacagagacacaggaggaaaggacagaagaagaagaagagaaggtggcaccaccacctacaaccaagagccagaaagcgcgggaagccaagaaagaagaaccaccagccctaccacaagatctccgatatcctgtg

SEQ ID NO: 42280 - DNA, 144 bp, Glycine max
  Peptide Sequence Number=SeqID_133965
atgacaagacaaacactagcaagtcaggtcactctcactaggcttaaagtagtactcaaaccgggtgaccccaaggcctacactccgaagagtccatcagggcctctccctcctgattcaggtccaacccaaaaaatattttag

SEQ ID NO: 42281 - DNA, 267 bp, Glycine max
  Peptide Sequence Number=SeqID_133966
atgctgcaggtcgacctagaggatcccttgtgtgaacgtgctatcatcttgtatatagcttgtcttgattccagggattgtcatcatcaaaaagggggagattgtagacaaaggatcaagctgaatgttttgatgatgccaaaggatcacatgtttctcaaagctttattcaagacaaagaaattaaagatattcaagatggatgataaagacagtctccagagtcttaggaagggtatattaaataggaagggaattcctaattga

SEQ ID NO: 42282 - DNA, 396 bp, Glycine max
  Peptide Sequence Number=SeqID_133967
atggcgcctaccaggcaccctctggaccaagataagtccaacagggccctgggatttcccgccttgatcacgggactctgccagtcgttccgcgtccccgtcacacctagcaaggtgattcgaccgcccatcacccgagcttttattgagaagtactgcacgcagagacaggtccagggtgatgcaccacaggccgcggacgcgccaccaccttatcaggctggtccagccggatcatttgatacagagcaggcagaggtcgcatggcctggagattggcccgaggcccaggcaggagaagcaccagcagaggctcccgacgaggcagatgaggcccacgaggacgaagagatgatcgatttactttatttcttaggagggagcggtgccacatga

SEQ ID NO: 42283 - DNA, 267 bp, Glycine max
  Peptide Sequence Number=SeqID_133968
ctaagagcctcagttctaaatttcgagcttctcgatacactacgggatacaatcggacatccgagtaaaaagttattgtcgtttgatactgctcagagcttctattctaaattcaagcgtctcgatatactacgggacacaatcagacatccgagtaaaaagttatcgtcggttgaatttgctcagagcttccgttttcaaatacgagcgtctcgatatattacaggattcattcggacatccgtgttgaaagttattgtcgtttga

SEQ ID NO: 42284 - DNA, 315 bp, Glycine max
  Peptide Sequence Number=SeqID_133969
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggggcggcgtccccattcgccattcaggctgcgcaactgttgggaagggcgatcggtgcgggcctcttcgctattacgccagctgggcgaaagggggatgtgctgcaaggcgattaagttgggtaacgccagggttttcccagtcacgacgttgtaa

SEQ ID NO: 42285 - DNA, 192 bp, Glycine max
  Peptide Sequence Number=SeqID_133970
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcaccctgcgcgtaaccaccacacccgccgcgcttaa

SEQ ID NO: 42286 - DNA, 240 bp, Glycine max
  Peptide Sequence Number=SeqID_133971
atggctcgcttagcgcgcataagtggcttttggcttagcgccagtcttctcgctcagcttggaggatgcaggcggtgtgcttactcatccttcttccagagtcttctatgcgctcatccagccgatgttgcgcttagtggattgctcgctcagtgtgtgaaacggcttagcgaatcaataaattttgcacttcaccaatcttgcccattttacctaaaattgaaatggaatgatcattaa

SEQ ID NO: 42287 - DNA, 459 bp, Glycine max
  Peptide Sequence Number=SeqID_133972
atggcgcctaccaggcaccctctggacccagataagttcaacagggccctgggatttcccgccttgatcacaggactctgccagtcgttcggcgtccccgtcacacctagcaaggcgattcggccacccatcacccgagcttttattgagaagtactgcacgcagagactggtccggccggatcatttaacacggagcagtatttgcggcatttggttcaccagcaggcggccaaccaccgggcacatcctgcagagccagggctttacttctttttcgtgccctactccggaccagttcagggcagaggtcgcatggcctggagattggcttgaggccgaggcaggagaggcaccagcaggggcaccagcagaggctcccgacgaggcagatgaggcccgcgaggatgaagagatgaccgatttactggatttcttaggagggagcggtgccacatga

SEQ ID NO: 42288 - DNA, 177 bp, Glycine max
  Peptide Sequence Number=SeqID_133973
atgaggggccaagacatttatagtagccaagatgaggttactacttcgccttcctctagtgaaagtgaagaagcaaaagaggaagaatctagtgaagaaatctacctccaagaagaaggggggggggaccttttaatgatagtggttcatgttgcaattgttgcagcacaagattag

SEQ ID NO: 42289 - DNA, 375 bp, Glycine max
  Peptide Sequence Number=SeqID_133974
ggctacacgccctcaccttgggtactagttaccctcaccgttgagagggctgcacgccctcacctccagaggactacacgtcctcgcctcagagggttgcacgccctcaactctagaggactacatgtcctcgccttgagagggctacacgtcctcaccttgggattacacgtcctcaccttgagaggactacacgtcctcaccatcagagggctgcacgccctcacctccagaggactacatgtcctcgccttgagagggctacacgccctcaccttgggtactagttaccctcaccgtcagaggactacacgtcctcgccttgagaggactacacgtcctcaccaccagagggctgcacgccctcacctctag

SEQ ID NO: 42290 - DNA, 642 bp, Glycine max
  Peptide Sequence Number=SeqID_133975
atgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacctgatgctcccatctggcctcaagcaaatgaatcatccaacctcaaatatggtaggcaaatatttgggaagtacggatgaccccatgatgtgcaaattcaaaacaagcacgccttctcgccatatggcttgcctcccaaactatacaccacccaatgtggcgtacattcccaatgaggatgtcaataactccactcccatactcattaagagccaacaacctcaatctgatcatgcacatgtctctcgacccatggaggagacacatgaaattccccaccacaatctagctgacttcgagccttggctcagatatgccaccgaagggcaagcagttggtggtataccctttgaaaacactttggagggccctcagtttcgcccacaaccacaaccctcgcgttccacagtggttaaaaaccctcatgactatggcagaaatgggaaagttggatcatctagaggaaaggctcagggccattga

SEQ ID NO: 42291 - DNA, 483 bp, Glycine max
  Peptide Sequence Number=SeqID_133976
atgaagaaaagaggtacaggccatcaaagtgtgtcattggagaataagacaggagattcaactgtgctgaagatagaagattcggctaaagttgtgataaaacaagacatgaagggaagaaggcataaatatgggtttaacaacaataaacgtgagaaaccagagaagatcatgggttctccacttgcctcccctcctcctcctccacctcctcctcctactctttcggacgcatcgacttcgccatctgccgtgaagcggacacgcaaagcctcacgtctacgatcattgtctactagaccacctagtgttgagagaccagtagtccatgttgatccagctaccgacaaggtcgacggtccccacaggaagaaattaagaacatatttggggattgtggcgcatgataaggtggacgtcacctacgagaactggaaggaggtccctactgctcaaaaggacctgatttgggaggatatttag

SEQ ID NO: 42292 - DNA, 836 bp, Glycine max
  Peptide Sequence Number=SeqID_133977
atggtgaaagttggaacctcttacgtgccgatcaacgtctcattttcgccaaaaagttggcccagggctttccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgccgtttttagttgacagatcgacgatactgcgacctctgttagacttggcttgcttgttagcaccagcctcaatcagcactttggctgctgcttggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42293 - DNA, 441 bp, Glycine max
  Peptide Sequence Number=SeqID_133978
atgagagaaaatgaaagaaagcctcaagaggctaacattaacctcccatacttccatgggaaggacaatgtagaggcttacttagattgggaaataaggatagagcaaaaacttaaaagaaagtctactttaaaatcttatggatctcattcttatccaaagaaagaccaaggtctaggtatcttaggggcagcaccttctaagagaaagacaatagaaaaacaaccccctaaggcaagtatgcaagagaaaactagctatataaagtgctttaaatgtcttggaagaggacacattacttctcaatgccccaccacaaaaaccatgattatgagggaccaagacatttatagtagccaagataaggctactacttcaccttcctctagtgaaagtgaaaaagcaaaaggggaagaatctagtgaagaaatctacccctaa

SEQ ID NO: 42294 - DNA, 462 bp, Glycine max
  Peptide Sequence Number=SeqID_133979
atgaagaaagagtttgtgctaatgcatgggttagaggacttgggacattctcttttgtacacaaccttgttgctagatgcaacaattgcatcagctaaggaggacattacaagaagagaatgtgaattgatccatgtgaatgacctcttaagcagggtcatcaaggagagacatgaggcacaaccaaaatgccaaaagctaatgctggaaaaactagaactccaacagaagcaacagctagaacaacaccaatttgttcaaacacatcaaagagataccatatcacaaagtgaagaagagcagcaagaaggcttctctgaaaagaattctgcatcttctgactgtgaagaaaacagcagcatgccctctcctggtggaagctggaccactgcttcaggcacttctcttagcaggactagtcccacagtggcaacaccctcctccacaactcaaacggcttag

SEQ ID NO: 42295 - DNA, 1023 bp, Glycine max
  Peptide Sequence Number=SeqID_133980
atgggaaacgaaacacatgtcgatggaggcgttggctttgtatgcgagttactggctttctacatcgccctattaacatcggttattgctaaaacgatgttaacgaaagcgcggtggcatttttatttcacaagccgcacgcgctcgaaaaccttgccctccctcttctctttgtcatcctcctgcctgaaatcgctcttctctttctcctcccgcctgaaatctgctggaaaccgcttccttgacacccacattgtcctcgctcgaacccacagaaccccctacactgtcggaaaacccacattgtcctcactcgaacccactgaaccccctacactgttcttggaagtctggctcaaagaaaaccctacatacactgttgctactagggtgctgaaacactcgtgggtgctcaaagctcaaagctttctccgcgaggtacgtaggtcaacttcgtgtatgctaagttttcgtggatgttcatgttttattgatgataataatacatcttcagttgcaatattgctgattgaggtacgaggaaagcttaaagtttcgtgccattttgttagatctcactgccattgtcattgtttgggttcgagactgctcggagcaccagtagagataactagtgataaggatcctgttattgtggcttctggtttatgtaaggtttcatacgtaggaacacctagtgtttggccttgtttcgttcagatcgatccttgcagctctaaggtagctactgggaattttgttgtttgtgccatgccagagtttgtttgcttcatggctaagttattgcatagattgatgctgtgtagtagtagtgttacaagttttgttcgccatccaatggccttattgaataccattttttatgcctctttgaaactagtcaatgcaaagaaaaagaatttcaagaaggcctacgatgatctcctaactcacccttcactcctctgcatgttccctcatgatcccacctcaagactcagttcatcttcgtgcacaatgtga

SEQ ID NO: 42296 - DNA, 761 bp, Glycine max
  Peptide Sequence Number=SeqID_133981
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtggatgccatctgcgtcgagattcattgcgctctgcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42297 - DNA, 252 bp, Glycine max
  Peptide Sequence Number=SeqID_133982
atgcagcacctgtatgaaagtcagtaccatcccgttaaggactggttttgttgttcatatgtcaagggctggcccccgtcaattcctttgagtttcggtcttgcgaccgtactccccaggcggagtgtttcacgcgttagctgggcccctgatccacgtagaccaagggcgaacactcatcgtttacggcatggactaccagggtatctaatcccgttcgctccccatgctttcgcactccagcgtcggtag

SEQ ID NO: 42298 - DNA, 213 bp, Glycine max
  Peptide Sequence Number=SeqID_133983
atgctgccatactattttcagattccattaggagcgattttagccattgttgatcctgtggtgataggcattgttgagaagccagaggtcattgctgttttgaaattaattaaaagtggtcttgcggtcattgctggaaagtcaattgtgttgaagcctcgaactcagaactatttgatttatacgcaccagttgttgctaagtacaacataa

SEQ ID NO: 42299 - DNA, 818 bp, Glycine max
  Peptide Sequence Number=SeqID_133984
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatattcatcttaaggagttctgtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42300 - DNA, 168 bp, Glycine max
  Peptide Sequence Number=SeqID_133985
atgacttgtcctcttggcccagaggttcatcgtgctgacttccgagcaatcaactctctccaaccttatggaaacctcgaacctgtttctccgttcgtggctctggaatttcaagaatgggccttcacattctcgggatctatctctatccctttctggctcacataa

SEQ ID NO: 42301 - DNA, 285 bp, Glycine max
  Peptide Sequence Number=SeqID_133986
atggtggagaagttcctgaagaagtatttcctggagtccaagaccgttgagagaaagactcctacacatgggtttagcgagccagtccagctcaacatcttcattgatggcttgcaaccccattccaagcagctccacgatgtctcaactggtgggaagatcaagttaaagactctagaagaagctatggagctgatagagaatatggcggctagtgatcatgccattctttgtgatcgagcctatatgcctacaaagaaaagtcttcttgagctcacttcttaa

SEQ ID NO: 42302 - DNA, 519 bp, Glycine max
  Peptide Sequence Number=SeqID_133987
gtcatgttggtgcgaatgatccgcactcgtctctttgcagcggcacgggtgaaatcttgccccggtatgcatagtagctgtgtgatagcctccctctctggttgtgctcgcacagttggccgtcctccaatatcaaggggtggcccaggaaccgtgcggatgtggagcacactgaaaatgaggacacgtagccctctaaaggtgagggcgtgcagccctctcaaggcgaggacgtgtagtcctctggaggtgagggcgtgtagccctctgatggtgaggacgtgtagtcctctcaaagtgagggcgtgtagccctacgaaggtgaggacatgcagtcctctgatggcgagggcgtgtagccctctgaaggtgaggacgtgtagtcctctaaaggtgagggcgtgtagccctacgaaggtgatagggtacaagtacccaagggtccacccttatgagaaagcaagagatcgactcatcgagagggctggtcatcccaaatccacaagatttggacattag

SEQ ID NO: 42303 - DNA, 123 bp, Glycine max
  Peptide Sequence Number=SeqID_133988
atggaaataaattacgagccttggggaactccgagataccatttttctaagggtgcctgcaaaaatctcatcaaaattcgatgtctaggtcccaattttggccttatgtctcctcgcgaaaag

SEQ ID NO: 42304 - DNA, 818 bp, Glycine max
  Peptide Sequence Number=SeqID_133989
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgtgttgcataatggcattggttcttgtagtgatattctttgataactcaagtccatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42305 - DNA, 372 bp, Glycine max
  Peptide Sequence Number=SeqID_133990
atggatttcttttccaatgagagttttgaatgcattcaggcatttgaaaactccaatctcattcttttcatgtctttaaaaatgcctgtttatactgaattagttaaagccttctattctaacctagaaattcaagaaggcactttaatttctgaagtttatgggataaaaatggtcattgaccaatccctattctatgacttgacccaattatctagtgaaggtgtaccatttgaagttggtttgcaccaaccaagcagatatgaccggaaggcttcttgtcagttcattggctttggaaagccgcatccttcattatctcattttgcgtatcatgcttccaagatcttcaaaccttgcacaggtttctga

SEQ ID NO: 42306 - DNA, 462 bp, Glycine max
  Peptide Sequence Number=SeqID_133991
atgaccatgattacgccaagctcgaaattaaccctcactaaagggaacaaaagctgctacccaacagagatttgtgcagtgtttatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42307 - DNA, 303 bp, Glycine max
  Peptide Sequence Number=SeqID_133992
atggctgaatttgatgctgagagtgaatctgaaattgatattgattacatgtctggtgatgttttacctcttgagattgattttctagagttagatagaactaaccatgtttcaggaagtacacatacctctgactttctttatgaggtacaggctgagaaaccatctctttctaccattatccatccgcccacaccagaatcgaagcctctgccatcaaatttaaaatatgcttacttagatgatagttgtcataacctaatttcgtccggggactattgcttgatgacatgcaacctttga

SEQ ID NO: 42308 - DNA, 324 bp, Glycine max
  Peptide Sequence Number=SeqID_133993
atggctacaccacccagctctcctcctcctcctcctcttcttactggtgtagcatcacattcatcgtctaccttgaagcagacaagaaaagccacacgcttaagatcattggtgactagaccagttggggcaaagagaccattggtctatgtggatcctgcgaccgggaaagccgatggtcctcacagaaagaggttaagaacatatttggcgatcgctactgccgacaagaatagtgttgatgacactgtatgtgaaaagtacgacattagtaaggagaagtgggcccaattttgtcagagccgcagagacccttcgtgggag

SEQ ID NO: 42309 - DNA, 381 bp, Glycine max
  Peptide Sequence Number=SeqID_133994
atggcttcaaagatgtggaagtgcttgacagttggcttcctccctttccagatttcataccagtgtggttggagtccctcttctaagtgtgactctgttgtggatagaatcatgagtgatgccttcggatgtgcagaatcagtaaacttactcaactccttgaatacttcaaaggtgtctgatttctctctgataaagttgacccagcaccctggaagtggtctgatgttgaagcttctggtgggacatcttgacttgctttccaatctgacattcaccacagattctgccttcttctattttcagattgggaatgcctctacagcacctttgtcaatgattttcttcatgcctcttaagtgcagatgtccaaatctttga

SEQ ID NO: 42310 - DNA, 243 bp, Glycine max
  Peptide Sequence Number=SeqID_133995
atggctgcaagtgaaaggggttcccttgtgtcacatcaacaaaagctttgtcagcgcggatccgataatgagtcctgtgaaggtaatgataccgaggagctagacgtcgattttgagcaactggtaaaccaagctgaggatggggaagatgaggattgggggtttccctcagagctaaaaagaatggttgaacaagaagacaaggaagttgatgcaatcctaccccgcaagggcattggatag

SEQ ID NO: 42311 - DNA, 439 bp, Glycine max
  Peptide Sequence Number=SeqID_133996
atgggacatctccagatgcaagccttccgcaaggcgtacgaaaagattttagatttggccatagcagagatatccatagaagccgttgtatcactcacccaatactatgaccagcctttgagatgcttcatgtttggagacttccaattagtaccaactgtcgaagaatttgaggagattctaggatgtcctcttgggggaaggaaaccgtatcttttctccgggtttcttccctccttgagcaagattgcagatgtggtcagggattcggcgagaggattggatcgtgtaaagcaaactcgaaacgccgtagtgggcctaccacagaagtacttagaaggcaaggcaagggatatggagaatcaagaggagtgggtcccgtttatggacgtattagcattgctaatctttggggttgtcctctttccaaacatggatg

SEQ ID NO: 42312 - DNA, 93 bp, Glycine max
  Peptide Sequence Number=SeqID_133997
atgaacagcagaaaccaacccaaggtacttaggaacgaaggcaattggggatggggtcacgaccgactgatcgtcgccccttccctgcgctaa

SEQ ID NO: 42313 - DNA, 343 bp, Glycine max
  Peptide Sequence Number=SeqID_133998
gtactgcacaactagacaggcacagggtggtgacgcacaggccctagacgcaccgccgccacctcctcaggctgatccagctgggtcatttgacacggagcggtatttacggcatttggttcgccagcaggcggccaaccacagggcgcacagccagggtttcccttcgtttccatgccctactccggatcagttcagggaagaggttgcatggcccggagattggcctgaggctcaggcaggggaggcacccgcagaggctcccggcgatgcagataaggcccgcatggacaaggagatgaccaatttgctcgatttcttgggagggagcggagccacatga

SEQ ID NO: 42314 - DNA, 369 bp, Glycine max
  Peptide Sequence Number=SeqID_133999
ccggagctgctcctactgactatgactggacagcagtggactctttctcaaagcttcatttcccgagtggacgagaagaaggagcaagcccctatttaagtgaagggaagagaatcaaggctattttactttactttactagactagctaccgagctgactcaactcaaggaagccgggaaagaaagggcttcaagacagcttcggcaacagaaactcgagctgaggaatacggaagagaagcggattcaactcaatcttagcctaagagcagttcagagaagagaatcaaaggcttcaagccctgtttcagcggagagcatggattcccctggcacctctcttccacagcttggcacgtttaaagaag

SEQ ID NO: 42315 - DNA, 390 bp, Glycine max
  Peptide Sequence Number=SeqID_134000
atgacatttctacttagcaacattctgcccagcgaccgcaatgccaatctccccctgcaaaagtatcagttggtctgtgtcgtcccgacatggggatcgcacccacaaagacacccagtggacctgaagaagtccaacagggccctggggtttccagctctggttacgggcctctgtcggccctacagggcacccgttccccccagcaagttcatgtcgtcgtggcatagggagtgcctgtcatgcgtcgccctcacaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 42316 - DNA, 570 bp, Glycine max
  Peptide Sequence Number=SeqID_134001
atgaaagctaacaaaacaagaaatgaattgaaagtctcggattcgaaaaattacccgttgaagaacgaagaacggatgaagaacgacggaaaaccttcacggattcgctcaaggaaacgtctcggaagcgttacggaagcacctcggctcggattttcttcatggaaattagggtatgacacttgggaagggtacattgatattgtggtacctagaaagatactccctgagcgaaatgtggtaatctaccatactgagtttgatgagttcaaggaacaactggagagaagaaaatgggatgaggaattgaccagttttgatggaggcagcattgatgttccattgtttgcactcctgaggcttgaccctcaggaattggcagccaagctctgcatcccaggtaggggatttgagcttaatgttgacggcttgccactgaagatccttaagaagaacttggcgacccttgatcagacatggagcgttctttctttctccaacttgatccctacctcacacacatcagatataactctggatggggcaaagttgatttatggtataacttag

SEQ ID NO: 42317 - DNA, 321 bp, Glycine max
  Peptide Sequence Number=SeqID_134002
atgataccgacccaggaaggtgaccagcccagacatgcacctgccccagaccatgcggagtacatgcagccggccatcccacaggtttcagtagcatttgacccctctccacatgcagtggatgtttacgaaggctatgaggcgattgcagaaaggttggagcgtgtgctcaaccttaggatggtcactgcaggcacagagttacatgatattatgcaagattgcctcacgatcgccaggggggtgccagtgcaaatggaagtgtcagggctcgacagagacggtgcacaaagcattgattattgtttttatgttttgtag

SEQ ID NO: 42318 - DNA, 492 bp, Glycine max
  Peptide Sequence Number=SeqID_134003
atggcgccgactaggcaccctttggacccggataagtccaacagggccctgggatttcccgcattgatcacaggactttgtcagtcgttcggagtccccgtcgcacctagcaaggtgattcggccacccatcacccgggcttttattgagaagtattacacgcagagaccggcccagggtgatgaaccacaggccgcagacgcgctgccacctcatcaggctgggcccaactgggcggccaaccaccgggcgcacgtacagacccatggctgtctttaccagctgagcctcagcctgcagagccagggttttacttcttttccatgccctactccggatcagttcagggcagaggtcgcatggcccagagattggcctgaggcccaggcaggggaggcacccgtagaggctcctggtgaggcagatgaggcccgcgaggatgaggagatgatcgatttgcttgatttcttgggagggagcggagccacatga

SEQ ID NO: 42319 - DNA, 189 bp, Glycine max
  Peptide Sequence Number=SeqID_134004
gtgatgttcgtcatggaagtgcggaagacagactttgtgggtgttttagggatggcctttgtggataactgggtggtgggtaaggagaaggttggttattggctgagtaatgacattgttgggttggtgggaaacttggctacccgctttgatccttctgccggtgaagaccaaatccgcaaagcttga

SEQ ID NO: 42320 - DNA, 887 bp, Glycine max
  Peptide Sequence Number=SeqID_134005
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatagtccactcagctgacaggtgtgccaccatgctctcgcctcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42321 - DNA, 845 bp, Glycine max
  Peptide Sequence Number=SeqID_134006
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcactgccacagttcaccctatggcggtcaccacagtggagacaggacaactaacaagggacatttctcggaggaatgagatgccattgcaacacatcatggaagtagaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaa

SEQ ID NO: 42322 - DNA, 627 bp, Glycine max
  Peptide Sequence Number=SeqID_134007
atggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagcttaaatccttgtgctttgttggtgcccaaaataggtattattaggcaccaaatccctaaaataggtggtatgatgaatgctttgggtggtgcaacactcatttgtaaaatcactcgtgcacccaacatcttcatgatttgtgtacatagggactcattaggtaggaataatcaacatgaaaatacagaaaaaggggttcctatgaaccctaagagaataaaagtcattcctgagtggcccgctccaccaagtgtaagaaaaatttggggctttcatgacttaacaaacttttacaaaagcaccactcatcgagttggtgaggaactatgttccttcatgggaagatgcccaaaaaatgagttttcagaccttaccttacttcaacatactgaacaccactaa

SEQ ID NO: 42323 - DNA, 782 bp, Glycine max
  Peptide Sequence Number=SeqID_134008
tcctctttctgaatgtggataggttggtggacctggcagcgatcgatgcttttctcgcctatcataaccacaaggaaagcccggttgtcgctatgctagccgacctatatgacaccttcgaccgaagatgtgaaaagagcaatacaaggattgtttgttgtactccagctctttatgtatggttagtttcacatctttttcgccaagaggtgaggcatgcttgcccgctagaaagccaccgttcatgcacagagaaaggagggccaaattgggaccaactcttagcaagcaaagaaggagcatctgtcaacttgttccctcgatggaaggaaggaagaaccggggttcttatttcatgcggaggatttccaaatgttcccttgatggggacgaggggttgcatcagctacaatctcgttcttgctataagacaacttggctaccctatgagaggggcgccactagaggatgagctcgcgcctgtcatttcacgaggcttcaataagaccaacatggagacacttcagaaggaagttgaggcaccggaggaagacgaagaagtgcaggcccttagggcggaactcgagcaagcccaaatagttaaagaaaggttcaaatcagcagctctgaaaatccgaaaagagaataccgaactgagagatgtaaatgtggctaccaccaaagccttggaacgagaaaccaagagggcttgtagggaagaacacggccggaacaaattccgaggggctctgtggggtagcaatagtgagcttaaactctga

SEQ ID NO: 42324 - DNA, 360 bp, Glycine max
  Peptide Sequence Number=SeqID_134009
atggaggccggaaacacatacgtttcacatgagatgcggagagtgtactatcactctacaagacgtctctgtgttgttaggtggctgcgacgtggaaaccaacatatcgacaatgatgatgtgaaagtttttcgtcgcaagttcgatattatgaaacgtcatgagtttgtgtgggagccttacccatcaaccgttatgtcattcttgcctcccgtttgtttagtcggaagtctcgcgtggtacgcggtggtgccactaatttgtttccaagttattgagtggcaccaaccggacagagtcttgagacaatttgggatgcaacaaccagttccagagtctccttcacaagggatcctctag

SEQ ID NO: 42325 - DNA, 573 bp, Glycine max
  Peptide Sequence Number=SeqID_134010
atgggattaagtcaaaagccttcgtttaaaaagaggttctatcaagtcaaaatcaagagcttagaggtcactagtttacgagagttggggcaattaatgggtcaacttcaacggcaagccttccgcaaagcctatgaatttctaaaaagtccaaatctcggcgcaggaattagaccgccaaaggcaagtcgaaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 42326 - DNA, 303 bp, Glycine max
  Peptide Sequence Number=SeqID_134011
atgcggggttaccctatggttacccgcagctttggtcaactaggggcaaacgagcccgttggcgcgcggagatttacatcgtcctcgacacctttttccgtcttgacccgggcaaacgcgcacgttgacgcgcggagactaacattgtttgctgcaccttttgtcgtcctgacccgtgaagtcaatggatatgcggggttaccatatggttacccgcacctttggtcaaccaggggcaaacgagcccgttggcgcgcggagactaacatcatcttctacaccttttgtcgtcctgacccgtga

SEQ ID NO: 42327 - DNA, 237 bp, Glycine max
  Peptide Sequence Number=SeqID_134012
atggcctctgattttcatgtgcaaaagctgtgtaattcgtgtttgggcactggtaatcgattacatactttgatcgcgatggcagcgcagttgatccatgatcgcgtagtgatggagtccctagagggtgtttgggagaccctcgaaggcaatgagaggttccgattccgtggcacaattcgacttactgctacttcattagtacatccggaggaaccttcacgcacgcttcagtaa

SEQ ID NO: 42328 - DNA, 456 bp, Glycine max
  Peptide Sequence Number=SeqID_134013
atgaccatgattacgccaagctcgaaattaaccctcactaaagggaacaaaagctggtaccgggccccccctcgaggagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42329 - DNA, 378 bp, Glycine max
  Peptide Sequence Number=SeqID_134014
atgaacccagatttcaaccaaccacgaggcgggtgctcgcggggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccggagtcgcacttaacagatttgagttccttgggggcacgaagcgccgggggtttgtgtttgtcgcgaggacgaggaggccgggcgcacgggcgccgtggtcatccccttcccttcccgacggtagatga

SEQ ID NO: 42330 - DNA, 375 bp, Glycine max
  Peptide Sequence Number=SeqID_134015
atgtcaggatttacacgcaattctcctcaaatttcagccagcccgcatcaattagaccttgcaccttacgcttcagagccctaccatgctcaatggaacgccccggggcttctccgtgacaagcacacgttgcgttcgagtcgtattctcgaagaaatggaggttgatgaaccttggctagggttatggctaccattgaattatcaagtagatatgggatcaagtttagcatatgacaacagaatttggggtgaaccctacaagctttttgctgcaaaattcctttttgttggtggtcttcgtcattggaagtgcggtagacagactttagttgatttagggatggcctttgtggataactgggtggtggggtaa

SEQ ID NO: 42331 - DNA, 650 bp, Glycine max
  Peptide Sequence Number=SeqID_134016
atggtgaaagttgggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcacttccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 42332 - DNA, 207 bp, Glycine max
  Peptide Sequence Number=SeqID_134017
atggatggcgaggaagggcagagtcgtcttaggccacgatcagaagtcgagacaaagttgacggcagaaatcaaccaaggtactgatgcaatcctccctaggaagggaccaatcactagaaccatgagcaagaggctacaagaagattgggctagagctgctgaagaaggccctagggttctcatgaaccttagggtagatttctga

SEQ ID NO: 42333 - DNA, 693 bp, Glycine max
  Peptide Sequence Number=SeqID_134018
gaaatcactgccaaacgagtccagcattggccaaggaaagggaagctttcagcagggaagctaagtgtgaagtatgcaattctgcacaggattggagctgcaaactgggttcccaccaatcatacttccactgttgccacaggtttgggtaaatttctgtatgctgttggaaccaaatccaaatttaattttggaaactatatctttgatcaaactgttaagcattcagaatcatttgctgtcaaattacccattgccttccctactgtattatgtggcattatgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 42334 - DNA, 410 bp, Glycine max
  Peptide Sequence Number=SeqID_134019
atgttggttcctaagttgtggttctttcctgttgggggtttgcaaaagacaattattagcattgccacacctcttgggcttgagtttattcctcaagtaaaggagttgttggatgggggtttggttcgcaagagcttaaatccttgtgctttgttggtgcccaaaataggtattattaggtaccaaatccctaaaataggtggtatgatgaatgttttgagtggtgcaaccctcttttgtaaaatcactcgtgcacccaacaacttcatgatttgtgtacatagggactcattaggtagtgatcaaggggttcccatgaaccctaagagaataaaggtcattcctgagtggcctactccaccaagtgttgaggaaaaaagcccagagtttcaagaccctcaggatttgag

SEQ ID NO: 42335 - DNA, 243 bp, Glycine max
  Peptide Sequence Number=SeqID_134020
atgaaaccgacaaaagaggaagtcatgatattgcacgagattagaaggcctaactctcgaaaaacagtccccagtggagtcgccaactgtcgcaacctacccttcggcgggagggcgacgcggggctcacgggtgcgtcttccaagggaggaagggtgtttccctcgctcctacgtatcctcaattgcgatgaggaaatcagacctatgtagttctctcaaaagtggtaaagttacatgttga

SEQ ID NO: 42336 - DNA, 252 bp, Glycine max
  Peptide Sequence Number=SeqID_134021
atggataaagttgatatctttgtccctcatcctctcacaaacgcatgtttgcttattcaactttcatcggaatgtgggtgcaagccattggtctgtttgctcaagcgacctgcgctcctgagtgttgacttccaagactgttcaatcagagattactcgtcttgcacgttggtggggttgccaaagtttgtcttcttagagaagcgagttgtcaagaataggatgttggacaaatggcctcagttaccttaa

SEQ ID NO: 42337 - DNA, 291 bp, Glycine max
  Peptide Sequence Number=SeqID_134022
atggggagtgagcaaagtgatttgattcccattgatttggagattaacgccacttgtagaaggcgtaatcaagagagaattagaaaaattttgcaggacttagaggcagcagcaactccagaggaagaacctcaatcttctgaggcatcttctagttttcctattgcagaacattctcatttagatcctactgaagactacatcatggctgaagagccaagaagagctactctggaagattattcaagttctaatgtgccacaatttttcaccagcattgcacaaccaaaa

SEQ ID NO: 42338 - DNA, 537 bp, Glycine max
  Peptide Sequence Number=SeqID_134023
atggaagcacaaccagagagggaggctatcacacagttactatgcattccggggcaagatttcacccgtgccgttgcaaagagacgaggatcgcgcccacaagacacccagtggacccggagacgtccaacagggccctgggtttccagctctggttacgggcctctatcagtcctacagggtgcccgtaccctcccggcaaggtcatgccatcccaacatagggatcgcgcccgcaggacacccggtggacccaaagaagtccaacagggtcctggggtttccaactctgattacaggcctctgtcagttttacggaatgcctgtcacccccaacaaggtcattaggccccgcattaaccgggctttcatcaagaagtactgcgccccctggcaggcgcagggcgagacaacacaacagcatggggacggctggcagcgggccatagatgcaccgccaccacctctagagttcacctcagctcatccacaaaaaggtttgtgtgttgcctatgacacagggccgaccaataggtaa

SEQ ID NO: 42339 - DNA, 438 bp, Glycine max
  Peptide Sequence Number=SeqID_134024
atgcaaggtttggattggcttacgagttttagaaccactaaaagggaggaagttgaggcaccggaggaagacgaagaagtgcaggcccttagggcggaacttgagcaagcccaaacagttaaagaaaggttcaaatcagtagctctgaaaatccaaaaggaaaataccgaactgagagatgtaaatgtggctaccatcaaagccttggaacgagaaaccaagagggcttgtagggaagaacacggccggaacaaattcggaggggctctgtgggtcagcaactgcgagcttaaactccaaagagaggaaagggaccaatcacgagtagacagtttgatcttgaaagatgaattgaaggcttgctcgaggtctaaaagaagtttgtctcagcgattatgcgagacagagaccaacatgttagctatcatcaccaagtaa

SEQ ID NO: 42340 - DNA, 240 bp, Glycine max
  Peptide Sequence Number=SeqID_134025
atgcaaaaatgccctaggtgtggggtatcatggtacaaagtgaaggatgatgacaagggtagcaatgacgaaaactcaaagaaaggccccccaacgaagtggatgtaccctccactagaactgatccacaagagatgtaccctctcttgttctcaatcaaacccaagtagatgtaccctctacttgtaccacaaaggatgtaccctccaacgtgttaagacaaagatctcaggcggttaa

SEQ ID NO: 42341 - DNA, 47 bp, Glycine max
  Peptide Sequence Number=SeqID_134026
atgacggtgttcgcgactaaccgtattcccaacgataaaactgtcat

SEQ ID NO: 42342 - DNA, 600 bp, Glycine max
  Peptide Sequence Number=SeqID_134027
atgcctaagtgccagctggtgtacgccatcctgacacggatgagcatccatgtggctcagttgatcgctgatgccatctatatttttgcaggtatggcgcccactaggcaccctttggacccagataagtccaacagggctctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgtgccaccaccacctcatcaggctggccaggctggggcatttgacatagagcagtatttacggcatttggttcgccagcaggcggccaaccaccgagcacatcatgcagagccagggcttcgctcctttttcatgccctactccagaccagttcagggcagaaggttgcatggccccgggagattggcccgaggcccaagcaggagaggcaccccccagaagctcccggcgatggagaagaaagcccacgaggatgaggagatggctgatttgcttgacttcttgggagggagtggagatacgtga

SEQ ID NO: 42343 - DNA, 90 bp, Glycine max
  Peptide Sequence Number=SeqID_134028
cacttgaggctctaaacagtgttcgatgttcattcaccacaaggatacttgatgaagatgaagcacttcttagttcaattaaagcaagag

SEQ ID NO: 42344 - DNA, 336 bp, Glycine max
  Peptide Sequence Number=SeqID_134029
atgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaaggtatctccgcgtatcataatgaccaaacttggtctctgcgtgccaacggacacgactgtgtctgaatggcaaaggggtgcggataaccgtaagaatgaccaaacttggtctctgcgtgccacggacacgactgtgtctgaatggcaaaggggtgcggataaccgtaag

SEQ ID NO: 42345 - DNA, 411 bp, Glycine max
  Peptide Sequence Number=SeqID_134030
atgggtagctgcggacttttcatgcaaggccacgatctgaattcctgcagcccagggggatccatagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42346 - DNA, 414 bp, Glycine max
  Peptide Sequence Number=SeqID_134031
atgcataccggggcaagatttcacccgtgccgctgcaaaaagacgagtggccgaagcaagtccaacagggccctggggtttccagctctggttacgggcctctatagtcctacagggtgctcgttccccggcaagggatcgcgcctgcaagacacccagtggacccgaagaagtccagcagggtcttggagttgtcaagctctaattacgggtctctgtcagttctacggagtgcctgtcacctccagcaagggcatcaggccccctactaatggagctttcatcaagaagtactgcgtccctaggcaggcacagggcgaaataccacaaccgcctggggatggttggcagcgggcaacagacgcaccgccatcacctctagagttcacctcagctcatccacaaaaaggttag

SEQ ID NO: 42347 - DNA, 332 bp, Glycine max
  Peptide Sequence Number=SeqID_134032
gggttcccatgaacccaaagagaataaaggtcattcctgattggcccactccaccaacaccactcattgagttggtgaggaaccatgttccctcatgggaagatgtccatgaaaggagtgtcgagggaaagagcccagagtatgaagaacctcgggatttgaggtcaaatcctttccaaggtggaggggataatgcaatcctatcccccaaagctctagcttctttaggaatcttctcaaggaagcttctcaaggagcttttcaaggaagttttctcaaagaagcttctcaaggaagttttctcaagaaagcttctcaaggaagctacctag

SEQ ID NO: 42348 - DNA, 263 bp, Glycine max
  Peptide Sequence Number=SeqID_134033
atgataaccatccaaaggtgtccacatcagaatccctggaacctgggaagagtgaccggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 42349 - DNA, 278 bp, Glycine max
  Peptide Sequence Number=SeqID_134034
atggcaggacgtggtagggatcataaccgtgatgtcctcgaccgcatcacagctgtgctggaaactctagtgcaggaacgtgatgtggagccaatagagtatcggggactcatggctttctgtaagaaccacccgtcgaagttcagtggggactatgatccagagagtgctaggttatggttagttgagactgaaaagactttcgtggcgatgggttgcctcgaggagcataaggtcccttatgcgacattcatgctccagggagaagctgagaactg

SEQ ID NO: 42350 - DNA, 351 bp, Glycine max
  Peptide Sequence Number=SeqID_134035
atggtcatctgcgccctttccggagatgtcagcattttccgatcggagatccttcacgaagttatccgctacccttgtatctccagaggcggcgggcccgatgatacgcggagaaccttacggttatccgcacccttttgtcatcagagcggcccgatgacaagcagagacaaaatttggtcattctgcacccttgtgtcatccagaggcggcgggcccgatgatacgcggagataccttacggttatccgcacccttttgtcatccagaggcggcgggcccgatgacaagcagagaccaaatttggtcattctgcacccttgtatcatccagaggcggcgggcccgatga

SEQ ID NO: 42351 - DNA, 848 bp, Glycine max
  Peptide Sequence Number=SeqID_134036
atggtgaaagttggaacctcttacgtgccgatcacgtctcatttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcgaatcgtttgttcacgttctcgagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42352 - DNA, 183 bp, Glycine max
  Peptide Sequence Number=SeqID_134037
atgtcgaaatgccctatctgtgggacttcacggtacaaagtgaaggatgaagaggaaagcaattctgatgaaaactccaacaagggccccccagtgaagttttgtggtatcttccaatcattccaagcgaaaatacatgatgttatctatgatgatatcgggcccaagatagccaggaaatga

SEQ ID NO: 42353 - DNA, 893 bp, Glycine max
  Peptide Sequence Number=SeqID_134038
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcggaatgttccgctgtgtgtttgtccaagaaatacgatccttgcttaccatctgcccctgcagaatctgcagttgtagaatcaatcttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42354 - DNA, 666 bp, Glycine max
  Peptide Sequence Number=SeqID_134039
atgcatgaagaagcgctaaggcttgttgcttcgaacaacaagccaagaagcgatctaaaatttcatatcactaaattggcttcaacacaaagtgagctggataaattgagacaagaaaatgaaaaacttgtttcgagctataaagccaccagttgtgtttgtgcttctacttctcttaatatggatgattacaaagctttgcaaattgaatttgaaaagttcaaaaaggatcactatgaagaacgtacgaagttgcaaactaagctttcctatcttaaagatttgtttagaaaaatgaatagaggaaaaagtgatcttagtcacttgcttaacgtgcaaaagcatactaccgataacattggtttggggtataacaagcaaactaccttttctacgaaaatcaagtttgcatcctccaaaaaggtgaacccaaacaaagtctccaaaaagaaaaacatagtgcattctaagcctaaagcaaagacttgtcattattgcatgaaaagagcacacacatcttataaatgctatgttaggagatttgacgttcctagagtggtcctaaaagcaagaaactcactatggtacttggatagtggctactctaggcacatgacgggtgataagtccagacttactgactttgtgtcaaaggaaggaggatat

SEQ ID NO: 42355 - DNA, 417 bp, Glycine max
  Peptide Sequence Number=SeqID_134040
atgaacagagccaggttggtttatggcttggtaacccacatggatatgaacattggcaccctgatctcaggtcaaatctcttctattgctcagagtaactcctctaggctcagatttccagccttgatcactgccccttgcagagctagagcagttacctctgatagtctgacttatgagagcctgagcccgtccattaacgtggcctacattaagaaaaactgttggaatgtggatgatatgacagttaacttcagaggggcaaggaaggcaagggcttggccagctgatgttccttcttcttctactccaccagctccttccacttctgttactcctacaccaactcctccaggcccatctgtccaggactttcaacactttgagtcaatgattcagagtctttatcaaggacag

SEQ ID NO: 42356 - DNA, 513 bp, Glycine max
  Peptide Sequence Number=SeqID_134041
atgtcaggattgacacgcgattctcttcaaatttcagccggcccatatcaattagaccttgcaccttacgcttcagagccttacaatgctcaatggaatgccccggggcttctccatgacaagcacacgttgcgttcgagtcgtattctcggagaaatggaggttgatgaaccttggttggggttatggctaccattgaattatcaagtaggcatgggagcaagctttctcgctgcaaaattcatttcttggttggcgtttttgaattgtgctaaaggtgatgttcgtcattggaagtgcggtagacagactttgtggttgattttagggatggcctttgtggataactgggcggtgggtaaggagaaggtttgttattggctgagtaataacattgttgggttggtgggaaacttggctatattggaatggcagtcacagcatgggcttctacttcatcctcaccctcttcatttgccccagttttctcattcgtccaagcaggatgactaa

SEQ ID NO: 42357 - DNA, 177 bp, Glycine max
  Peptide Sequence Number=SeqID_134042
atgaagggaatcataggagcaccttacagggcacgctgtgatggtttgaccatcacaaatgtgtcctggttgccgtacacggagcatcgcggggttagggcctttcaagagatttcatctttccagggtcagctgagatggggtcctatggtggtcacagctcgaccggagagggtg

SEQ ID NO: 42358 - DNA, 717 bp, Glycine max
  Peptide Sequence Number=SeqID_134043
atgatcaatgacctcgtgctggaaattcaagaatttagagaaagtcttttagatttagggatcgaggttagatcaatttttgcgcctattggacaagggagttcacaggtttcaggctcatctcaattatcatcaaaagatgtgtttctgtcaaagactgaagtaaaaaatatctctgagattaatgccagttcagaggagtttgtttgtgttactgtcgccaagattacaaccatagtgatgaacaactattcatggtgctatccggcttgtggtcaatgttataaaaaagttgacatgcaaagtgtgtcgttcacatgtccgtgtggcaaagagaacaatcaacatgtactgaggtatcgggttgaggtgatggttagtcacaagggtgaacaaaccaaatttttgatctgggattgtgaatgtgcacagttaattggtcagtcagcggatgaagtcaacatgctcaaaatagaagatggggatgttgatttaaatgcctctcctcaagcactagataggctattgggttgtttccttgcattcaaagtgaaggtgcaaccaaggttcaggaattctgttgttcttaaatattcagatgaaccagagttgatcaatgttatgctagatatgattcccgatagtgagccatgttgcaagatcaagaattcaatacttgagtcgaccgatcctacagtgcttgaatctgtgagctaa

SEQ ID NO: 42359 - DNA, 707 bp, Glycine max
  Peptide Sequence Number=SeqID_134044
atggcttctaggaaacataaaagtattagttcaagacccacagcacagtatgacacaaggagattctcttccttagatgcttggaccagatacacagataatgttctagggagaaacattttacctgagaggaaggtaaagctctatcacattgagataaatgattttaaagctgaactggagaggcgtaatttccataaacgcctcaccaatttagttgatgggagcatagacttggctttggtgaaagagttctatgcaaatttatacaattctgaggaccatccaccaaagcagtccagagtcagaggtcatttggtgaagattgatgctgatagtctcaacacattcctggagacacctgtggtattagctgagggagagactctactcgcatactccagatactgcaggttgcctacaaacttcagagagatagaggctattttatgcatacatggccgagggttcatcttgaactctgagggccatcctgggaagattctcaggaaggatttgactacactagctcaggtgtggagtgtcctctcatactccaacttggctcttacatcacatacctctgatctgacagtggacagagctaggctaatttttggcctagtctctcacttggatatgaacataggagcactgatctctggccagatgacctctatagcccagtctaacacttctagacttgg

SEQ ID NO: 42360 - DNA, 75 bp, Glycine max
  Peptide Sequence Number=SeqID_134045
atgggtgccttatgtcttgttggaataggtgcgaaaccaaccacacacaaagatagctacccggacgaaattagg

SEQ ID NO: 42361 - DNA, 835 bp, Glycine max
  Peptide Sequence Number=SeqID_134046
gaaggactccgcgactgaagggaccagtgtcgcccctgagtttgacagccatcgtttcaggagtgctgagcaccagcagcgtttcgaggccatcaaaggatggtcgttccaccgagagagacgcgtccagctcagggacaatgagtatgcagattttcaggaagagatagctcaccggcgttggacgtcgttggtcactcccatggctaagttcgacccagatgtagtcctagagttttacgccaatgcttggcccaaggaggagggcgtgcgggacatgcgatcatgggtaaggggccagtggattccttttgatgcagatgccctcagccagttcctgggagacccgctagtgttagaggagggccaagagtgcgagtatagattttgcccggaccgctgccgggagatgggtgcggatcatgcgcaccaacatgaccaccttgactcaaatgtggatgatgttactgctcagcaacgtatgccacctaccaggcaccctctagacccagataagtctaacagggccctggggtttccagcgttgatcaccagcctctgccagtcattcagggttcccgtcacacctagtaaggtgattcgaccgccgatcacccgggccttcattgagaagtattgcacgcctagacaggcgcaaggtgatgcaccgcaggccgcagatgcaccgccaccacctcatcaggctgatccaactgggtcatttggcatggagtggtatttgcagcacttggttcgccagcaggcggccaaccatagggggcaggtgcagatccatgagtgtctctaccagctcagccttagtctgcagagctag

SEQ ID NO: 42362 - DNA, 516 bp, Glycine max
  Peptide Sequence Number=SeqID_134047
atgagtaggagggcgcggcggtcgctgcaaaacccagggcgcgagcccgggcggagcggtcgtcggtgcagatcttggtgcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtggaacagcctctggtcgatggaacaatggattggctctgagggctgggcacgggggtcccagtcccgaacccgtcggctgtcggtggactgctcgagctgcttccgcggcgagagcgggtcgtcgcgtgccggtcgggggacggaattgggaacgggcccttcggggcctcttccccgggcgtcgaacagtcaactcagaactgggtacggacaaggggaatccgactgtttaattaaaacaaagcattgcgatggtccctgcggatgttga

SEQ ID NO: 42363 - DNA, 218 bp, Glycine max
  Peptide Sequence Number=SeqID_134048
atgggggtgcaaatagcacccaggcccacttgggccctccagaagattcctccagaaggctgttgcttctggaggaagcaacctggctcgcctgggcgagctgggcggcaagcacctcccctattttgctataatagggggaggaagaatttcgcgaaggttttgaccgttcttcgacgttcttcattcgttcttcaccgttcttcgatcttcaacgg

SEQ ID NO: 42364 - DNA, 216 bp, Glycine max
  Peptide Sequence Number=SeqID_134049
atggggacgtcgggttcacctttagcaacaaccgctggtagcggcaattgcaaccgcattggcttccattatcttcttcatgctcatcatggccttcatcattgtgggccatttgctctttcatggcctccattttcggccttcatcttctcttgcacctcctctgcttcacccattactctagctctagcacgagttcgggaaagaatgcaatga

SEQ ID NO: 42365 - DNA, 387 bp, Glycine max
  misc_feature (289)..(289): n is a, c, g, or t
  Peptide Sequence Number=SeqID_134050
atgcccttgcggggaaatggctccgaaaaagctttccatgaagagatcaaggaagggtccagtgccgcccacgagtttgatagccaccatttccggagcgccgagcaccagcagcgcttcgaggccatcaaaggatggtcgtttcacagagagaggcgcgtccatctcagggaggatgagtacacagattttcaggaggagatagctcgccgacattggacgtcgctggtgactcccatggctaagtttgaccctgaggtagtcttggagttttatgctaatgcttggnccacagaggagggagttcgagacatgcgttcatgggtgaagggtcagtggattccttttgacgcagatgccctcagccagttcctgggagaccgttag

SEQ ID NO: 42366 - DNA, 58 bp, Glycine max
  Peptide Sequence Number=SeqID_134051
gtctcaaatgtaggaaatcgtggcagtgctaagggatgtttccccttgataggagaag

SEQ ID NO: 42367 - DNA, 403 bp, Glycine max
  Peptide Sequence Number=SeqID_134052
gaaagtagagctttatcacactgagctagatgactttaaggatgaattggagaggcgtaatttccataaacgcctcaccaatttagtcgatggaagcatagacctgactttggggaaagagttctatgcaaatttatacagttatgaggaccgtccaccaaagcagtccaaagtcagaggtcatttggtgaagattgatgctgacagtctcaacgcattcctagagacacatgtggtattagctgagggagagactctacccgcatactccagatactgcatgttgcctatggacttcagagagatagaggttgccttatgcatacctagccgagggttcatcttgaactctgagggccatcctgggaagattctcatgaaggatttgactacattggcttag

SEQ ID NO: 42368 - DNA, 432 bp, Glycine max
  Peptide Sequence Number=SeqID_134053
atgaagcacttcactgacaccctcatcagtgccaacatacaacttctgctcaagtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42369 - DNA, 405 bp, Glycine max
  Peptide Sequence Number=SeqID_134054
atggcctctttagattctttgtctttcaaaagtattttcaggaacaagttattccaagatcatgatgaaggccaagtcaacttgtgtctcatgacaaaatctgatgagaataacaaagaagattctgtaaggaagaaatggtacatagacagtggatgttccaagcatatgaagggagatgtatccaagtttgcaatcatttcccccaaaagtggacatgttacatacgacgacaacaatatcagtaaaatctcaaaagagaaaacacgttttcgtgaagaaaaatcgagtcgaagtttccgtaacgcctccgtaagcgattctgtggaaattcttcatcgttcttcgtcgttcttcactgttcttcatccgttcttcattcgttcttcgttcttcaacgggtaa

SEQ ID NO: 42370 - DNA, 261 bp, Glycine max
  Peptide Sequence Number=SeqID_134055
atgggatcgagtcaggcgccttcgcttaaaaagaggttctatcaagtcaaggtcaagagcctaggaatcaccagtctgaaagagttagggcagttgatgggtcagctccagatcttggcaagtagaggcgaatgggcctcattcatagacatcctcgcacttttgatctttggaggattccactttccaaatgtggatggggtggtggacctagcagcgatcgacgcttttctcgcctttcatgaccgcaaggaaagcccg

SEQ ID NO: 42371 - DNA, 270 bp, Glycine max
  Peptide Sequence Number=SeqID_134056
atggaagattcaattgacttggatgaagatgtagatcatagtgtgtttgtcaaaagattcaacaaattcctttggatgagaggaactcaaagaagacaaaacttcaaacctaaaagaaggattgaagaatcatcccaaactccaagatgctatgagtgcaatcaacccggacatttgagagttgattgtccaatctttaagaaaagaatggagaagttcgaaaacaagaacattagagaaaagaaggcaaataaggcctacatcacatag

SEQ ID NO: 42372 - DNA, 367 bp, Glycine max
  Peptide Sequence Number=SeqID_134057
ggaacaaaagctggtaccgggccccccctcgaggtcgacggtatcgataagcttgatgtggttcaagccaaggtaggagggcagactaaatttgagcttgcgaaaacaagtttcgaagtgaaaagggagaatgaagtgggtgatatggtatatggcatgggttggtattggtggcacacgatgaaatgctccgtagtgttggggctacacaaattaggcgtgacggttaagagtggtggtgcatatgggtcaaaggtggtgggtcacaatgtgactatggggtggctcaatggtgttgtcaggtggatggaggttgtaaatctaagcagcttgttgatgccggctcggaggttgggtgatgtgctgg

SEQ ID NO: 42373 - DNA, 357 bp, Glycine max
  Peptide Sequence Number=SeqID_134058
atgtcggcactcattcctagcggccgccaccgcggtggagctccaattcgccctatagtgagtcgtattacaattcactggccgtcgttttacaacgtcgtgactggggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42374 - DNA, 312 bp, Glycine max
  Peptide Sequence Number=SeqID_134059
atggctcagggatggtggcctcagaagatgcatcatgtacctgctgaggtacctgagcactgggacccccaccttttctctcgagagaaggcagggttcctggccaggactctaaagcatggattcaaagcgctaagagtcttgagtagatgggcctggaggagctggtgtaggagtagtagaagtggaaggagctggtggagtagaagaagaaggaacatcagctggtcaagcccataccttccttgcccctctgaagttaactgtcagatcatccacattctgtggaagcaagactacaagagattttga

SEQ ID NO: 42375 - DNA, 213 bp, Glycine max
  Peptide Sequence Number=SeqID_134060
atggtcattagtgaccaatggtcttcttataaggaagatgatgttgcaaagactaaatttgtgaaagatactttgttggatgataaatggtgggataaggttgattatattgtttctttcactagccctatctatgatgttcttagaagaacatatacaaaagcttcatctctccatctagtatatgagatgtgggattcaatgattaaaaag

SEQ ID NO: 42376 - DNA, 380 bp, Glycine max
  Peptide Sequence Number=SeqID_134061
atttcgggcagatagggtatggcccggcccgtattaaccaagtgtttcaccagcgctggaatggtgtccgaggaggaggtggcagcaatataagaggagttccctcaagacccaccaagttttgtgcaaccatgccaccccaattcccaagtggggaactggcgcgtgataagccaggtcgattctttgaggatccaagcaacgagggtttgacaatcgatttcgatcgagatataagccaaacgataaacgaggaagaggaagaggatgtcctgtcaccagagttggagaggttggtcgctcaggaagaacgtgaaatgaagcctcaccaagaagaaaccgaattggtaaacttggggaccacggaggaaaagaaagag

SEQ ID NO: 42377 - DNA, 298 bp, Glycine max
  Peptide Sequence Number=SeqID_134062
catccctcttgattctgaaccttatgttccaatcaagagatctttcttgatcggtgttgctgtggttgcgtcctttggttaccgcaaagagcgtgatggctcttgggtaaaaaagggtgctcaaccaaatgatgatgaaggacaattaccggttgaaggggacttttctctccttcagagtattttggacagtggacacgcgattcgacgaaatgaactcaaggatcacaaaggtgaagaagatgtcaccatcattcttgactaccttgatttacctccaccaccaccatcagtttag

SEQ ID NO: 42378 - DNA, 135 bp, Glycine max
  Peptide Sequence Number=SeqID_134063
atggaggatagggtcacgactgaccgatcgtcgtcccttcccggtgctggacaagcagagaacgtcgctgcgaggttagctcgcctgggcgagatgagctcgcctgggcgagcaacccctgcaccaaaaatataa

SEQ ID NO: 42379 - DNA, 672 bp, Glycine max
  Peptide Sequence Number=SeqID_134064
atggacccgaaacaccgcgaccgcgtggcctttatgcgcgtggtttccggcaaatacgagaaaggcatgaagctgcgtcaggtgcgtatcggcaaagacgtggtgatttccgacgcgctgacctttatggcgggcgatcgttcgcacgttgaagaagcctaccctggcgatattatcggtctgcataaccacggcaccattcagattggcgacacctttacccagggcgaaatgatgaagttcaccggtattccgaacttcgcgccggaactgttccgtcgtattcgcctgaaagatccgctgaagcagaaacagctgctgaaagggctggtacagctgtctgaagagggcgcggtacaggtcttccgccctatcgctaataacgatctgatcgttggcgccgtcggcgtgctgcagtttgacgtggtggtagcgcgtcttaaaagcgaatacaacgttgaagcgatttacgaatccgttaacgtggccaccgcgcgttgggttgaatcgacagacgtgaagaaattcgaagagtttaagcgtaagaacgaagttcagctggcgctggatggcggcgataatctgacctatatcgctccgacgatggtgaacctgaacctgacgcaagagcgttaccctgacgtggtgttccgcaaaacccgcgaacactaa

SEQ ID NO: 42380 - DNA, 403 bp, Glycine max
  Peptide Sequence Number=SeqID_134065
gtatctccgcgtatcatgggtgcagaatgaccaaacttggtctctgcttgtcatcggacacgactgtgtctgaatggcaaaggggtgcggataaccgtaaggtatctccgcgtatcatgggtatctccgcgtatcatgggtgcagaatgaccaaacttggtctctgcgtgccatcggacacgactgtgtctgaatggcaaaggggtgcggataaccgtaaggtatctccgcgtatcatgggtatctccgcgtatcatgggtgcagaatgaccaaacttggtctctgcgtgccatcggacacgactgtgtctgaatggcaaaggggtgcggataaccataaggggtgcgtgataaccgtaggtatctccgcgggtaccagtttgtcatgggtgcaaaagggcgg

SEQ ID NO: 42381 - DNA, 210 bp, Glycine max
  Peptide Sequence Number=SeqID_134066
ttgagcctcagcctgcagagtcagggttttacttcttttccgtgccagttcagggcagaggtcgcatggcccggagattggcttgaggcccaggcaggagaggcaccagcagaggcactagcagaggctcccgacgaggcagatgaggcccgcgaggacgaggagatggccgatttacttgatttcttaggagggagcagagccacctga

SEQ ID NO: 42382 - DNA, 294 bp, Glycine max
  Peptide Sequence Number=SeqID_134067
atgaaaataaaaggccatattggatcagagatcgtgtttggaacgatctgttatcacattggaatgcacctgagtatcattccaagtgtgcataggcaaaaaaaaaaaatcggacatctgaaaagggtgggtgtatgcacacaggtggttctatcaacttgtaggatcatgccattcgcttgggaagaatttgaggctagactatctcaagccaggtctgatgctgcatcaagtgttggtgaatcccaactcactctcttagaccctgctgaagaacaaagacttaggagttga

SEQ ID NO: 42383 - DNA, 586 bp, Glycine max
  Peptide Sequence Number=SeqID_134068
gcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcaccaaggaccaccttgcaaggctaaatactcctgggtgaccgatagtgaagtagtaccaatgagccggcgactcataggcagtggcttggttaagggaaaccaccggagccgtagcgaagcgagtcttcacagggcaattgtcactgcttatggacccgaacctgggtccgaaccgactgatgttgaagaatcagcggatgagttgtggttaggggtgaaatgccactcgaacccagagctagctggttctccccgaaatgcgttgaggcgcagcagttga

SEQ ID NO: 42384 - DNA, 156 bp, Glycine max
  Peptide Sequence Number=SeqID_134069
atgatcctagaggaaggacgtaggagtaacctgagcatccatcctagtgctaccaagatgtatcaggatttgaagatgatgttttggtggcccaacatgaagagagagagtgtaccagccattactttaggtcgtcacatgaaaataatagaataa

SEQ ID NO: 42385 - DNA, 369 bp, Glycine max
  Peptide Sequence Number=SeqID_134070
atgtcaggatttacacacaattctcctcaaatttcagccagcccacatcaattagaccttgcaccttacgcttcagagccctaccatgctcaatggaacgccccggggcttctccgtgacaagcacacgttgcgttcgagtcgtatcctcagaaaaatggaggttgaggaaccttggctggggctttttgctgcaaaattcctttttgttggtgtttttttggtttgtgccaaaggtggtgttcgtcattggaataatgacattgttgggtttggtgggaaacttggccgtacaggaatggcagtcacagcatgggtttctccctcatcctcaccctctttatttgccccagttttctcagtcgtccta

SEQ ID NO: 42386 - DNA, 111 bp, Glycine max
  Peptide Sequence Number=SeqID_134071
atgtcgcgggggtcaggagaccttggggacgtcagggttatggcctctggtaatcgattaccaagggtgggtaatcgattacaaggcttaaaaatgaagacaggagactaa

SEQ ID NO: 42387 - DNA, 255 bp, Glycine max
  Peptide Sequence Number=SeqID_134072
atgactattgaagaatccattcatgtttcctttgataagtctaatgttatttctccaagaaaggatgtgttagatgatgtttcagatttcttagaagagatgcatactcatgaaagggattctaaaaggaaaagagatgaaagcaatgagaattctcaagactctgaaactaaagcaaacaatgatcttccaaaggagtggaaaacttccagaaatcatcctcttgacaacattattggtgatatctctaaatag

SEQ ID NO: 42388 - DNA, 758 bp, Glycine max
  Peptide Sequence Number=SeqID_134073
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagatgccttaaacttccaacaaggaagccttttggttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42389 - DNA, 507 bp, Glycine max
  Peptide Sequence Number=SeqID_134074
atggctcaacttatttctgatgccatccactatttgcagggatcgcgcccacaagacacccagtggacccgaagaagtccaacagggctctggggtttccagctctggttacgggcctctatcagtcctacagggtgcccgtcccccccagcaaggtcatgccatcgtgacatagggatcgcgcccgcaagacacccagtggacccagagaattccaacagggtcctggggtttccagctctgattacgggcctctttcagttctacggagtgcccatcgcccccaacaaggtcatcaagccccctactaaccgagctttcattaagaagtactgcgcccccaggcaggcgcagggcgagacaccacagcagtctggggatggccggcagcgagcaacagatgcactgccaccacctttaaagcccctcatctcatctacaaaggctggagcgttgcctacgacccgtggccgactagcaggcgaccaagtccaaagccaaaggtaa

SEQ ID NO: 42390 - DNA, 471 bp, Glycine max
  Peptide Sequence Number=SeqID_134075
atgactaaagcacgtcaaaaaggggtacggaaagaaaaggaaggagaagcttgccacccacctcgcccaggcgagctaggttgcttcctccaaaaggcaccgccttctagagaacttcctggaaggcccaaatgggcctggttgctattgcaccccctttttactaaatacgcccccttgccttttttttgccgattctttttccgtaacgttacggaaacttacgaattacgtaacgatacttattttcctcccgtaatgttatggaatcttacagattacgtaatcatcccttttttgcctttcggaatgttacggaactttacggattatgtaatcatctcttttttgccttccggaatgttacggaactttacgaactgcctaaagatgggtgccaagtacctcaaagtggtcaaacgagggttgcatcccaacaatggatggtccccggacgaaattagggtatga

SEQ ID NO: 42391 - DNA, 330 bp, Glycine max
  Peptide Sequence Number=SeqID_134076
atgtttcagtttatgttcctatctactatctgggatataccaagaaaagatgtacggtctaatgaggctactacgaaatatttactcatgggtggggcaagctcttctattctggttcatggtttctcttggctatatggttcatccgggggagagatcgagcttcaagaaatagtgaacggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 42392 - DNA, 519 bp, Glycine max
  Peptide Sequence Number=SeqID_134077
atggtattattcactctgagattacccagtcaaggtgcaccttttgagggaaccattgttgatgactggaaatttgactattctagtcatgatgctcgccgtatgatcgactgggctcacttggttaggtaccgaatgcataaggcattacgggccaatgcacctcttccatatcctcaattggtcaccatttttctctgtcattttcaaattcctcttgatgatgaaccttttgttcaagtcaagcgatcctttgctataggtgctggtgcagtaacttcatttggttaccgtaaggatcgtgatggtcaatggctgaagaaggacgtgctacctccacaagacgagcatactccttctccttctcctcaacgagatgattcctcagcccttatgaatgaagttctttcagagttacggggcctccacacctatgttggcatggatacccgcatcatgcagcttgaagaggatgtgacttatcttcgtcggtgcttcgaccttccaccgccttcttag

SEQ ID NO: 42393 - DNA, 818 bp, Glycine max
  Peptide Sequence Number=SeqID_134078
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattaatagaaaggtgcaacagaacaagccaaagattgaaggagaagccattcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42394 - DNA, 723 bp, Glycine max
  Peptide Sequence Number=SeqID_134079
atggtcattgtgcgccttttgtcatccagaggcggcggacccgatgacatgcggagacaaattatggtcattccgcacaccttttcgccattccagacacagtcgtgtccgatggcacgtagagacaaattatggtcattctgcgccttttgtcatctagaggcgatcgtgcccgatgacacgcagagaaaaattatggtcatccgcatgcttttgctatctgtaagactcgacaagagcagcgagtctagtgataaacgcgtaaagacaaagacaaattatggtcattatgcgctctttgtcattcaggagcagcgagtcgagagcagcgagtcgagtgataaacgtgtaaagacaaattatggtcattctgcgccctttgtcattcaggagcagctagtcgagagcagcgagtcgagtgataaacgcgcagagacaaattatggtcattctgcgccctttgtcattcaagagcagcaagtcgagagcagcgagtcaacgaagtggtgggcggagacaaattatggtcattccgcacaccttttcgccatccagaggcgatcgtgtccgatggcgcgcagagacaaattatggtcattctgcgcctttccatccaggcccgatcgtgtccgatggcgcgcagagacaaattatggtcattctgcgccttgtgtcacccaagaggaacaaattcggcagtatcaagatgatgttggtcgtacg

SEQ ID NO: 42395 - DNA, 76 bp, Glycine max
  Peptide Sequence Number=SeqID_134080
acattcactggggaagcagaagtccttttgaaggaagctattccagaacagatggactctttttctccaggaacag

SEQ ID NO: 42396 - DNA, 489 bp, Glycine max
  Peptide Sequence Number=SeqID_134081
atggaggaaaaggattccttcaagaagattgttaagaaggaaaatcattttgcaacaaaaggtgatattaaaagggcactccttaaacaatttttctaccttctcctatcaagggaaacatctcttagcaccgccatacctcttgagcttgaggtttttcctgaagtaaaggagttgttggatgagggtattattaggcaccaaatccctatgattggtggtatgatgaatttgttgagtggtgcaacactcttttgtaaaatcactcatgcacccaacatcttcatgatttgtgtacatagggactcattaggcagtgatcaaaggcttcccatggaccctaagagaataaaggtcattcttgagtggcctactccaccaagtgttgaggaaagaatccatgagtttcaggaacctctggatttgaggtcaaatccttttcaagggggagggaatgatgcaattctaccccccgaggacattggatag

SEQ ID NO: 42397 - DNA, 541 bp, Glycine max
  Peptide Sequence Number=SeqID_134082
atggcgaggacttgtagtcctctaaaggtgaggacgtgtagtcctctgaaggtgagggcgtgtagccctacaaaggtgaaggcacatgaccctttgacggcgaggacgtgtagtcctctgaagttgaaggcgaggacttatagtcctctggaggtgagggcgtgcagccctctggtggtgaggacgtgtagtcctctcaaggcgaggacgtgtagtcctctgacggtgagggtaagggcgtgcagccctctgatggtgaggacgtgtagtcctctcaaggcgaggacgtgtagtcctctgacggtgagggtgagggcgtgcagccctctgatggtgaggacatgtagtcctctcaaggcgaggacgtttagtcgtctcaacggtgagggacgtgtagtcctctcaaggcgaggacgtgtagtcctctcaacggtgagggcgaggacatgtagtcctctggaggtgagggcgtgcagccctctgatggtgaggacgtgtagtcctctcaaggcgaggacgtgtagtcctctcaacggtgagg

SEQ ID NO: 42398 - DNA, 624 bp, Glycine max
  Peptide Sequence Number=SeqID_134083
atgacgaagaacgaacgacgaacgacgaagaacggttggaaatcttcgcgaaatcacccacggaaacgttacggaagcaccttggcttggattttcttcactgaaacaatttttttctcaataattttaagtgatcccgaaataccagatgggctgaacccctttctctttcactcctccccctatttattggaaaataggggaagagcttgccacccagctcgcccaggcgagccaggttgcttcctccagaagcaaccgccttctggaggaacatcctggaaggcccaagtgggcctgaaactcacgaaggttacagaacctcacggattgcgtaacaatgtcgaccttcaaccggttggtggcgacgccgcgcgttttcctcccttggaagatacacccgtgagccttgcatcaccctcctgccgaaggtttttagaaccttttaggttttttaggaaaagtctttactcgcaagacactcgaaatgcactcaaatggcaattcaagtttggtatcatcaaagccaaaaagggggagattgttagagatagggggagcaacatgaagactaagctttggagcttgaagaagttttgtctttttacatgcccaactctttga

SEQ ID NO: 42399 - DNA, 830 bp, Glycine max
  Peptide Sequence Number=SeqID_134084
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattttctgtttaggaggctggaaagattctggagatgatgatggtgatggtggcacaacagtgaatgtacttaatgccactgagccggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42400 - DNA, 294 bp, Glycine max
  Peptide Sequence Number=SeqID_134085
atggatgaatttgatatctttgtccctcgtcctctcacaaacacatctttgcttattcaaactttcatcggaatgcgacttgcgctcctgagtttggacttccaagaccgttcaatcagaaattactcgtgctacacatttggtgaaggtgccgtaaaacgacaagggcaaattagaagttcccacccaataggttccctgttacgaaagacaacgattggtacctcaaagccctacactggggcaatgaggggcatcgtgcatgagcctcaagtaaacctaggggcaaattag

SEQ ID NO: 42401 - DNA, 371 bp, Glycine max
  Peptide Sequence Number=SeqID_134086
atggtagaccccatcaaagattacaatgaacaccaagatattcaagatctcaacgctaaaaaatccttgttggcaaagcttctctctctacaatctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 42402 - DNA, 604 bp, Glycine max
  Peptide Sequence Number=SeqID_134087
atgaaaagagaaaaacatgcctcctatagtagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccatggtaaggacaatgtaggggctaacttagattgggaaataagggttgagcaacaacttaaaaagaagtctacttcaaaatcttatggctctcactcttatccaaagaaagaccaaggtcaaggcatcttaggggtgacactttctaagcccaaagatgataaggggaagacaatagaaaagcaagcccctaaggctaaagcaaaatgggaagaatctagtgaagaaatcgacccccaagaagaaggacaaccattaatggttaaggagtgtaaggagatacttgttagcattgccacacctcttgggcttgagtttattcctcaagtaaaggagttgttggatgaggatttggttcgcaagagcttaaatccttgtgctttgttggtgcccaaaataggtattgttaggcaccaaatccctaaaataggtg

SEQ ID NO: 42403 - DNA, 144 bp, Glycine max
  Peptide Sequence Number=SeqID_134088
atgatgcaaaagatactaatattccagttgaagtatagagatattactatctcacaaacaggcctgaggaacctgattcggttggcaatgccaaagctcatggaagctgatgttcagtttgctgtgtttactggtagggtataa

SEQ ID NO: 42404 - DNA, 549 bp, Glycine max
  Peptide Sequence Number=SeqID_134089
ggcacccttgttgatgactggaagtttgattattctagtcatgatgctcgtcgtatggtctgcaatgatcaggctgatatgaccggcaaattacttgttggggcattaacctttgattgccgcatcatgcactatattattgttctcgttagaatcgactgggctcacttgattcggtaccggatgcataaggcattacgggccaatgcacctctcccttatcctcacctcgtcactctttttcttcatcatttcaaaattgctttggaagatgaaccatttgttcaagtaaaaagatcttttgctattggtgttggtgcggttatcttgtttggttaccgtaaggatgatgatggtcagtgggttcggaaacaagacttacctcagccaatccatgacgaaccttttgtgggtgaccgatttgatgctatggatactcccctggatgccatggatgctcacttcgatgggatggatacgaggattactcgacttgaggacaatatgagcttcattaggcgttgcttcgatccaccagccaacccttag

SEQ ID NO: 42405 - DNA, 806 bp, Glycine max
  Peptide Sequence Number=SeqID_134090
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataatcttacaaaatactatgctttagcacaaagtacaccagtcaatttaaacagtcctggatcaatagagcaatctaaaggaggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42406 - DNA, 96 bp, Glycine max
  Peptide Sequence Number=SeqID_134091
caaaggaatccattgatgaagaagatcctaggcctacaagctccaatggagcttgcaacacaattgttgtgaaattgatatgctattatgttgaga

SEQ ID NO: 42407 - DNA, 346 bp, Glycine max
  Peptide Sequence Number=SeqID_134092
atttattggaggtcccactagaaggatcggcaccaatctgtgcctgttcctcctctaccaactcaatatctttcgtttcacctttgcttttgtaaactacactgtaatttacaaaacaaaagttgaaaggaaagatattgagctggtagacgaggaagaagcacagattggtgctgatcgttctagtgcaacctctaataaatctgagatttataacgaggaagcatggaatgcagcacagaagcataaaccaaatagggtggagagtgtcaatgctgatgcagaagcctttggtgatcactggaaaattcttattgctttatgcattctaaagctgaagcactaa

SEQ ID NO: 42408 - DNA, 561 bp, Glycine max
  Peptide Sequence Number=SeqID_134093
atggtggaggcctctggtaatcgattaccagcctgtgtaatcgattacacagtggaatgggtcactggtaatcgattaccagcgcagctaatccatgatcgagtagagatggagtgcctagagggagcttgggagaccctcgaaggcaacacaaagtgccgatttcggggcacgattcgattcacggctacttctttggtgcatccagatgaacctgcacggacgcttcagcgcactgtggagtggatactacccacgcctacaccatatcgtctagtggagcccgtccaagtgatcgaggtaacatcatccgaggaagaccctgaggatgatcttgaggagctacctcctgagcctgctgtggatgctcttgactttctagaggttgatgaggatccagttcttgaggtggattctcccgaggaagtcatgtcggcatctgaggcagattctacggaggatagtggcccggggggagatggcaatcagcggaggctcttcatcatagtggacagttccatgggactagttttatatacttttgagggtgggtgtatctag

SEQ ID NO: 42409 - DNA, 297 bp, Glycine max
  Peptide Sequence Number=SeqID_134094
tatcaggcattgaatgaatctcctattggacataaccagtcccctaaagttacctcagaagttgtggccatcgctaaagacattaatgacatcaaagcaaaggatagtataattaaggatgtagatgtaattgatggattgaggaatatgtcagaaaatctatgtgcagtggttgtgaatgctggaaatgaagggacaagtttaaagaagcaagtccaggcactgactctcagaaattcaacacttgaagatagagtcacccatctagacagtgcacttaaggagtgtgttaggcag

SEQ ID NO: 42410 - DNA, 138 bp, Glycine max
  Peptide Sequence Number=SeqID_134095
atggccaggaaaggggttttccgtccttaccgtgttgaggaaagaattcatgagtttcaagaacctctggatttgaggtcaaatccttttcaagggggagggaatgatgcaatcctaccccccaagggcattggatag

SEQ ID NO: 42411 - DNA, 483 bp, Glycine max
  Peptide Sequence Number=SeqID_134096
atggggaatggcaatctagaaataagcaacgataaccaaaagataaccttcaacatttttgaagcaattaaatgccgaggggaagataggaggtgcttcaaggtggaggtagataaagaagacattggtattcttcaaaccacacaaacttcactcaataaagttatgatcaatgttgtggattgtctacccagtgaaaaagagaaggatctaaggtcttgcttgaaagaccaaaatcatgaaggaaacattcctgctgaggggaccaattccacctccacaggccacacatcactagcaggcatccgcgtcagccccaccggatatggacaatcagatgctccagtccatctactagggccaacaaatcatagtctaggatcttcatcgactgtcccttcacctaaagatggacccaccactaacgaccccagagaccttcatccagtaggttgcttggccaggaggacaaccctcaactga

SEQ ID NO: 42412 - DNA, 87 bp, Glycine max
  Peptide Sequence Number=SeqID_134097
atggaaattcttcatcgttcttcaccgttcttcattccttctttgtcgttcttcagtcttcaaccgttttcttttcttccgctttaa

SEQ ID NO: 42413 - DNA, 456 bp, Glycine max
  Peptide Sequence Number=SeqID_134098
atgaccatgattacgccaagctcgaaattaaccctcactaaagggaacaaaagctgcaaaagcacaggcaaccaaaacaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgccctttccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42414 - DNA, 474 bp, Glycine max
  Peptide Sequence Number=SeqID_134099
acacttaacaccttccttgcttggcagacacttatcacaacaggcaactgtgtctccagcaaaacctccagataggccggatcatgaggtcgatgatcccctatatttgatgacattaaccatcccacaactttttttgaagcctctccaagttatgtgggatgctaccgtgtttaatgaagacttcccattgtacataaagcacgaagatctccatgaaattgcacacggtggtcaatgtcttagcatatctgttatacagttgtggattctgcatctgactgagacaagtatgcgagcggggaatttcgatgtgtatggattcctcgagccacagtccattcagagatctgggcaatcacaatttgaatcaaaaagttacatgaagagttggatgcagagttcaaaatgtgatgtctaccttggagcctacctgaattggccagacaactaccttaaaggaataattaacag

SEQ ID NO: 42415 - DNA, 824 bp, Glycine max
  Peptide Sequence Number=SeqID_134100
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctgggctcaagtgattttcctgcctcagcctttcaaagtgctgggattgcagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42416 - DNA, 297 bp, Glycine max
  Peptide Sequence Number=SeqID_134101
atggcaactgttggctatgttgtagggaaagataaaggtcgattggaactcagtgtggaggatcataaaatctattttgacctctttgaagccatgaaacactcaaatataggtgatgcctgttttgaagaagaagaggtggagcaggaaatagcattatcagcttcaaccatggtactacagtttcctttggaaaaagaacctggttatgtggtagactgcttagtttgtgatgaagagcttgatgtgacaccctctacccctcacatatatactaacaaaggaatacaaatttaa

SEQ ID NO: 42417 - DNA, 408 bp, Glycine max
  Peptide Sequence Number=SeqID_134102
atggcattgctacttagcaacattctgcccagcgaccgcaacgccaatctccccctgcaaaagtatcagttgatctgtgtcgtcccgacatggggatcgcacccacaagacacccagtggacccggaaaagtccaacagggccctggggtttccagctctggttacgggcctctatcagtcctacagggtgcccgtacccccccggcaaaggatcgcacctgcaagacacccagtggactcgaagaagtccaacagggtcttggagttgtcaagctctaattacgggtctctgtcagttctacggagtacctgtcacctccagcaagggcatcaggccccctactaatcgagctttcatcaagaggtactgcgcccccaggcagacgcagggcgagacaccacagtag

SEQ ID NO: 42418 - DNA, 654 bp, Glycine max
  Peptide Sequence Number=SeqID_134103
atggcttctaggaaacgcaaaagtattggttcaagacccacaactcaatatgatacaaggaggtttcactccttggatgcatggaatcggtacatagataatgtattgggtagaaacatcttgccagagaggaaggtggagatctaccacactgagtttgatgattttaaggctaagttggagaggcttaatctccataaatgcctcactaatttggttgggagcatagatttggctttggtgaaagagttctatgcaaacttatacaactctgagggcccttcaccaaagcaagccagggtcagaggccatcgagtgaacatcgacgctaacagcctcaacacattcttagagacacctgtggtgttggtagagggtgagactttgcccacatactccagatactgcaggctacccacaggctatagagagattgaggttgccttatgcatactaggccgagggttcatcttgaacactgagggccatcctgggaggattctttggaaagatttgactactttagcccaggtgtggagtgttctctcatactccaacctggcccccacatcccacacctctgacctgacagtggacagagctaggctgatctttggcctagtttctcgcatggacatgaacatgaacatatga

SEQ ID NO: 42419 - DNA, 226 bp, Glycine max
  Peptide Sequence Number=SeqID_134104
cgcacccgtgagcctcgccttcgctcgcccgcaaaaaggcacattgcgacagcgctttatcaaggattctagcaaagttgcccttccactatccaatctgctgcaaaaggaggcacctgattggagaaccccatttaagctaatgtgcgatacatccaattacgcattgggggttatccttgctcaaaagatctccttacttcaccttacttcttttccgccatga

SEQ ID NO: 42420 - DNA, 324 bp, Glycine max
  Peptide Sequence Number=SeqID_134105
atgggtctaataatcttatacccgtacccgtacccgacttttggttatcggggaaaactcgttcccgaacccatacctgatcaactcgggtattacccgtcaaagtcgagacgaattcgggcgggtacctacggagatggtccctttttgtgtgtaaaaccggttaggtcggaccggtgcaaccgggatccggtggctaactgtccgagtttggatagatcatcccgtgtcaattgcatgaccgatccaatagtgaaactagttcggttagaccaccgagtaacggttgagtcaaaccaggtttcgcaattgtgcttgcaatga

SEQ ID NO: 42421 - DNA, 54 bp, Glycine max
  Peptide Sequence Number=SeqID_134106
atgggcttaggtgatattggttcacttggtgagtatgagtggtgctgggtgtag

SEQ ID NO: 42422 - DNA, 523 bp, Glycine max
  Peptide Sequence Number=SeqID_134107
cccaccaaacctatctcagaaaaacaacgatctcggactcgttcaccgttggatcgtcgtgaaatttgagtaccatgttcgcaacccaattttgaacattctcaccgttgggaatttcaaaatcatatctgagcttagaggaaaacccttcgcattggagaaaaaagaatctcatgaagacagtacaagtgaaggtttcaatctcttctccgtctctctgacatttgggaattctatcggagcagtcggaggaataactgaaggaatctcagggaaccgctatagatgttactatcgttggctgaagacacgtgagtccgctcagagggtacatccacttggggattgctatactaagaacaagagaaggtacatctcttgtggatcagttcaagtggagggtacatccacttgggttttcaaagagaacaagggagggtacatcccttgtggatgtttggcttataaaggattttacaagattgaaagaaatctcaagaactgcaggtcgcttggggactag

SEQ ID NO: 42423 - DNA, 306 bp, Glycine max
  Peptide Sequence Number=SeqID_134108
atgtgcactggtgctgaatctcgaggagatataaatggtgatcctgtgatttcaaaggttggaggaggagactatgaggatagaatgagaaccatagaattggaaggtggtggagaagaaagagcttgcaactgtggcacatttgttcaagggcttcttcaaggcatacaccatcatctcactgcccttaatctccctaccctttctgcttctgaggttgattatgttcacgtgaaaggaggaaaacgccgagacatctatgcagacaattttcttggagcaatgataagcggcagtttcagttag

SEQ ID NO: 42424 - DNA, 1356 bp, Glycine max
  Peptide Sequence Number=SeqID_134109
atggcaaggattcctgacaagattaagtctattgatgggtcaagaaagacgcttaaacttgatatgagaatcatggatctttggttcgttgggactcccaataagtctgagcaagcggaaatggttattgttgattctgagggtgatcaaattcatgctgtttgtaaagcggaccaactaaagtcttggaaagttgatttgaaggaaaattccacttatgttatgcataatttcaaagtggtgaagaatgatggtcaatttagagtgtgtgaacatgagtacaagttagtttttaccgaagtgactgttgttagagaatctgatttgcatcagctgccttttaaggaatttagatttgttgaatttggaaatgtcattggtggaaattttgaggctggcctgttggttgacattattggggtcgttgatcagttcttagcctatttgaatgaacgtggaaatgatgggtcgatcgttattattttgacacatgccagagtaaaagatgcgcagggaagttatccagcttcagtgagcaattcgttgaaggcctcaaaattattaattaaagaacctgtattggaaatccaggaatttagggagaggcttttagatttaggtgttgaggtcagcccagttttggcacctagcgatcaaggaagttcacaactttcagggccaagccaattatcatcaaaggatgcatttctttcaaaagctgaagccaaaactatttttaagatcaatggcatttctgaggtggtcctaaaaattgacatcgaaacaggaccattcacatgcggatgtggcaaagataatgatcagcctattctaagagttgaagtaatgattagccaaaacaatgacagtagcaagtttttgctctgggaccatgaatgtgctgagttgattggtcaaacagcttatgaagtgaacagggtcaagattgaagacggtgatgttgatttgaatgcttctcctcaagcacttgataggttgttgggttatgtccttgcttttaaggtcaggattcaatcaaaattcaggaatgttgttgttcttagatactcaaatgaattagatttgatcaatgttctgctcaacatgctggctgatactgaggcatgttccaaaatagatgcttcgaacgttgattgcaatgatgctacgcatgttgaatgtcaatctctgtctgtgacagcagatcatgatccagttgcaggattccctttaacgccaaaaaaacgtctatcatctgatgaagttgatgatgaactaggaagctcccagatttccccagcccaactatcatctaacaaattaacaagacattctgataaaagtgaatttagctga

SEQ ID NO: 42425 - DNA, 801 bp, Glycine max
  Peptide Sequence Number=SeqID_134110
atggctgaccaaggattggaagggagccaaccagtggatctacagaagcatccttctgggatcgtgcctacccttcaaaatattgtgtccacagtcaatttggactgtaagttggacctcaaaacaattgcacttcaagctcggaatgcagagtacaatcctaaggcaattgcctatcctgctttctggattgttttctgttcctttctggaccagagaagtgtgcgttttgctgctgtgattatgaggataagagatcccaaaacaactgctctaatttttgcttctggcaagatggtttgtactggagctaagagtgaacaacaatctaaattggcagcaaggaagtatgctcgtattatccaaaaacttggcttccctgccaaatttaaggatttcaaaattcagaacattgtcggctcttgtgatgtcaagttccccatacggctggagggtcttgcatattcccatggtgctttctcaagttatgaaccagagctgtttccaggactaatctaccgtatgaagcaaccaaaaatagtcttgcttatatttgtctctggaaaaattgttctaacaggagccaaggtgagagatgagacttacactgcctttgaaaacatatatcctgtgcttacggagttcaggaaaaaccaacaatggtatgaatttgtctttacatatttaactttttcagtacatagtacatacagatattgctgtttcaagaaagagcaggagcagtggtctggcagaaaagttcgtggaactgtaaatattaagacaaaggagataatctaa

SEQ ID NO: 42426 - DNA, 216 bp, Glycine max
  Peptide Sequence Number=SeqID_134111
atgaaaggaagatgtgctctatgtgaccttcatgccaccttgaacgcatttggccatcaagctagtgacattaaagaagagcttattgggagaattacacagtgggaagcctggaagatggttgaagaaattgagcaactcgctatgcgcgtcaacaacggctcaacgcgaggagccaacatggagattaggcttagtgcgcatctggcgacttag

SEQ ID NO: 42427 - DNA, 93 bp, Glycine max
  Peptide Sequence Number=SeqID_134112
atggatttagccaccaaggatgaccaacagatatggttgattggtccgaagaaactgtacctacccatgaatctaagtttaaatttgaactag

SEQ ID NO: 42428 - DNA, 768 bp, Glycine max
  Peptide Sequence Number=SeqID_134113
atggggtcaagggagacaaagagtgaagctaagggggtgagaatgggtggggaaatggatgggggaagaggaataggaaattacaaaacagggaaatcaaacatctacgcctatgataaaaaataccttcgggcaaatcagatccaggtctccagcaaccttggtgccatcgggaaacaagccacgccgcatcacgcagaagagcttgaccctgaaaaactggaggagcaagctgttgtattggagaaagacctgatcctgaaagaaagggaaacacttgatgtcttaaagagttggaaagtacaaaaagaagaatctgaagcaaatttgaatgttcagacgagtgtgtgtgaaaatatatcgtctgttgaggaggatgaaagaaaagataaggaaaaccgagtgagtaatgttgttcaggactcgaaggaaggttgtatcccctatccttcatcctcctcagggttaatattaatggaattgaagccagcaaaattcaatctgaacagaactacaagtgatattgctgatgttcgtgcttctgttgaatctctcagtaaaaagttagagaaagaaagactatcacttgagaagactcgtgagaggttagctcagaactcttcaaagatatgttctcttgaggaagaactaaaccagacaaaactaaaactgctagtggcaaaagatgccggttcggataaccattcagatataacaagagaacttcagcgactgagttttgaacagacaatgtcagagattgaatag

SEQ ID NO: 42429 - DNA, 1998 bp, Glycine max
  Peptide Sequence Number=SeqID_134114
atggattctttgcctgattcaataggtaaattgattcatctgcgctatttagatctctctcattcaagtatagaaacactgccaaagtcattgtgtaatttatacaatctgcaaactttgaagttgtatggttgcatcaaactgactaagttgcctagtgacatgtccaatcttgttaacttgcgtcatcttggtattgcttatactcctataaaagagatgccgagaggaatgagtaaattaaatcatttacaatatctggatttctttgttgtgggcaagcacgaagagaatggaatcaaagaattgggaggactttcaaatcttcatggtcagcttgaaattaggaacttggagaatgtttcccaaagtgatgaagcattggaggcaaggataatggataaaaaatacattaatagtttacggttggaatggtctggatgtaacaacaacagtaccaacttccaacttgaaatagacgtgctttgcaagttacagcctcactataacattgaattgttggaaataaaaggttataaaggaaccagatttccagattggatgggaaattcttcctactgcaatatgacacatctaaacttgagtgattgtgacaactgtagtatgcttccttcacttgggcaactaccttctctcaatgtccttgatatttcaaaattgaataggctgaagactattgatgaaggtttttacaagaatgaagattgtcgttctgggacgccctttccctcccttgaatttctgtccatttatgacatgccttgttgggaggtgtggagttccttcaattcagaagcttttcctgtgcttaaaagtcttaaaatacgcgactgccccaaactagagggaagtttgccgaatcaccttcctgctctgaaaacatttgatattagtaattgtgagctgcttgtctcttctctcccaacggctcccgccattcaaagattggagataagtaaaagcaataaagtagcactgcatgcgtttcctctcttggtagaaactataacagtagaaggaagcccaatggtggagtccatgatagaggccatcactaacaaccaaccaacttgtctcctgtctttaaaattaagggattgctcgtcagccgtgtcatttccgggtggtcgtttacctgaatcactgaagactctgcgtatcaaggatattaaaaaactggaattcccgacgcaacacaaacatgagttactggaaacactgtcaatagaaagcagttgtgattcactcacatctcttccattggttacctttccaaatctcagagatcttgaaatcagaaactgtgaaaatatggaatatcttttggtttcaggggcagagtcatttgagagtctgtgttctttggacatcaatcaatgccccaactttgtatcattctggagagaaggattgcctgcgcccaacttgattgctttcagcgtttcgggctctgacaagttttcgttgcctgatgagatgagtagtcttctcccaaagttagaatatctcgtcatatccaactgcccagaaattgagtggtttccagaagggggtatgccacctaacctgagaacagtttggattgacaattgtgagaaactactgagcggcctagcatggccatccatgggcatgcttactgatctcactgtttcgggtcgatgtgatggcatcaagtccttccctaaggagggtttgctgcctacctcccttacgtatctgtggctatatgacttgtcaaatctggagatgttggactgcaccgggcttctccatctcacatgcctgcaaatattagaaatttatgaatgtccaaagttggagaatatggctggagaaagtcttcctgtctctctagtaaaattaaccataaggggatgtcctttgctggaaaaacgatgccgtatgaagcaccctcaaatttggcctaaaatttcccacatccctggcattcaggttgacgatatatggatatag

SEQ ID NO: 42430 - DNA, 660 bp, Glycine max
  Peptide Sequence Number=SeqID_134115
atgtgcttgacagttaagaattccttcaccgaggctaatgagttcgtgcctccatctgagctatccttgttcaaccttgatgacattggatgtttagtccactgtccatatctgttttttgctcgggcgactgaggtgccaagaaatctcagccattgtgcaatatccaaacacaacgattgtgaagacgtgtttctagaaatggagcaaaaaggaggtgtgcttatgcaacgatatgaactggggagattattaggccaaggaacctttgcaaaagtctaccatgctaggaacatcataactggcatgagtgtggccattaagattactgacaaggacaagattctgaaagttgggatgagtgatgaggctaatcaggcatccacatgtggtggtgagctcttcaacaaggtatccaaaggaaagctcaagcaggatgatgctaggagatattttcagcaattgatcagcgctttcaaatttcttaactggattgcaccagatctacgcagattgctgtcgaaaatcttggatccaaacccaaagacaaggatatcaatggccaaaatcatggaaagttcttggttcaaaagggggttagagaagcctaccattactcggaacgaggaccaagaactggctcctctggatgcattactt

SEQ ID NO: 42431 - DNA, 223 bp, Glycine max
  Peptide Sequence Number=SeqID_134116
atgcataactatcaacatgcaaagagatctaattctgcaaaagtcaggatcaataggaaacgtatcatgcagcagaaacgacatcctcaagctcagtcattcattgtgtctgattcatcagaaagtgtaaattctgaatccacacaagcttcaggctctaattttttaactgcctatgaggattgccaatctccaactaatcagcttgtaatcaacactgaag

SEQ ID NO: 42432 - DNA, 249 bp, Glycine max
  Peptide Sequence Number=SeqID_134117
atgacgatctcggactcatttccgagcattttcaccgttgggaatttcgatatcacgtctgagctaagagaaatacccctcacattttgcgcacgctttgaccgttgggatttgggagataatgttcgtggagggagaaaaaggaatcacatgaagatagtccaaatggaggctttaatcctttctccgtttctctcacgtttgggaactctaccggagcagtcggaggaaaaactagagaaattttag

SEQ ID NO: 42433 - DNA, 1161 bp, Glycine max
  Peptide Sequence Number=SeqID_134118
atggcatcgcgtgggtatttctttgttcttctccatgcttttgtgtttgcgactcttgcaacctcagctttctcaaaattgtcacctaattactatgatttctcgtgccctaaagctttgagcaccatcaaaagtgtcgtggaggccacggtgaagaaagagcgtcgtatgggcgcatccttgctacgcttgcacttccatgattgttttgttaacggttgtgatggttcagttcttctagactccacatcctccattgacagcgaaaagaaagcaactcctaatttcaaatctgcaagaggatttgaagtgattgatgatatcaagaaggctgtggacgaagcatgtggaaaaccagttgtttcttgtgctgacatagtggctgttgccgctcgtgactccgtggttgcgttaggtggaccaacatggaaagttgaactaggaagaagagattccactacagcaagccgtaaagcagcaaatgcaaacattccagcaccaacttttaacctatctcaactaatcaccaacttcaagaaccatggtcttgatgaaaaggaccttgttgttctttctggaggccactccattggatttgcacgttgtatttttttcaggaaccatatctacaatgactccaacaacatcgatcccaaatttgcaaaacgtctcaaacacatttgccctaaaaaaggtggtgactccaaccttgctcctttggacaaaaccggaccgaatcactttgaaattggctattactctaatttggttcaaaagaaagggcttcttcattctgatcaagaacttttcaatggtggctatactgatgcactggttagacagtacagctacggtcacgtagctttcttcgaggatttcgcgaattcgatgattaagatgggaaatactcggccccttactgggaatcaaggtgaaatccgtgttaactgcaggaaagcccagcccaacactggcgctaagcgagcgtcaggcgctaagcgagcaaagaagacaggcgctaagcgaggcgttgaactcgaagatgcagaatccgttacgcgtgctaagccccagctatgcgctaaacgcgcgatccaacagaagcacaggctaagcctgcaaggcgcactaagcgtgcgatccgaacgcgctaagcgcgag

SEQ ID NO: 42434 - DNA, 576 bp, Glycine max
  Peptide Sequence Number=SeqID_134119
atgatgcttggtagctgcaaaggacctacttcatctgaggatactagaactgttgcaaatatccaatatgcaacatatagagaagcatgttttgtcatgggttttttacaagatgacagagaatatgttgaagcaataaaagaggctaaggactggggcacaactaattatcttaggaaattgtttgtattaatcctattaacaggtgccatgagcaaacctgaagaagtttggaaccaatgttggcattggctggctgatgacattgcatatcgacatagcaaatcaacaatgaactctgatgaacaaaaaacaatttgcaatagaattatccaagctgtcaacaacaatgaaggtgagatgtttttcctatacggatttggaggcacaagaaaaatattcatatggagaacattggcaagttcattgagagcaggcaatcaaattgttattatagttgcttctagcggcatagcttctctattattactaggaggcagatctgcacattccagatttaagattcttgtaccaatttttgaagactcaacatgcaacatccatcaagggacttaa

SEQ ID NO: 42435 - DNA, 378 bp, Glycine max
  Peptide Sequence Number=SeqID_134120
atggttgtcattcgcaatacatttcaccagcttactattgcaggacacataggtgtcactaagaatttccaccgcctgcagcaaaactttgattggccccgcatccttgaagatgagctttttcgccttagtggaaccaagcttcgaatgagcactgcctatcactcacagatggacgatcaaacagagaaccatccagtcattgagcctcttcatattttggattggaaatgggattcctcatcttgtccaccaactaagcttgttctagtccaatgggatggcctggcacaagaggacactacatgggagccgttggatacactactccggtcttacaaccttggggacaaggttggtttggttgagggagggtga

SEQ ID NO: 42436 - DNA, 1020 bp, Glycine max
  Peptide Sequence Number=SeqID_134121
atggcggacaccaaactttccatcgcctgtgtggatcgtctcgaggccgccatggccaaactcactgcaattcaaactttcattgctgcagaccaaacttccattacttcgaaacttgatgccattattcggatattgaataccatggtacctaaacaaccctctccatcttctgcctctgcgaagtcaccacccatgccgcctctgcttcctaagacaatcaactcaacttcttcctctgctaagccaccaccaacagcagaaaccacgttgtctccccttcccatggcaactttccaccttcccgttaacaagcaccacacactctccttcgaatccatcccggtcgccagtcatcggtcccacacaaagtcctctagtcgtggcatccttccctctgacatccacttctccctttctgttgtgtgtgctgccacggtcagggacacaaatctcaaccaccccttcctcctcctcatcttcgtcattctcgttgctgccaaagggttctgtctccacaatcatcttcaggcactaattcttacacccattttcatttgggatccaggttctgttttctacacccaaccccttgaggacaaggggtcgtcgacgtacaatttcatgctgcaacaacatctcctctgttgcatcgtcgtcatcgtcatcgaagtcacgctagtggtgtcttctcatcggcataagcagcacgttcaccgacacgaattggcagaactcgagggagaaggaggagggagtccactccggcaaggcttcgacatcgtcagaatgaggcacgcagcggaggaggaggagaggagagtgagacggagttggagacacaaatcgagtagggagacgtggtcattctttgacaacgtggcaaagatgctgaatgaagcgtttggagtgaccgaacacgaagactttgtggttggggtggggaaaatgaaacgaggagggaagaggagggagaagaaaagagtgggtgaattaggatttctagaaaagagtatttaa

SEQ ID NO: 42437 - DNA, 915 bp, Glycine max
  Peptide Sequence Number=SeqID_134122
atggggtttcaagggaggtttggggggttttggagacacagtagcggtggtgtggagctggtgaaggagttggttggggactgtgcaaactactcccgtttagtggaagaaaacgtaaaagctacccttattagcgttggaaaatccatctcaaagcagaaattgcccttattagtgttaggtgctgggtttgctgttgctggtttcgagggtatgctggctgttgccttacgtatcattccatggcccttggaaattcaccttgccctcaaggtgatacgctcaaccatcactaccaaggtaataccagggtcccagggtctgtggcggcaaaactcactcagctcagcacttgcccgtagtgccaagacagccgccggcaagattgtaggtcgcagcgaggttatgggctggagctgtatgagtgtcgaaggtggtggcggaggtgtcgtggctggtggaggtggcggcggaagcgtcgtggctggcggaggtggcggcggaggcgtcgtggcgggcggaggtggtacagtcatgaatgcggcaacggcggagggggcgatggagttaacggctgtggcgtcagaaatggcggaggtggcagcggagtccgtggcagaggtccgggtcatcggaggagaagggcatccagcagccatggaagtttcatatggtgagtggcagccatggaagcttcgtatggtggttgctgaaataaaggaggggttatctcgggatcgaacaagcttagcaaccgttggcgggtactctcaaaatcaatcccaagggattgagctggatgtgcaaagggaggagaggtgtgcaacaacgaagcaccaaatgttaggtgctgggtttgctgttgctggttttgagggtccagcacctctagaagaagaagagaagaagagctaa

SEQ ID NO: 42438 - DNA, 240 bp, Glycine max
  Peptide Sequence Number=SeqID_134123
atgacagagaccataaaagatggcaaggagttcacagccttgagattggtacacaatccagtccacatgatcctgagtatcccgaaatccattggccaagaagatacgaaaaaggaggttacattaagcaaaaagggcaacagaaatgaagagaaagaaagagttatgaagcaggcccagcccaacactggcgctaagcgcacgccaggcgctaagcgagcaaccaaatgcaggcgctaa

SEQ ID NO: 42439 - DNA, 1194 bp, Glycine max
  Peptide Sequence Number=SeqID_134124
atgaggcacctccgctgccaattaccttctgaagacctcaacgctcttgtctccatcacctccgacgaggatctcgcaaaacctcatcgaggaatacgatcgcgtttcatcgccgaaattatacatttcaagcatctgatttctcaccacagacgtgatgcagttagggctgagaatgctttgactcttctttatggcaatgagccaattggcatgcaaagagactggaatgaagagctgcagtcttgtagagaatttcctcatacatctcctcaggagaggattttgcgggatagggcactttataaagtgacatcatactttgttgatgcagctattaatggtgctattggagtgatcagtggttgcattcctccgataaacccgactgaccctgaatgctttcacatgtatgtgcacaacaatatattctttagttttgctattgatgctgaccttgagaagctgtcaaagaaacttgtggatgctaattcaaaatcttggagctccagctctttgcaaagttcttctgataaagattccattccagttcatggagaaagtcaggttcctaatggggggtgtgtagtgaactatgaagcacggacactccagtcccttgccgtgtccggtgtcccacacgcgtccgtgtcagtgtccgacaccgacacgatacccgtactacgttctatattttggacattacagagtgacttaccaggcattcttcaaggggacaagtcagactctctctcttgtacggctctgttgacaatggaaagaaaatttgctggattttcattccaaggtgtcagaggctgccaaaaatgccttcatttgaaggaacatttagtccttgatggatctggaaatcttttcaaattagctgcaccagtggaatgcaagggcattgttggtcgtgatgatcgacattatcttcttgatttgttgagagtaactcctcgtgatgccaactatactggacctggttcccgattttgtatcttgagactagaattaattactgtctattgccaggcccaagtagcagagacattgaaatctaaggagaagaattttcaagaggcagacaatttggccattgaatctcaaaatgggcagaacttttcaatgctgaaaaagtgtttctttgccattggaaagcttatccaaatgggcagtatctttagttga

SEQ ID NO: 42440 - DNA, 1059 bp, Glycine max
  Peptide Sequence Number=SeqID_134125
atggcagttttcgacaatcctagcaatggctccatgccacctcaactggaacaacaacccaacaagtatgctttcaccaagcccctctctctcgcgggtcccaccgatgctgatctccagcgtaacaacgaattggacaaggttcttcatcgccttgatcgggtcttctacttcttcgatctcgcttttcttcatattgttgaggattgtgaaaaaatgactgaagcagttgacgcgccaacgtacacagatcagatggttgaggatgcaaatgatgtcatttttacttttggctcttaccgactagggggatgtgatgcatcagtgttactgaaagacacagcaaatttcacgggtgaacaaagtgtcattcccgatgttgattctacaaatggtacggatatcatactcatagagaagataaaagctagactggagaaactgtgtcctgatgttgtctcttgcgctgacattatagctgttgctgcaaaagattctgtcgttgcgctcggtggacctacttggaatgttctcttgggtagaagagactcaacaactgccaatctaagtgctgttttaacagattttcccactacttttatgaatcttactgaacttcttgctacgttcgggaaaaaaaatttcacagcccaagaaatggttgcttttacaggtgctcacactacaggtagaatcaaatgtttattctttcgaacaaggatttacaacgaaagcaatataaatccctcgtatgcaagatcgttgcaagctaagtgtccattcgtaggtggtgatgacaacttagctcctttagatcgaaccactccaatcctttttgacaatgcttattacaagaatttgctgaagcaaaagggtcttttacactctgatcaacagctctataacaatggttccacggacacgattgttgaattttatgcaaagaaccctttggggtttagaacagatttcgctaaagtaatgactaagatgggtaaccttagtccacttaccggcaccaacgggcagattagaaagcaatgcagcaaagtcaattga

SEQ ID NO: 42441 - DNA, 402 bp, Glycine max
  Peptide Sequence Number=SeqID_134126
atggctagttttactaagttggcatgggtggttctggtgtgcatggttgtgatgggtgcacacaacactgtccaaggcatcacatgtgggcaagttcagggtaacctagcaccgtgcctagggtttctccataatggtggggctgttaccagaggatgctgcaacggggtcaggagtattgtgagcaatgctaggaccactgctgatcgccgtggttcaacacttacaatgctcaggctctccccgggaaatgtggggtctacataccctacaaaatcagcacctccaccaactgtaacagcatcaggtgaaggacaaaaagatttggatagatttggccgcgatgaactatgcatatggtactacgtatacgtgctaggaaagagaaataaaggaagatga

SEQ ID NO: 42442 - DNA, 450 bp, Glycine max
  Peptide Sequence Number=SeqID_134127
atggtggttataatggcaagcctcaaggttgcatttgtggttgctgtgctatacatggttgtggtgagtgcacacatggcacatgctaggatcaactgcggccgtgtcgcggtcgcggtgtctccgtgccttggctaccttcgtcgcggtggaaggccacaggcgaggtgctgcaacggagtgagaaacctccacgccctggccaagaccaccgtggaccgccggacggcgtgcaattgcctgaaaacctttgccagaggtcttggtaggggtgtcaatgccaacaacgcagctgcacttccaagaaaatgtagagtcaacatcccctacaagatcagcatctccaccaactgcaacacgtatgtgaaactcatcatcacccacttcaaatgctttcatttcctcacattttcattcactaactcctacagtaatttcactaatacctaa

SEQ ID NO: 42443 - DNA, 810 bp, Glycine max
  Peptide Sequence Number=SeqID_134128
atggcgcgcccagcgcgcgatctgaacgcgctaagcgcgaggaaacttcacctcgtctcagagcactactctcagtacttcaagcctaaaaagccaacgatgtacaatgagcttcaagagttatcaatgcaaaggaatttattccagtcgtttggggtggcagccgcggcggtgttctcgtcgagccggctgaggtgcagggatcccgaggcactagtgtcgtcgaagagccctggatgtttgcataaaggaagaagtgttggagacttcaattgtcacgagaggaggccaagaaagggtgtcgcttcggtgccccctttgggttcagttattgaactcaatgattccgacacggacgaagacgaggaccatgatttggacaatgcaatcgccaacgcagtgaacggtgcttcttcttcggtagagagtccgtccaagaagcaatggacgagcgaggctgaagaagtggttttgccagttgtatttgtcacccctctccctccgacgccggtgcctcctcccactttaatgttgtccttgctggcgatggaatatgcatctaattcggcggcatcgcgcaccaacgcgagtaagagtttgagtctgaatagctccaagcagttctggaaggctggggattacgatggcgctcctctcggaggctctacagctgacttgaatgagacaatggaagacttagccagggacaagcgattgactaatgttgaaaatggagattcaaacagtagaggtatacttggtctaacagacattgaacagactcctaccagcaatatttcaggaaagtga

SEQ ID NO: 42444 - DNA, 435 bp, Glycine max
  Peptide Sequence Number=SeqID_134129
atggattctaggcggcgtagtaaaaaagcagctatgcaacgcaagttgcaacaacttcgatcggtgaacaaagcctcaattattgtggatgccaccagatacatagaggagctgaagcaaaaagttgatgggttgaactcagagcttggaactgctgaatcatccatctcccaagacgaacttcccatggtcaccgtagaaaccctagaaaggggattcctcattaatgtgttttcagaaaggaattgccccggtatgcttgcggcaatactcgacgcctttgaagaactgggacttgatgtgcttgatgctagggtttcttgcgaagacaccttccagcttgaagctgtcggaggagaaagtcaagagaatgaaagcatcgacgcgcaagtagtgaagcaagcagtgcttcaagcaatccaaaacatggattag

SEQ ID NO: 42445 - DNA, 159 bp, Glycine max
  Peptide Sequence Number=SeqID_134130
atgggcaaaattgtcaattcgagcaccgagtcttcacttgcagaatcatcttcatctgttgcagactctgctgttcgcaaagaccctcgtgttgaggttgtgaccgccatcaatgggatcgaagagtttcatgataatcatagagttggtgttgagtga

SEQ ID NO: 42446 - DNA, 261 bp, Glycine max
  Peptide Sequence Number=SeqID_134131
atggttattggagctaaggatcctccaattttggaagtgtgggaaaaggaggcaaaccttgagatcaccggaaagttgggaggccaaagcttgagcgaaatcggtgatggcgtggttaaggtagagaacagtggagtgctgcaacttcttggtttggttggctatggcctccaccacatcatggtgacagtgcccgcagcacaccctagcaatccctccgaactaccttttccccttctcgtcgaacagcacgcagtttaa

SEQ ID NO: 42447 - DNA, 357 bp, Glycine max
  Peptide Sequence Number=SeqID_134132
atggccaagggtgatcaagacttcaaagttcaagctaaccttttggtgaaagaaatccaaggcaacattcaatcaaagaatagattaaatcagttcgtagatataattaaatctgtgatttacatctcaacgtcatcacgtcggcttggcggctccccaacagaatctcatccctgcaccctactgctgtcattccgcttccacgaacaaggttcgcgatcatcacagatgcaatgcggtatgtaccgtatccaataccaaggaaatagccctaagcgtgtctacacgacacctcacttaggaaaccatgcagtatttgtcgaggtcacccagtcatacaccgtaactcccccctag

SEQ ID NO: 42448 - DNA, 120 bp, Glycine max
  Peptide Sequence Number=SeqID_134133
atgattttctatttggatttgggtttccctagcaatgatggagactatctcatagccgacgacatcaaggacggagaagaagacatcaaccatgacgttgaggggaccaaagtgccctag

SEQ ID NO: 42449 - DNA, 252 bp, Glycine max
  Peptide Sequence Number=SeqID_134134
atgtattcttccttcttctccaggcagccaaagggagtcacattcgttgttgttgcatcgcatttctcctcctcatgtctcctccgcgtttctcccctaggtgatgctagacatttttctcccctgcgattgtggtgcaaggaggcctggaagatgattgaagaacttgagcagctcgctaagcgcgtcaacaacggctcagcgggagaagccaacttggaggtcaggcttaacacgcatctggcgacttag

SEQ ID NO: 42450 - DNA, 414 bp, Glycine max
  Peptide Sequence Number=SeqID_134135
atgagtatgacatcctccactacctcgaccagaatgaaatacccgatcataaggccaccctcaatcatgcaattcaaggcagctttccacaatgaccagtcttccaaaatttacgtccaggcttttatagaaataccgtcattctaccatcaacaatgggcaccaaattacccagaatccgttcagttgagatacaatggagcaacctaccaaatacaactccaacagcaccgaggcagattttttttagcagatggactcacagacttcagaacagatttagagatctacgagtccatcatcatcaacttctttgcctatgatcataactccatctttgatgtacacttcactccttcactcgaccaacagacatgtgccagaccactacttcattctcgtcaacacatctga

SEQ ID NO: 42451 - DNA, 510 bp, Glycine max
  Peptide Sequence Number=SeqID_134136
atgccaggtttatcattgaagattgagacactcatcaaagctcaaactcaagtccctatcactacaccttcatttctaacctatgataaatgtgggattatgcatgggcttggagaatgcattattgatgacaagctagttgcagtcatggatgagatcaactttgtagagggaagagacaatttttctaatcaataccctagcaatttcaatcaaggacaaggctttaggattgaacaacctatgaaaaagttaaagaagaaggagaaagcaactccaacaccaaaaagagaggctcttactgaagagagccaagagaaaaacaaagaagatgagaaggtgatgcaatcctaccccgcaagggcattggatagagaagactccaacgaagctctagcttctttaggaatcttctcaaggaagcttctcaaggagcttctcaaggaagttttctcaaagaagcttctcaaggaagttttctcaagaaagcttctcaaggaagctacctag

SEQ ID NO: 42452 - DNA, 654 bp, Glycine max
  Peptide Sequence Number=SeqID_134137
atggatcgatttgctcttaccttgaacgggagtcaagaacttcctcgattgctagccaaggccaaagcgatggcggacacctactccgcccccaaggagatccatggacttctcggctattgtcagcatatgatgggtgatcaagaggagacacatgaacagatgaaagccgacatgtcggctttgaaagagcaaatggcttccataatggaggccatgttagcaatgagacaactcatggagaaaaacatggccaccgctgccgctgttagttcggctgccgaagtagacccaactctcctagctaccgcgcaccatcctcccccaaacgcggtaggacgagaagggagcacactagggcacaacagcaacccccatttaggatacaaccgggtggcttacccttatggattacctcctaattacacaccgccagtcatgcatgatgacgcgggtcatgtctcttcccccatccttgaaggggagcctcctcgacagcccgacgaggtccacgaagatcatcgagagtatgcccaaggggatgtcgatttctaccccctaatcctcgtcgaggggccgacacccaacacattgcctcagcacaacctcacagcacaaccaatattcttgtccacagaaggaccacccccagtg

SEQ ID NO: 42453 - DNA, 187 bp, Glycine max
  Peptide Sequence Number=SeqID_134138
gagttgtcatcatcaaaaagggggagaggtcttaaatcatgaagatttgagattcagaacaagatcaagggaatgggttgtcctatgggttcagatcaaaaaggggtcaaagagaaaggaaaatcatcaagtgggcttgatggatgttgaagcaagaacacttgtgtcatccaaaaaggaaatgtga

SEQ ID NO: 42454 - DNA, 881 bp, Glycine max
  Peptide Sequence Number=SeqID_134139
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcctgttgatgataataacgtcattaggaaggattatttcactaaaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42455 - DNA, 222 bp, Glycine max
  Peptide Sequence Number=SeqID_134140
gtggtgttcgtcattggaagtgcggtagacagactttgtggtagatttagggatggcctttgtggatacctgggtggtggatattgttgggttggtgggaaacttggtcgtacaggaatggcagtcacagcatggacccacattgatcctttcactggcaaagaccaaatcctcaaagctttgaagttgccaagcctctccatctttgggcgtgttctttga

SEQ ID NO: 42456 - DNA, 1002 bp, Glycine max
  Peptide Sequence Number=SeqID_134141
atgggaacaaatcaaaccggcaagaggttctaccaagtcaaggtcaaaagcttagataccaccagcatcaaggaattagggcggttgatggaacccctccaaatgcaagccttccgcaagacttacggaaagatcttagagttgaccatagcagatgtgtccatagaagccattgcatcactcacccaatactacgaccagcctttgagatgcttcacattcggagacttccaattagtaccaaccattgaagaatttgaagaaattctaggatgtcctctcgggggaagaaaaccatatctttcctccggatgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggaaactgggtcccgtttatggatgtgttagctttgctaatttttggggtcgtcctctttccaaacgtggatggttttgatagacctagcagcaatcgacgcttttccttgccctaccaccatagcaaggaaagtccggtggtagctgtcttggcagatctatttgacacatttgaccgaagatacccaaacattccgctggtaggaacgaggggttgtattaactacaatcccgcgctcgctataagacaactagggtaccccatgaggggagcaccgacggaagaaagcatgtctcttttccttgtgagggatttcggcgcacgaaattccaagactatacaaagaatccataaggcgtgggaaaccccgttaaggaaagatcaagagcttagaggcattcgtaatggcatcattggtgggtaccacgaatggctaaaagttcatatacgaggtttagattggctcgcccaagttaaagtcgtcagcgaagagaattttgagcaccggaagaagacaaagaagtccaagctctcaaaagcgagttag

SEQ ID NO: 42457 - DNA, 359 bp, Glycine max
  Peptide Sequence Number=SeqID_134142
gactacgacgaggattcatcgcgtgcctgtaggtggattgccacgaagaagaccgtgaagagcatacatacaccggcatacagggagcacctggaccgactccggattccggatgtctgttggatcccatatgaggagcaccgaccgaccattcctgctctacctgtcgattcatgggtgtcgtatgataatatacacgacaggtggatgcactattcgaatcatatgattctagcaggtgaggccacagagacagatatccctcacgtgccaaagccaggagcaccatcgacatctgcgaggctcgctgtggaggagcctagacatgcagtggaagtttgctatgggattgctgagag

SEQ ID NO: 42458 - DNA, 264 bp, Glycine max
  Peptide Sequence Number=SeqID_134143
atgattgaaagttttgaacaacaagaaatgtctgtcatagaattatgtgttgaagttgatgttgcaggtgcttctgcaattaatttcacagatgaggatgaggatattgatgaaatatctgacacagatgatgaagctgcccgtttgatcgaaccacttacagttgtgcaatcgggagaagtcagactctattttgagattctgcttctcactatagtaatattaattggagtcatcctgaccaagaagatatttgcggtttag

SEQ ID NO: 42459 - DNA, 291 bp, Glycine max
  Peptide Sequence Number=SeqID_134144
atgggtctccgaataaaaagtggagaatggagaattggcgaacagagctacgcaataacttcgcggggctccagactcgaagcgctagggaatgacattaatggctctccgaataaaagtggagaatggagaattggcggacagcactacgcaataacttcgcgcggctctagactcgaaggtggaggacacatgaatagcgctaggaaattacattcatgggtctccgaaaaaaagtggagaagggagaattggcggacagggctccgcaataacttcgcgcggctctag

SEQ ID NO: 42460 - DNA, 254 bp, Glycine max
  Peptide Sequence Number=SeqID_134145
gtaatttagttcctctggacttggaaattgaagccacattaagaaggaacatagccgaaaggagaaggaaattgttgcaagactggacagtagcttccattctagaagaagaagctcaatcctctgaccctacatcgtcttattcaccgtcatcaagggaatccactacatattcatcagaagccactgtcatggctgatgaacatcaacacagggttacccttgaggattattctagtagctcaatgctgtaa

SEQ ID NO: 42461 - DNA, 225 bp, Glycine max
  Peptide Sequence Number=SeqID_134146
gtaccttaaaccaaaatgtcagtgaagttccatcttctccaccacatccgactgaagttgctcctccaccacttcttacatatcaacgtaggagacaaacagttggttctacagtacctgaagcttctcctcatgattctcatccttcttcaatcactccccaagccatggatcctgctacctctcattcctctgattcagactggcccattgccatccgaaaag

SEQ ID NO: 42462 - DNA, 854 bp, Glycine max
  Peptide Sequence Number=SeqID_134147
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccacttactactgatgctttattacctactcactcttccacccctcctttcaaactccctgagtgcaggaagggagtgcctaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42463 - DNA, 408 bp, Glycine max
  Peptide Sequence Number=SeqID_134148
atggtgaaagttggaacctcttacgtgccgatcaacgtctcattttcgccaaaagttggcccagggcttcccggtgctccagtggcttctgtttctatcagctgtccctcctgttcagctactgacggggtggtgcgtaacggcaaaagcacccgccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 42464 - DNA, 426 bp, Glycine max
  Peptide Sequence Number=SeqID_134149
atgccttctataattgaacaagacgaggtcgatgacgtacatgcgattcgtaataatcatcataaaggtttatgggagaacattcctacggtcatgggaacaccaccaaggtcacctccgcattcagatgctcgagaaaagattcctattgtacatagcaattggaaagatgtgtcagaatctctaaaggacttagtatgggatgacattttggccaaatttgatatcccagaagcctcaaatgccaagaagaaggtcatgtccatgatggccactagatggaggcaatttaagtcttcgctaaccactaaatttgtctatgctgacaataacaatgaacaaaaacaagatccttctataaaatatggtatggatcaacaaacttgggatgaatttgctgcaagtcgcaagacccctaccaggcaa

SEQ ID NO: 42465 - DNA, 195 bp, Glycine max
  Peptide Sequence Number=SeqID_134150
gagtacgtgagctcagttgaaggtgggcaactggggatggtgggttcatgtttgatttgtggaaagtggtacctagagatatgtcgcgggggtcaggagaccttggggacgtcagggcttagaaatggaaacaggaagttaaaatggcctctggtaatcgattaccaagggggtgtaatcgattacagggcttaa

SEQ ID NO: 42466 - DNA, 382 bp, Glycine max
  Peptide Sequence Number=SeqID_134151
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgatttttcacattctgagaacatggcacaacctccacctcgtgagaggactctaagggaaatggacgcacctaatttcacctacgaaagcttgtgcatccaataccctgatgaggatgtcccatatgttcttaaaactggactgattcatttgcttccaaagtttcatggccttgcag

SEQ ID NO: 42467 - DNA, 411 bp, Glycine max
  Peptide Sequence Number=SeqID_134152
atggcaatagacgatgctggccatgacaaagcaagcatcctcaaagtcaaagcattagaagctgtagataaaagccttgggatagctggaaaggcttctatgggtagcagaatcaacaggaaaatttcagtttttcctttgtttttgttaaaattactcaagccatggtcgctgctcctcaacccctggcaaaaactgccaccatctacggaaatatctcttaatgcttgtggccatcacatgatagtattaagacgatttagccctccattgcaatggcctcttgaaactctcaaccctggaattgctcctaaagccattgctcaaccatggtatgattttcttgcagaaagtgactttgatcatggagatgaagtctccttttattatagacgttttgacaaagtatga

SEQ ID NO: 42468 - DNA, 150 bp, Glycine max
  Peptide Sequence Number=SeqID_134153
atgcatctacatgatcaaggaagccttcttaacaacaaagagaagaacaagatgaaagattgcaaaaatacaagtggtgaggatgtctccttcaactctaggatctcacaatcactcacaaactcatctcaagctctcaaaccggcttag

SEQ ID NO: 42469 - DNA, 401 bp, Glycine max
  Peptide Sequence Number=SeqID_134154
atggaaaccatatctaacagatttgaggaacttgatgtttatggtaagtttactctaaagagtaaactttgggaacttgcataccctaatcaaaactctatgtgtcctcctccagcaaaggtgaacacaagaggtgcaccaaagaaatcgatgaacagaaaccaaaggtcaacaaagtgtgatccatcgtactgggagtatgtagattatttacattttgtgcagaatagaaactcttcagtgaagtgtagtgcatcatcttctgaccaaccaatccaagaaagatcatgtcaatgtttggatcaatttcatccatttatccaagatttaatgacaacattgtggatgtcaaagctgacggtaactatggatatcgatcgattgccgatttattatgtatg

SEQ ID NO: 42470 - DNA, 291 bp, Glycine max
  Peptide Sequence Number=SeqID_134155
atggtgaaagttggaacctcttacgtgccgatcaacgtctcattttcgccaaaagttggcccagggcttcccggtgctccagtggcttctggtttctatcagctgtcccctccctgtttcagcctactgacgggggtggggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 42471 - DNA, 353 bp, Glycine max
  Peptide Sequence Number=SeqID_134156
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgagcgtctcgatatattacgggactcaatcagacatccga

SEQ ID NO: 42472 - DNA, 699 bp, Glycine max
  Peptide Sequence Number=SeqID_134157
atggtttttctccgggagcgacgcgtccagctcagggacgatgagtataccgatttccaagaagaaatagttcgccggcggtgggcatcactggtcacccccatggccaagttcgatccagacatagtcctcaaatttacgccaatgcttgctacagaggagggcgtgcgtgatatgagatctggatgctatcggccagctcctgggatatcctttagtgctggaagagggccaggaatcaacatcctgcccagcgaccataattccgacctccccctaccgaagtgtcagctggtgtacgccatcctgacgcggatgagcattcatgtggctcagttaatcgctgatgccatctatatatttgcaggtatggcgcctaccaggcaccctctggacccggataagtccaacaaggccctgggatttcccgccttgatcacaggactctgccagtcgttcggcgtccccgtcgcacctagcatggtgattcggccgcccatcacccgagcttttattgagaagtactgcacgcagagacaggtccagggtgatgcaccacaggccgcggacgcgctgccaccacatcaggctggtccagccgggtcatttgacacggagcagtatttgcggcatttggttcgccagcaggcagccaaccaccgggcacatgtacagacccatgattgtcttaccagatga

SEQ ID NO: 42473 - DNA, 153 bp, Glycine max
  Peptide Sequence Number=SeqID_134158
atggactccttgaagcaaagttggtacattgatagcggttgctccaaacacatggcgggagatgcatcaaagtttattcatatttctcccaaaaatagtgaacatgtgacctatggagacaacaaaaaagggggagagatagataaaagatga

SEQ ID NO: 42474 - DNA, 578 bp, Glycine max
  Peptide Sequence Number=SeqID_134159
accatacattcctccaccaatccaacaacagcaacaaccccagaaacagccaacagttaaggcccctccacaaccttccctcgaagaacttgtgaggcaaatgactatgcagaacatgcagtttcagcaagagaccagagcctccattcagagcttaaccgatcagatgggacaattggctacccaattgaatcaacaacagtcgggaaaacagtgtcaaggacctcaacccgtagcaccttcctcatctgcaaatgaacctgccaaacttcactctactccagaaaaaggtgatgacaaaaatttacctaacaatttctgtgcaggtgaatcttcttccacaagtaattctgatttgcagaagcagcacattccccctcttccattccctccaagagcagtaaacatacctctgttggatgcaataaagcaaattccaagatatgccaaattcttgaaggagctgtgcactaataagcggaagcttaaaggaagtgaacggattagcatgggcagaaatgtctccgcattgattggtaaatctgttcctcaaattcctgaaaaatgcaaagatccag

SEQ ID NO: 42475 - DNA, 936 bp, Glycine max
  Peptide Sequence Number=SeqID_134160
atgcgtatcttgcaggtgacatcactgttttctcccgaccgtgtgggaggcgcggagatattcgtcgaagaccttgcccggggtttggccgggaaaggacatacaatcgcggttgccgccatttcccgggagcgccagaccgcagaattgcgagacggtttcgccattcatcggcttggacatacgacgccctttttcattggggattgggagcggcaatcagaatggaaacgcaaatattataaggtcgccgtccagatcgatccccggctggtgcagcggctggcgcgcgtcattgaggattttcgcccggatgtggtcaatacccattccctctcggaactgacgccgctgatctggccgatgattggcagacgcggtattccgcttgtgcactccctgcatgatttcaccagcatgtgcaccaatggctccctgtttcacgaagggcatatctgcgatggcaggagcaaaaaatgccgggccttctcctgtctgcaccggcgctgccaaggcgcggtggatgctgtcaccggcgttggcagcgacattctgaaacgccatctggaggccggttttttcacgcacgttcctgaaaatcgccgcgcgataatctggaacgccatcgcacaaccagaatcgttgaacccccgcaaggcccgtgttgcaggagaaccgctggttttcggttatctcggacgtatcgaagaacccaagggcgccgatctccttatcgatgccatgcggctcctgcccccgcaaggttggcgaatgaccatggccggtcgagcgcccggcggcatcgaaacctataagcgaaaggcatcaggcctgcccgtcgactttcccggatatgtcgaggccgacagtttttttgctggcatagattgcctcgtcgtgccgcctttgtggccggagctttcggcagaacggtag

SEQ ID NO: 42476 - DNA, 345 bp, Glycine max
  Peptide Sequence Number=SeqID_134161
atgtatgtcagagatgggggaatacgcaaagatgaggaattgctgatacattccttcctagaaaagtctactggggtagctgttacctggatgcaactacagaacatttgcaaaaagggggacggatctttcaaagaacacgcccaaaaggtggagggatctagcggcccaagtggtacccccaatgatggaaagggagacgatgatcgtgagagaatcgatactctaatggaaagatgcggtgctgcaattgccctaccaaactttgcgttgttcgccagtgaaaggatcgaacctgatgtccccatccggcatcaaccaaatgaatcatccaacctcagataa

SEQ ID NO: 42477 - DNA, 234 bp, Glycine max
  Peptide Sequence Number=SeqID_134162
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgcccgttcgtaa

SEQ ID NO: 42478 - DNA, 843 bp, Glycine max
  Peptide Sequence Number=SeqID_134163
gaacgtcctgaattgaagttagcctcccacggaaagaaagttgaaaaatttgggaggccagctcctaagattgaagggctagtcactgccataggattaactcctttgattgcgtgtttagtagacactggcgatctaggagttatatccgcttttgttgagaggtggcacaaggagactagcagcttccatcttccagtagaagagttggccatcacactggatgatgtggcctcattgcttcatcttccgatcataagcgccttccacagcttcgagcctctgcatgtggatgaggcggtcattatgttgatggagttggaagagagtgggagctatgcatggggagctgccgccttagtccatatgtatgatcagttaaatgatgcttctaagagcactggccgacagcttgctggttacattactttgttacagtgttggatatataagcattttcccaatgttcatgagagcatgactgatgaaaggtatgatgagacgtcacaacgtgcctatcgatggcttactatgaaggcttatatgaaggaattaacagcatcgtcgtaccggacacgtatagatgcactggtgatccctgacgatatcgacgacaggtggatgcattactcagaccatctagcagttgcgggacaaatttgtcttgtgtctgggcaatgttcagcaaattacatggactggttctttgggatatctcatccgttcatcacacccacacgggcagttgatcagcccagacatccacttgtcccacagcatgaggcatatgtggagccagatatcccggaggtcccagtggcaccagaagctggaccgtcatag

SEQ ID NO: 42479 - DNA, 351 bp, Glycine max
  Peptide Sequence Number=SeqID_134164
atggctccaaaaaaactctccacgaagaggtctagaagagatgccacaggagaaggatccagtgctgcctcagagtttgatagtcatcactttcggagtgccgagcaccagcggcgcttcgaggccatcaggggatggtcattccacagggagaggcgtgtccaactcagggaggatgagtatacggacttccaggaggagatagctcacagacgttggacaccgctagtgactcccatggcaaagttcgaccctgagatagtcctagagttctatgctagcgcctggcccacgaaggagggagttcgggacatgtactcgtggggtaaggggtcagtggattccctttga

SEQ ID NO: 42480 - DNA, 174 bp, Glycine max
  Peptide Sequence Number=SeqID_134165
atgagaaaggtgaaaggaaatgtttcttttggagattcttccaaggtgcaaatccaaggaaaagattttggcaacaaggtgttggctattgtgaaccaaatgaagttcactttgaatagagaaaatatggaagcatgttcgtgtggtagcgaaaagatgaccttcggtccttaa

SEQ ID NO: 42481 - DNA, 464 bp, Glycine max
  Peptide Sequence Number=SeqID_134166
caattgcagaatcaagagatctcactaatatgtctcttgccactctctttggaaaacttcaagaacttgaaatggaacttatgagactccagcaacatgaagagaatgataaaaagaggaaaggaataacactcagagcctcatcatcttctattcaagaagaaaatgacaaagaggacttgactgaaatagaagaagatgatgattttagattttttgtgaagagattcaataagtttttgagaaacaaaagaaatcaaagaaaatcaaacatcaatccaaagaagaaaggagaagattcctccttagccccaaaatgctatgaatgtgatcaacctgggcacatgagattcgattgtcttgtctttaaaagaagaatggaaaaatccgacaagaggaatttcaaagaaaagaaagaaaagaaagcatacataatttgggaagataatgacataaattcataa

SEQ ID NO: 42482 - DNA, 381 bp, Glycine max
  Peptide Sequence Number=SeqID_134167
atgcctaggcaggcgcaggatgatgcaccgcaggccgcagacacaccgccaccacctcatcaggctgatcccgctgggtcattaggcatggagcggtatctacaacacttggttcaccagcaggcggccaaccaccgggggctggtgcagatacatgggtgtctctacctgctcagcctcagtcagcagggccagggttttgctccttttgcgtgccctactccagatcagttcagggctgaggtcgcattgcacggagattggcccgaggcccaagcagggggggcgcctgcaggagctcccggcgatgcagaggaggcccgcatggatgaggagatgacagacttgctcggcttcttgggaggaagcggagccacgtga

SEQ ID NO: 42483 - DNA, 375 bp, Glycine max
  Peptide Sequence Number=SeqID_134168
atgcgagcgaagaattctgatctgtatggattcctcgagctacagtccattcaagggtctgggcaatcgcagtttgagactgaaagttacataaagagttggatgcagagttcaaaacacgatgtctaccttggagactacctgaatggtggacactggcagatggtggtcatcgtgcccaaggaacacctagttgtctggttttgttcattgcataacaggccagacaactaccttaaggggataattaatagtgctttaaaaggtcttgatgatgctccacaacctaaatcaaaggttcctactaggtggattgtcgtcaagtgtaatagacaaaaaggaagcactgagtgtagctattatgtcatgcactag

SEQ ID NO: 42484 - DNA, 285 bp, Glycine max
  Peptide Sequence Number=SeqID_134169
atgaaggaaaatagagcgaaattggccgtattatcttcgaggatgtcgatgtgtgggaccggtacaatgtttgcaacccattatgggtaccgagcgacggccagaaaaccagcgtcaaattgcttcttcacttcttcttttatcttcaaagatgtttcgagcttcatccttctcagtttctgctttaccggggaacactcgggatttagaggtaatcggtactgtacaatgtcagaactcaaaccgggcatatcttggtacgaccaagcaaagatgtcttggtag

SEQ ID NO: 42485 - DNA, 1041 bp, Glycine max
  Peptide Sequence Number=SeqID_134170
actacacgtcctcgccttcagaggactacacgtcctaaccttcagaggactacacgtcctcaccttcagaaggctacatgccctcgccttcagaggactacacgtcttcgccatcagagggctacacgccctcaccttcaaaggactacacgtcctcgccatcaaagggataaagccctcaactttagagggctgcatgccctcaccttcagaggactacacgtcctcctcttcagagggctacacgccctcaccttcagaggactacacgtcctcacctttagatggctgcactcacttccctttagagggctacacgcccttgccttcagaggactacacgtcctcgccttcagaggactacaagtcctcacctttagagggctacatgccctcgccttcaaaggacaacatgtcctcgccatcagagggctacatgtcctcgccatcagagggctacatgccctccccttcagagggctacatgccctccacttcagagggctacacaccctcaccttcaaaggactacacgtcctcaccatcaaagggctacatgccctcaacttcagagggctacacgccctcaccttcagaggactacacgtccttgccttcagagggctacatgccttcgcctttagagcgctgcatgccctcgccttcagaggaggctatcctccgcccttaatgcttaatcaaggcttgcgatcggaggctatcatgcagctactatgcataccaggtcaaaatttcacccagaccaccacagggagacgagtgaggatcatgcggaccaccacaactccgatctccccctgccaaaggatcgcgttcgtaagacagctagtggacccggagaagtccaatagggtcctggggtttccaactctgattacgggcctctgtcagttctacggggcacagggcgagacaccacagcatgccattggggacgggactcttacaccgccaccacctccagagcccctcagctcatctataaaggctggagcgttgcctacgacccgtgaccgacca

SEQ ID NO: 42486 - DNA, 111 bp, Glycine max
  Peptide Sequence Number=SeqID_134171
atgcattcgggggcacagtgccccatgtgtgcagttaagaagacgcgcaacacggagatgtacacagtatggcaatacccacaaataatcatacagcaaaggcgtacatga

SEQ ID NO: 42487 - DNA, 495 bp, Glycine max
  Peptide Sequence Number=SeqID_134172
atgtggggcatccctgttatccttgaaccaaaccaagccctgacatgtatcatgtctagccgttctacgagctttgagccaaaatcccgaatcaccataaaccttgacccaggaaaaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42488 - DNA, 234 bp, Glycine max
  Peptide Sequence Number=SeqID_134173
atgtccccagtggagtcgccaactgtcgcaacgtgcccttcgcgggcgagcgagggcgaggctcacgggtgcgctttccaaaggagaaaagatgcgcggagtcgccaccaacgtttatttgtggaaaacgtcgggaaaaccgaaggaaaccggtcgacaaaagcggggtttttgctcctacgtaccctcctttggagaggaaataagacctacgtagttctttcacatgcgtga

SEQ ID NO: 42489 - DNA, 869 bp, Glycine max
  Peptide Sequence Number=SeqID_134174
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatctcaatgggtacatccggatagcaatgacgtcgacaagtctgtaactcgtccaaagtccaaacaggaaaataccattgccttgccatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42490 - DNA, 192 bp, Glycine max
  Peptide Sequence Number=SeqID_134175
atgcccgctacagggaacgctgtcccattcgctgcattcaggctgacgcaactgttgggaagggcgatcggtgcgggcctcttcgctattacgccagctggcgtaaagggggatggcgaatggagctccaccgcggtggcggccgctctagaactagtggatcccccgggctgcaggaattcgatattctga

SEQ ID NO: 42491 - DNA, 53 bp, Glycine max
  Peptide Sequence Number=SeqID_134176
atgggaatcaaaccacctgcagtagatcttcttgtttttccagtcacgacgtt

SEQ ID NO: 42492 - DNA, 537 bp, Glycine max
  Peptide Sequence Number=SeqID_134177
atgacgtcgctatttagcaacattctgcccagcgaccacaatgccaatctctccctgcagatgtatcggttgggatcgtgcccacaagacgcccagtgggcccgaagaagtccaacagggccctggggtttccagctctggttacgggcctctgtcagccctatagggtgctcgttcccccagcgaggaatcacacccacaaagacacccagtggacccggagaagtccaacagggccctgggggatcgcacctgcaagacacccagtggactcgaagaagtccaacagggtcttggagttgtcaagctctaattacgggtctctgtcaattctacggagtacctgtcacctccagcaagggcatcaggccccctactaatcgagctttcatcaagaagtactgcgtctccaggcaggcgcagggcgaaacaccacagcagcctggggatggccgacagcgggcaacagacgcaccgccatcacctctagagttcacctcagctcatcaaacaaaaaggttagagcattgcttatga

SEQ ID NO: 42493 - DNA, 198 bp, Glycine max
  Peptide Sequence Number=SeqID_134178
atggaggagaaaaaaaagaaaaaagtggaggaagctgctcaattcggaaacactaacaccgtgattgatcctccatctcccattaaacgacacgtgaagtggaagatggcccgcaccaaaaaaactgaacaaatgacgtatgagacaacaaaggaaattgctaacaagattgatttgttggaggagcaagtctcatag

SEQ ID NO: 42494 - DNA, 450 bp, Glycine max
  Peptide Sequence Number=SeqID_134179
agaggacttatcttagggttggaagagcttgatatctttatcagcacagggaagaagcattttcctacttcagcaaagggatgtcaggttgcttgcgttaaatataagctcccaacatgcttctgtacaggacttgtgatcaacactagggttgccagacttcactccgtgtttagggacagcttcaaaggaatgatggagtcgtgtccaaggtgcggtgagcttcacttggagtcccagagaaataagtcagctctccaacatgggagactgcatctcaaatatctgagaattggggacatctgttggacaaaagtcgaagatctcattcgcctcaaacataagtttgagcacgttcagatagaagtaactgctataactcctctagcagacaaatgcccagcttgcccctcagtttttcaaactgatttgcatccaatgcctttgtga

SEQ ID NO: 42495 - DNA, 513 bp, Glycine max
  Peptide Sequence Number=SeqID_134180
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtggatgcaagttggaacccgaactgcagtcatcatatctgaaccaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 42496 - DNA, 723 bp, Glycine max
  Peptide Sequence Number=SeqID_134181
atggggataaatcaaaacggaaaaaggttttatcaagtcaaggttaaaggtctagatgtcactagcctcaaggaattgggacgattgatggggacccctccaaaggcaagccttccgcaaagtgtacgggaagattctagatttggccgtagcggaggtatttacggaagctgtcgtatccctcgcccaatactacgaccagccgttgaggtgtttcacgtttggggacttccaatggtaccaactattgaagagtttgaggaaatattaggatgccctcttggggggagaagaccgtatcttttctccggctttcttccttccttgagaaagattgcaactgtggttggtgattcagcaaaagagttggatcgcacgaagcaaactcggaacggcgtagtgggcctgcctcggaaatacttggaagacttagccgccattgatgctttcctcgcatatcaccatagcaaggaaagtccagtggtggctatcttggcagatttgtttgacacctttgaccagaggtgtgagaaaaacagtgcacggattgtctattgtttacccgctctctgtgtgtggttgatttcacacctattccaacaagacacgagacacccgtgtccgcttcaaagctatcgctcatgcgccgaaaaaggaagagtcgtttgggaccaacatttggctgggataggggcatccgttgaggaaagacaaggagcttag

SEQ ID NO: 42497 - DNA, 189 bp, Glycine max
  Peptide Sequence Number=SeqID_134182
atgttgctaagtagcaatgtcatctatatctgtgtaagagtggtcatgttggtgcgcatgatccgcactcgtctctttgcagcggcacgggcgatacggaccctccgtcggtttgctaaagtgaggggatcaaagacgaaacccacgcatgatgcatatgcgaaaggcacaacacggggatgtacatag

SEQ ID NO: 42498 - DNA, 144 bp, Glycine max
  Peptide Sequence Number=SeqID_134183
atgtttcaatctttgaccattcaccacccatgttctgtcagggtcctgagattatggatcatgcagttctattgcatcgtaaggccaaacattcttaatgatgaaaggtctagaccttttggaattcagtttaccaggaaataa

SEQ ID NO: 42499 - DNA, 333 bp, Glycine max
  Peptide Sequence Number=SeqID_134184
atgcaccacaggccgcggacgcgccgccacgtcatcaggctggtccagctgggatcatttgatacagagcagtatttgcggcatttggttcgccagcaggcggccaaccacccgggcacatcttgcagagccagggctttacttcttttttcgtgccctactccggaccagttcagggcagaggtcgcatggcctggagattggcctgaggcccaggcaggagaggcaccagcaggggcaccagcagaggctcccgacgaggcagatgagacccgcgaggatgaagagatgaccgatttacttgatttcttaggagggagcggtgccacatga

SEQ ID NO: 42500 - DNA, 252 bp, Glycine max
  Peptide Sequence Number=SeqID_134185
atggtctatcgcttttcactcagatttgcggattcaggcacatcagatatcgagacgctcgaaattgaacgacaaaagctatcgagaaattcaaatggtcataacttttcacacggaggtccgatgccggaacatcacttatcgagacgtttgaaattgaacagcggaagatatcgagaaattcaaatggtcataacttgtcacacggaggtccgattcaggcgaatcatatatcgagatgctcgaaattga

SEQ ID NO: 42501 - DNA, 378 bp, Glycine max
  Peptide Sequence Number=SeqID_134186
atgtccatccgttctacaagccttgagccaaagtcccatctcaccataaaccttaccctaaaaagaaaacaaaaaggagaaagttcccgatcaaagaatcgaaagaagaagaagaaaaaaggaaaattcccaatcaaagagtgggagaaagcaaacaaaagaaagaaaattcccgatcaaggatcggaagaaaacagaagaaatatgcagaaaggtctttggactagacaatatctgaacaatacagaattgtcaccaagtaaacaagaaaagaaaggaaaccacgacctaaagtggtcctctccctttgattgccaaccaaaatcctgtgcgtcggtgacttgttcacctcacactaaacaaggtgggatcctctag

SEQ ID NO: 42502 - DNA, 300 bp, Glycine max
  Peptide Sequence Number=SeqID_134187
atggaaaattctgacaagatgaatttcaaagagaagaaagaaaagaaaggatatatcacttgggaagataatgtcataaattattcaagtgattcagagaagaaaatcataagtctggatatcatgatgaaagactatgaaaatggagaagagcaaagtcgatacattgatagcaatttctccaaacacatggcatgcatcaaagtttattcattttttctctccaagataaatgaatatgtgatttatggagacagcaaacaaaggccacatttctccccaagaaaagtgaatatgtga

SEQ ID NO: 42503 - DNA, 1533 bp, Glycine max
  Peptide Sequence Number=SeqID_134188
atgtcctcaccttcagaggactacacgtcctcgccttcagagaactacacgtcctccccttcagaggactacatgtcctcgccatcagagggctacacgtcctcgccttcagagggcaccacaccctcgccttcagagggctacgcgcctttcccttcagagggctacacgccctcacctttagaggactacacgtcctcgccttcagagggttgcacaccctcacctgcagaggactacatgtccttaccatcagcggactacacgtcctcgccatcagagggctgtatgccctccccttttagaggactacacgtcttcgcctttagagggctacacggcctcgccttcagagggctacgcgccctcgccttcaaaggacaacacatcctctccttcagagggctacatgctctcgccttcagaggaggactacccgtcctcacctttagagggctacacgccctcgccatcagggggctacacgtcttcatcttcaggggactacacgtcttcccctttagagggctacacgccctcgccttcgtaggactacacgtcctcacctttagagggctacatgccctcaccattagagggctacacgccctcaacttcagaggactacacgtcctcaccttgagagggctacacgccttcgccattggaggactacacgtcctccccttcaaaggactgcacgtcttcgcattcagaggactacacgtcgtcgccttcagaggactagacgtccttgcctttagagggctacacgccctcgccttcagaggactacacgtcctcaccttcaccttcagaggggtacaggtcctcaccttcatagggctacacgccctcgcctttagagaactacacaccctcaccttcaaaggactacacgtcctcgccttcagaggactacatgtcctcaccttgagagggctacacgccttcgcctttagaggactacatgtcctccccttcaaaggactgcacgtcctcgcattcagaggactacacgtcctcgccttcagaggactacacgtccttgcctttagagggctacacgccctcgccattagaggactacacgtcctcaccttcaccttcagaggggtacaggtcctcaccttcatagggctacacgccttcgcctttagaggactacacattctccgcttcaaaggactgcacgtcctcgtattccgaggactacacgtcctcgcctttacagggctgcacgccctcgccttcagaggactacacgtcctcaccttcaccttcagaggggtacaggacctcaccttcatagggctacatgccttcgcctttagaggactacacgtcctccccttcaaaggactgcatgtcctcgtattcagaggactacatgtcgtctccttcagaggactacacgcccttgcctttagagggctacactccctcgccttcagaggactacacgtcctggccttcaccttcagaggggtacaggtcctcaccttcatagggctacacgccctcgccttttga

SEQ ID NO: 42504 - DNA, 360 bp, Glycine max
  Peptide Sequence Number=SeqID_134189
atggacatagactttgatataaggaaagacgaaccacctgcaatcattgatgaaagtaacccagctgatgttgcgctatatgagcaatgggagcgatccaaccggctcagcgtgatgttcattaagaccaaaagctcggctaggatacatgattctgttgacctgcatgaaaaggtccgagacttgcttaaggccattgatgaccaattcatcacttcagataagactttagcaagcaccctgatcatgaagttctcctctcttcggctcactagtgtgaaaggaagaagaaaggcttgtaatggagatgggtgggagtgcattgctgacaactgcttatgggaagaacaaagcaactaa

SEQ ID NO: 42505 - DNA, 246 bp, Glycine max
  Peptide Sequence Number=SeqID_134190
atggagaacaaaaacaacaacagtggcgagtcggagctgcgggtggtggttgtcatcttcctcttgaagggcagatcgatcctcctcggtcgctgccgctccgctgtcggcaactgcccttcaccctatggccacctcgaattacctagaggggctttgttacacgcacccagcataatagatggtgcacccatcaaacgagtgttgaagcttaaggattgtccaatccataagtggttcaaataa

SEQ ID NO: 42506 - DNA, 207 bp, Glycine max
  Peptide Sequence Number=SeqID_134191
atgcatatgacacagatgcaatttacgaatacgggagcccgagaaattgtccccttcttggatacaatgtttgggcggcatggcacccaacgtatgtttttaagaaggcgacacggaccctctgtcggttttgctaaagtgaggggatcaagacagaacccatgtgcgatgcatatgcgcaaggcgcaacacgggggatgtacatag

SEQ ID NO: 42507 - DNA, 477 bp, Glycine max
  Peptide Sequence Number=SeqID_134192
atggaccttattgaaaacatggctgttagtgatattttcatcttaagagacagagcccacatcccaaccaagaagagcttattagagcttacatcacaggatgcgttgttgattctaggatgtacaatctgtagtagagctcatgactctggatattgtatccctagtgaagaaccaattgttcatgaagtcaactacatggggaatcagccccgaaatacttttaatgcagaaggatttaccggattccaaaatggccagcaatatcaacaacagagacaatggcagaaccacccaggcaatcaattcaacagagaccagggtggaccctctaacaggccccaacaacaagggcctagtctctttgagcgtacaacgaagctagaagagactctagctcagtttatgcaggtttcaatgtctaaccagaagagcacggagtccaccattaagaatttggaggtccaagtgggctag

SEQ ID NO: 42508 - DNA, 330 bp, Glycine max
  Peptide Sequence Number=SeqID_134193
atgacagaacatttgcattatcgagcattgctagtgtatctggatgttgtcaggcttttaaattatttgcaggttacaattccattaggatatcatgatgattgttctctttatgtctcattcgtctcatttcatggagctgataaatttcttctaaacacgatcttggatatttattcaactcttcaagagcaagaacaaagtgtggagagaccaaccatgagggaagtggttgaaatgcttgcaccagcaaagatatacaaacacattccaaacgcagtttctcctttggggggagaggaacctataatggagaaggcccctacttga

SEQ ID NO: 42509 - DNA, 552 bp, Glycine max
  Peptide Sequence Number=SeqID_134194
atggcagaaaatatgcaaattgaagaacctagttcacaccaaccaacttcacaatcttcagaccatcctactccgctatcttcacaccaaccaactttagtagaaagttctaccggtacagttgaaggtcctaataatgaacctatgcaacaaccacctagcatagaggtggatgaccatggtgtatcatcaacaaaaactggaggagtgaggctcaaaagtattgtgtggaaccattttgataagattaaaactgttgatgggcaagacaaggcccaatgtaaatactgcaaaaagcttcttgggggagcatcaaagaatggaacaaagcatttgcatgcccatatggagaaatgcattcggaaaaggttacatgacaaagggaagggacaaacatttcttattcctaagctgttggatacaaatgaaggaagggtggcaattacatcagatatgtggactgcaagcaaccaaaagaaagggtatatggatgtcacagctcattacattgatagctcatggactttgcaaagtcgcattttgaggtactag

SEQ ID NO: 42510 - DNA, 573 bp, Glycine max
  Peptide Sequence Number=SeqID_134195
atgcttcctttcgactcccgacatgtcgcggaacttcacggattgcctaacgatgggtgtcaagttcctcgaagtggtcatgcgaaggtcgcatcccaccaaacagatggtcctcgaacgaaattaggccataaggctgatttgaacttgagccacccttatagccttggtagcttccttgaaagttttgttgaggtctggcttggttctgcacatgatgggcctcctcttcttgttgtccatcaccaggtgctaaattgtggccattctgatgattaccaccacagaaatcacatctcaaaatttgttgaacttggtgagcttgatgtgttttatgtggtctaccctggtgatattgctgaggaagttggcatatctgcttcgttaaggcctccatttgttgcgtcaagagttttttttgtgctagaattgcattttgagtgtccaactccattataccttttctttgagttagagctctatcatgatgactttgataatcactggctctatggagtcaatgattacaatggcttcctctgcactcttggacatcatagtgcctccagctga

SEQ ID NO: 42511 - DNA, 249 bp, Glycine max
  Peptide Sequence Number=SeqID_134196
atggcgtatcagaaaggcataatagaactttattggatatggttaggaagaatgttacaaaaggctagacttgttgctaagggttcattgaaaatgatgaatatcaaagagtacagtttcaccggagaagtagcattatatggatggggttctcatgaagagaaagagaccagctattgtgtgactatatgtaaagaaatcagaaatacgatcttaagcaagcttccgcctatggtatttgaagtttaa

SEQ ID NO: 42512 - DNA, 1005 bp, Glycine max
  Peptide Sequence Number=SeqID_134197
atgaggatttttctgagctttgacaagtttcttccccaacatgctccattcattagtcgagaggttggcccggcctggttcactgactattttcctgctgtcgatccggacaatgaagaagaagtgaacgaaatatggtcattttacttgaatccacagatcctgtcttgtcgtacaggtgttcaatcgaactatttaggcttggttggataccagcctaatttggtttcaagacaatttggcctctcgcaaatccgtcctaaaagcttgttcgaagatcctcgagacgttataagaggggccaatctttcagaaaagacttttaagaagtttttgaagatttctcttgatgaaaactataacctgcatccttttgagttcaaccattcccacttctgcaccatggggtttgttacctggtgggagaaatattattcgacccgttcagttggagatactacgatcatgatctccagacttgaaagtggttttacacaaccaacggtcgagaatatccgctcaaaccttcaagctcgaggcaaaacaatcatgacgaagaaaagcgctgaaacgtctcgagctgatgtgagacccaaaaaacccactggagtgaagatccaagaaaggaaacaagaagagaaggaagaggaggaaagaccactcataagaaaaagaaaatttccttcgacttcgaccaagtctactgaacaaacagaggcagggaattcccaagctcaaatacctaagaagaaaaagaaggtaaagcaggacgagcctgaacctcctgtggctgttgagggtggtgagccaatcaagaagaaaaagaaaaagaccaagtcctcaaaagaacaaggtgacaatcaacttgttgacgtccaaccaccttcgaccgacgttgacggcactgaagtagaggctactccttctattgccgagatgggcaaccctgtcgagcaacctaactcaccacaagaacaacccgccgtcgaggtatcatcctcttaa

SEQ ID NO: 42513 - DNA, 514 bp, Glycine max
  Peptide Sequence Number=SeqID_134198
ggatggaccctcgggtactagtaccctggtcttcagaggactacacgtcctcgccaacagagggctgcacgccctcaccttaagaggactgtgtgtcctcactttcagaggactgcatgtccccaccttcagagggctacacgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacaccctcacctttagaggactacacgtcctcgccaacagagggctgcacgccctcaccttgagaggactacacgtcctcgccaatgtagggctacacgccctcacctttagaggactacacgtcctcgccttcagaggactccatgtcctcaccatcagagggctgcacgccctcgcctccagaggctacgcgtcctcgccttcagagggctccacatctgcaccttaa

SEQ ID NO: 42514 - DNA, 294 bp, Glycine max
  Peptide Sequence Number=SeqID_134199
atggagtggtatctacaacacttggttcgccaacaggcggccaaccaccgggggcaggtgcagatacatgagtgtctctaccagctcaacctcagtcagcagggccagggtttcactccttttgcgtgccctactccagatcagtttatggttgaggtcgcatggcccggagattggcccaaggcccaagcaggggaggcgcctacaggagctcccggcgatgcagaggaggcccgcatggataaggagatgatgaacttgctcggtttcttgggaggaagcggagccacgtga

SEQ ID NO: 42515 - DNA, 345 bp, Glycine max
  Peptide Sequence Number=SeqID_134200
atgacattgatcatcccacagctttatctaaagtcgttgaaggttatgtggaatgctaccttgtttggggtgtttaataacaactttcccttgtacataaagcatgaagatctgtctgaaatagcacacggtggtcaatgtctcagcatctctattatacaattgtggattctgcatatgactaagacaagtatgcgagcggggaatgccgatgtgtatggattccttgagccacaatccatacagagatctgtgcaatcacaatttcaatcagaaagttacattaagaactggatgcagaattcaaagagagatgtgtacctaggagtctacttgaatgggtaa

SEQ ID NO: 42516 - DNA, 937 bp, Glycine max
  Peptide Sequence Number=SeqID_134201
tcgacctatatgatacctttgactgaagatgtgagaagagcagtacgaggattgtttgctgtactccagctctttatgtatggttggtttcacacctttttcgccaagagaggatttccaaatgttcccttgataaggacaaggggttgcatcagttacaatcctgttcttgctataaggcaacttggctaccctatgagaggggcaccactagaggaagagctcgcgcctgtcatttcacgaggtttcgataagaccaatgtggagacacttcagaatttgagaatcgctaaaagggaggaagttgaggcatcggaggaagacgaagaggtgcaggcccttagggtagaactcgagcaagcccaaacagtcaaagaaaggttcaaatcagcaggtcttaaaatccgaaaggagaatgccgaaatgagagatataaatatagctaccaccaaggccttggaagaagagaccaagagggctcgtagggaagagcacggccggaacaagttccgaggggctctgtggggcagtaacagcgagcttaagctccagagagaggaaagggaccaatcacgagtagacagtttgatcttgaaagatgagttgaaggtttgctcaaggtccaaaagaaacttgtctcagcggttatgcgagacagagaccaacatgttagctatcgtcagcaaataccaagaagagctaaatctagccacggcccacgagcacaaagtggcggacgagtatgcccgagtttatgcggaaaaggaagatagaggaagggtgatcgactcgttacatcaaaaggcaacaatgtggatggaccaatttgctcttaccttgaacgggagtcaagaacttccccgattgctagccaacgccaaagcgatggcggacacctacttcgcccccgaggagatccacggacttctcggctatt

SEQ ID NO: 42517 - DNA, 387 bp, Glycine max
  Peptide Sequence Number=SeqID_134202
atgggtgaagcaaaggaggtgcaagagaagatgaaggccgacatggaggccatgaaagtgcaaatggccacaatgatggaggccatgatgagcatgaagaagataatggaagccaatacggttatagttgccgctactagcgttgtcgctaaggtgaacccgatgctccgatctggcctcaaccaaatgaatcatccaacctcaaatatggcacatatctctcaaaccatgggggagacacatgaaattccccaccacaatctagctgacttcgagccttgcctcggatatgccgctgaagggcaagcagttggtggtatacccctgcaaaacactttggagggccccctcagtgtcacccacgaccacaaccctcgcagcggttaa

SEQ ID NO: 42518 - DNA, 114 bp, Glycine max
  Peptide Sequence Number=SeqID_134203
tcggaggaaaaattggaggaatctcagggaaccgctagagatgccgctatcgctgtcggaagacacgtgagtccgcttagaggaagggatgagttattcacaattgaggattag

SEQ ID NO: 42519 - DNA, 757 bp, Glycine max
  Peptide Sequence Number=SeqID_134204
gaaagccttccgcaaagtctacgggaagattctagatttgaccgcagcggaggtatttacggaagctgtcgtatccctcgcccaatactatggccaatcgttgagcgcgatcaattggtttcctcgttggaaggaaggcaaggaaggagttcttttctcgtgtggggactaccctaatgttccattgatagggactagggggtgtattaattataatcctgcactcgccataagacagctagggtaccccatgaggggagcgccaacggaagggagtctctcacctttccttgtgaaagatttaggcgcgcaaggtctcaaggttatacaaagaatccacaaggcgtggaggagtccgttgaggaaagacaaggagcttaggggcatccgtaatggcgtcatcggaggttatcatggatggctaagaattcacacgcgagggttagattggctctccaagttgaaagttatcgatgaggagaacttcgaagctccggaggaagatgaagaagtccgagctctaaaattggagctagggaaggaaagactcgccaaggagaagttcaaatcagctgctacacacatccggaaagagtgcaccgagttacaagaggaaaacgcggccactgcaagagcccttgaacaagaaaccaaaagggcccgcaaggaggaatatggccgagagaaattccgaggagcattgtggggtagcaacaatgagctcaagctccgaagagaggaaagagatcggtcacgg

SEQ ID NO: 42520 - DNA, 335 bp, Glycine max
  Peptide Sequence Number=SeqID_134205
tcaactttagaggactacacgtcctcgccgtcaaagggtcatgtaccttcacctttgtaaggcgacacgccctcaccttcagaggactacacgtcctcgcctttagaggactacacgtcctcgccatcataggactacactccctcgccttcaaaagggatcgcaccaacaagacacccagtggacccggaaaagtccaacagggccctggggtttccagctctagttacgggcctctatcagtcctacagggtgcccatacccccccggcaaggtcacgtcatcatagggatcgcgtctgcaagacacccaatggacccgaagaagtccaatag

SEQ ID NO: 42521 - DNA, 206 bp, Glycine max
  Peptide Sequence Number=SeqID_134206
tcatcgacttgcttgatgacagtgaaacctcatctagagtttttctctttgatgatacattgtcgctggtagtccctaccgccacaacgtttgatatcaaaggggatgatatctctaggctctataatgtaggtaaggtgtcataccctaatttcgtccggggacctttgcttgatgacatgcgaccattctttggtcctcgtgag

SEQ ID NO: 42522 - DNA, 264 bp, Glycine max
  Peptide Sequence Number=SeqID_134207
atgggcgaaagcctgacggagcaatgccgcgtgaaggtagaaggcctacgggtcatgaacttcttttcccggagaagaagcaatgacgttcgccgtcaaatcccagggctcaaccctggacaggcggtggaaactaccaagctggagtacggtaggggcagagggaatttccggtggagcggtgaaatgcgtagagatcggaaagaacaccaacggcgaaagcactctgctgggccgacactgacactgagagacgaaagctag

SEQ ID NO: 42523 - DNA, 528 bp, Glycine max
  Peptide Sequence Number=SeqID_134208
atgaaaaattgccaatccaacagtaatgaacttgcaaccaacattgaaggctattctgacttgggtgatcaggccatgcaatgtagacattgtaatgcaaaaatgcgccaacatgttgcaattcaaccacacattgtttcagctttaattcaaatgttggatgaccataatgtccatgcaaaaagtttcagaatggccagagacagattgacagatagtcaattagataatgtaaaattgagattgatagctggacgtgaaaaagatggtcgtacaaacaatctcccaaatgtttttgaagttgctgccctgattgttggtgattttgatgcagactcaagaagggatattattgttgaaactcaaaatagagaattacaaagaatccatgaattacactctagctatctaggactgcagtaccctttactcttcccttatggtgaaaatggatatagacctgatatacttcaccgttctacatctagcagcagaaaaaggaagagaaattgtctaacgatgagatag

SEQ ID NO: 42524 - DNA, 330 bp, Glycine max
  Peptide Sequence Number=SeqID_134209
atgaattgcgtcttcatggggtcgcgtggttcgtactggatgtcaaactctgaaagttcgatggagcaagccaccatctttcttacgagttcaggatttctcaaaaacctgcttgatggggtagttcgtcttgactaccacttgatgactcgggaagtaaggcttgagtcgttgggccaagggaatgagtgggctgagctgataacttcgtcaattactgagagatacaagagcaagggtgctcttggccttgatcgactcaaagatggtagtgtggttatggtcttcttgaaagctagaaaggcttgttcacaagtctcgttccattaa

SEQ ID NO: 42525 - DNA, 618 bp, Glycine max
  Peptide Sequence Number=SeqID_134210
atggcaatattgttcttgctatgcagtggccttggctatgctgcttttggtgataacacacctgggaacatcttgactggatttaccgaacccttctggttggttgcactggggaacggattcatcgtaatccacatgattggagcatatcagggcgttcttcttatttctccttctgccctaagttcgtctttgtcacaaactgggctgctcttccgtgactgcaaccatattgtggagttggtctttgtggagttcgtgtctgccacatatcgattgaggtcgaagaaaactacgaaaggaaaaggggggaagcgattttggaagtccattgtggttggctttaagcctcccagggaagccatcaaagtaaggattgatgggcttgggcagcaacccaaagagaatcatgcaactgcttcctctccaatttttcttgctctgttaactgtctatgcattgagttctcctccaaattcttcttcttcttccactcagaggaagtgtgcttttgctagaaagtgtgctaggctggtcaaagagcaaagggctcgtttctacatcatgaggcactgtgtcattatgctcatatgctggcatgagtacaatgattcatga

SEQ ID NO: 42526 - DNA, 126 bp, Glycine max
  Peptide Sequence Number=SeqID_134211
atgccgcctgagagagacgaccacgacgacgacgctgctttacgtgctggcactggcgtgcgacatcagtggcagcatgggggttgtggtgacatcggtgggagtgggagcatcgccagcttctga

SEQ ID NO: 42527 - DNA, 481 bp, Glycine max
  Peptide Sequence Number=SeqID_134212
aggactacacgtccttaccttcgatggacttcccgtgctcgccttcagaggactacacggcctcaccttcagagggctacacgtcctctccttcaaatggactacacatgtctgcctttcagagggctacacaccgtcaccttcaaaagcggactacacgtctcacctcttagagggctacacctcctttaaggtacacgccctcacctttagaggactacacgtcctcaccttgcagaggactacacgtcttgccttcagagggctacacgcctcaccttcaaaggactacacccctcgccttcagagggctacacaccctcaccttcagaggctacacgtccttgccttcagagggctacacgtcctcaccttcgaggacttcccgtgctaccgcccttaccttcagaggactacacgtccccgccttcagagggctacacgtcctctccttcagaggactacacgtcctcacctttag

SEQ ID NO: 42528 - DNA, 369 bp, Glycine max
  Peptide Sequence Number=SeqID_134213
atggctaaagagcaacctaaccagtgtgaccttggaaatcactcaaatccatactcacacttggaaacgtatattgagatttgtaatactgtcaagcttgtcagtgtacctgaagatgctattaagcttagtctgttttcattttctttatctggggaggccaagagatggttgtgttcattcaagggcaacaatttaaagacctgggatgaggttgttgagaagtttctaaaagaatatttcctagaatctaaaactggagagggaaaagtttcaaagcagttactcgacgcttttgcgggaggaaaaattaagttgaagacacctgaagaagccatggtgttgttggatcaagtggcctcagaataa

SEQ ID NO: 42529 - DNA, 555 bp, Glycine max
  Peptide Sequence Number=SeqID_134214
atgaagcacttcactgacaccctcatcagtgccaacatagtaagccagtatacactccggctagcgcccaatacgcaaaccgcctctccccgcgcgttggccgattcattaatgcagctggcacgacagactcttgcttttattcgctcttatccaaacgctgtcaaactgcttttaaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42530 - DNA, 654 bp, Glycine max
  Peptide Sequence Number=SeqID_134215
gtgcaggcccttaggacagaactcgagcaagcccaaacagtcaaagaaaggttcaaatcggcagctcttaaaatccgaaaggagaatgccgaactgagagatataaatacagctaccaccaaagccttggaacaagaaaccaagagagctcatagggaagagcacggccggaacaagttccgaagggctctgtggggcagtaacaacgagcttaaactccggagagaggaaagggaccaatcacgagtagacaatttcatcttgaaggatgagttgaaggcttgctcgaggtccaagagaagtttgtctcagcggttatgcgagacagagaccaacatgttagccatcatcaacaagtaccaagaagaactaaatctagccacggcccacgagcatagagtggcagacgagtatgcccaagtgtacgtggaaaaggaggctagaggaagggtgatcgactcgttacatcaagaggcaacgatgtggatggaccgatttgcttttaccttgaacgagagtcaagaacttccccgtttgctagccaaggccaaggcaatggcggacacctactccgcccccgaggagatccacggacttctcggctattgtcaacatatgatagatctaatggcccatataattagaaaccgctag

SEQ ID NO: 42531 - DNA, 423 bp, Glycine max
  Peptide Sequence Number=SeqID_134216
atgttgctacttagcaacattctgcccagcgaccggagaagtccaacagggccctggggtttccagctctggttgcgggcctttgtcagtcctacaggggatcgcgcccgcaagacacccagtggacctggaaaagtccaacagggtcctggggtttccagctctgattatgagcctctaacagtcctacagggtgcccgtccccacagttgggatcacgcccgcaagacacccagtggacccggagaagtccaacagggtcctagggtttctagctctgattaccggcctttgtcatcaggccccccactaaccgagctttcatcaagaagtattgcgcccccaggcaggcgtagggcgagacaccacaacagcctggggatggccgacagcgggctacaaacacaccgccaccacatctag

SEQ ID NO: 42532 - DNA, 429 bp, Glycine max
  Peptide Sequence Number=SeqID_134217
atgcatagatctcccacaggaaatttagttcctctggtcttagaaattgaagctacattgcgaaggaatagggccgagaggagaaggaaacttttgcaagacagaataattgcattcattcttgaggaagagactcatttctctaatttattatcacctgattcaccatcatcaagggaaccgccactcaattacctgaagtcattaccatggcagaagagcatgaccaaaggattacccttgaggattactcaagggaacttatttcaaggattacctaatgaagacccctatgcacacttggcaacattcattgaaatatgcaacactgttaagatttccggtgtaccagatgaagctattaggctcaaccttttctcattctcattggcagccatcatcaagggaatccgccactcaattacctga

SEQ ID NO: 42533 - DNA, 463 bp, Glycine max
  Peptide Sequence Number=SeqID_134218
tgtctactatgagaaactagtaggttacatgccgtccagcttcgcggacctagtgtttgccggggaaagaatcgtggaaggcaagacgatgcccatattgcttctcttccgccggtgcaaacccgagccagcctccccatcaatacatcagcccgagcttctcagctcacaccgaagacccttagttcagactatgcacctaagggatgtcgagttctatcccccacccagagggaagctcgccccagcacgttgtcagcccaactccaaacacaaccatccgccccccgacaattcgaagaataggaggaagctatcctccttgaggttcagagatcaccccactcccaatgaggcctcaaagtaccggacttccaagtataaagggacaacccttgtcccaagaaccactcaacgcatgtactgtcgcaagtaccatggggtgcccggcattccactctaa

SEQ ID NO: 42534 - DNA, 600 bp, Glycine max
  Peptide Sequence Number=SeqID_134219
atggcctccaggaaatgtaagagcattggggcaaggccaactgctcaatatgatactagacggttccattcgcttgatgcttggaaccgttatacagataatgtcttggggaagaatattttgccagaaagaaaggttgaggtataccacacggagtttgacaacttcaagacaaagttggagaggcgtaatcttcacaaacgcctcaccaacttggctgatgggactattgatcttgctttggtgaaggaattttatgctaatctctatagctctgaggggagggggttcatcttgaacgctgagggccatcctgggaggattctcaagaaagatttgactacattagcccaggtgtggagtgttctcttatactccaacctggcccccacatctcacacctctgacctgatagtggatagagctaggctgatctttggcttaatctctcacatggagatgaacataggagcgctcatttctggccagatgacttctatagcccagtctaactcttctagacttgggtttcctactctgatcaccgccctatgtcgagccagaggggttgtcttgacagcctcacttttgagcgcctga

SEQ ID NO: 42535 - DNA, 541 bp, Glycine max
  Peptide Sequence Number=SeqID_134220
tgtatccaaatgatgatgatgaccaacatgatgtcagacttgaagatgaggacgaggtggattcggaggaatgcataagtattgatagcatgatagatattagacaatttgacatggaagaaattaccgatgaagttgtccgcaggttggattttggtgatttggagttagcgtatcagttctattgttggtatgctaaaagagagtttcaacatcagatagaaggatgcagcgagaaaaaaaagaaagcaggtgtggttgtgaagcaatgttttgtgttcatgtgcatttttgtacaggacgatggacataggaagatgttcgcatttgatattatgcaagttgaaaactatagaaaagttgggattagacctccacacatgcatgcaacatttgccaatcaatgtggtggatatgacaaggtgtggtttattaggaaagatatttacaatgaagaagggcgcatgagaaagcaacatacttcagatggaagtggtgcattgaagtatttacatgatttacgcaagaaagatccaatgat

SEQ ID NO: 42536 - DNA, 240 bp, Glycine max
  Peptide Sequence Number=SeqID_134221
atgacaatagaaaagaaaccccttaaggctagtatgcaaaagactagctccataaagtgctttaaatgtcttggaagagggcacattaattctcaatgccccaccaagaaaaccatgattatgaggggccaagacatttatagtagtcaagaagaggctactacttcaccttcctctagtgaaagtgcagaagcacatggggaagaatctagtgaagaaatctacccccaagaagaatga

SEQ ID NO: 42537 - DNA, 420 bp, Glycine max
  Peptide Sequence Number=SeqID_134222
atgcgagcggagaattctgatatctatggattcctcgagccacagtccattcagaggtctgggcaatcacagtttgagtttgaaagttacataaagacttggatgcagagttcaaaacgcgatgtctatcttggagcctacctaaatggtggacactggcagatggtggtcatcctgcccaaggaacacctagttgtctggttttgttcattgcataacatgtcagacaactaccttaaggggattattaacattgctttaaaaggtcttgatgatactccacagcctaaatcaaaggctcctgctaggtggattgtcgtcaagtattttaacgatcctagaccattggagccagagagattaaaggcgttgcggatccagtggacacagtattatctccgagttagagatcaaacctag

SEQ ID NO: 42538 - DNA, 258 bp, Glycine max
  Peptide Sequence Number=SeqID_134223
atgaagtcgcaccaagaagaaatgaaaatcgtaaacttgggtgttagcaaggaaaggaaaaaggtaaaggttggtacagcaagatatgcccagtttgaaccccaacattgtacaacatcgattgctgttgaatctcgattgttccctatggctcgataccccgaatggatggccaatattgtgctggcccctaagaaggatgggaagataaagatggcgccggaggacatggagaaaactatgttcgtcaccttgtag

SEQ ID NO: 42539 - DNA, 270 bp, Glycine max
  Peptide Sequence Number=SeqID_134224
atgcatattgttgtggtgaaacaggggcaggatcatcttgagctaccttctggggtagagacaaaacatgagcagcagaaaccaatcaaggtacacaggaacggatgcaggtggggatggggtcacgaccgactgatcgtcgcccctttctccacgctaagcaagcggaaaacgtcgctgcaaggcagccccgtatcctttgtattcgcagttttcttttactttttgtttgttttaaaaataagtaatcaatgcctaactctaacttaa

SEQ ID NO: 42540 - DNA, 423 bp, Glycine max
  Peptide Sequence Number=SeqID_134225
atgatccctactcatgatgtggttctgtattacaacggaaggtggaacatgccatgccaaaacaactttgtaggttacacgttcacaggaaaaaatccccaaaaatttgatattccaaaaggatgtaccataaatgaactgaagtatttgatcaagcaagtagaacctaaagggaatcctcctcatgggattcatgaatcccaacttgtaaggcgtttgttttttcgacaacctgctcatttggagtattctaacaacgttttaaaatttgaaattattgagctaaaatctgacgacgacgtgttgaaggtgttggtagagtccaattactggaaacaatttgtgccaatagaaattttggctctctttagtaaaccggttatggaaaatgaggacgaggtcgttacgccgttgcaggattga

SEQ ID NO: 42541 - DNA, 384 bp, Glycine max
  Peptide Sequence Number=SeqID_134226
atgaatgacttagtttatgtcatgtacaacttgaagctcaaaagtagacaaacaagaaaaacagttgctcttgcatttgaagatatggaatctgatgatgagtggataacagaagagggagatgatatatttgatgaagacaatttccaagttgagcaagagcaacctttaggggaaagtggtagcggaagtaatgttgatttggttggaggaagtttaactgatccaactttggatgcatttgatattgacaatatggtattgaatgacaatgttgaagatcatttctcaactgaggaagagctagaagatgatggagatgaaaatgatggtggtggtggtgatattggagatgattttattagaggattgatggacatttga

SEQ ID NO: 42542 - DNA, 912 bp, Glycine max
  Peptide Sequence Number=SeqID_134227
atgcccgcatcgcaggcgacgatgattttgcgcacggtgctcagatcgccgtcgaccgatgccggcgccgccgcgccgcctttggactgcgatttcatctcttgcatgcgacgggtcgcggcttccagatcgtcatcctctttcaccttggaggtttttcagcaggaaagcggacaccacgaaggagacggcaaaggctgcgcacaccgccgcaatgttggcgaagtaggcgcctttcggggtcatcgccagcactgccaggatcgaacccggagaagccggagaaaccaggccgccgttcagcatcgtcagggtgaagacgccggtcatgccccccaggatcaccgccagcagcaggcgtgggttcatcagcacgtaagggaagtagatttcgtggatgccacccaggaagtgaatgattgccgcaccgccggcggattgcttggcgctgccgcgaccgaagaacatgtaggccatcagtacgcccatgcccgggcctgggttggcttcgatcaggaagaataccgacttgccgacttccgtggcctgctggatacccagcggcgagaagatgccgtggttgatggcgttgttcaggaacaggattttcgccggttcaacgaagatggacgccagtggcagcaggttgttcttcaccatcagaagttaacgcctgccgccagaattttggacagcacttcaaccgcagggccaatgccgaggaacgccagaatggcgaggatcatcccgatgatgcccgcagagaagttgttcaccagcatttcgaagccggatttgatcttaccatcaacccagacgtcgaatttcttaatcgcccagccgcccagaggaccggcaatcatcgcaccgaggaacatcggcatatctgcaccgacgataacacccatggtt

SEQ ID NO: 42543 - DNA, 255 bp, Glycine max
  Peptide Sequence Number=SeqID_134228
atgcagaacagcggggtcaccctaagggctgaatctcaacactttgcaagtgtcaatgacgccaatccctgtgtagcttccatcccttactttgggttcattgatgaaatttgggagcttaactatgtgaaattcacgagacagaggtcaccaaagcaaatggcatccttaggacttcatacagctcatgtttgtcgccagtttcatcatccaccacccttacattctctggcttctcatgtttattgttgttaa

SEQ ID NO: 42544 - DNA, 171 bp, Glycine max
  Peptide Sequence Number=SeqID_134229
atgagatttcttacaatccaaaccataagcccaaatgagaagttcatttttatggggaatgaagtgaaagctccagtggaaatagttgagacttattgtttaaaacgcaacactggacatcgtttagatttactggaaactccttatatacctagtttatctaggaattga

SEQ ID NO: 42545 - DNA, 213 bp, Glycine max
  Peptide Sequence Number=SeqID_134230
atggcacgctgcatgcttgcttcatgcccctattttagggacccatatgggagagagttaaaagggcttttaacgataattcccaaggtggtcatatctctcttgatggtctctagaggtatcatcccctttgaagaacatattgcagcagtagggactactagcaacaatatgttgtcaaagagaaaaactctagatgagggttcactgtaa

SEQ ID NO: 42546 - DNA, 243 bp, Glycine max
  Peptide Sequence Number=SeqID_134231
atggccttcaagcacaaggtgcaaagcttgattgccgcaggatggctgacgtttcaagaggacagtccaaatgtgaggactaatccactcaccagtcatggaggctcggtggttaatgcagtagaaaagtgggagccttggggacggaagcagatgagagacatgctaacctctaggaggggcatcacacgatgtggagacgtgcccaatggaggaagagttgctataagggatgatggataa

SEQ ID NO: 42547 - DNA, 159 bp, Glycine max
  Peptide Sequence Number=SeqID_134232
cgtgttagcagctcaatagtgaatgactttttcttgggagaccccattgttccttcttccgaggacagggatggaaattctcatcctgggtcaaggtttatggtggactggtggtttgaggtcttgggtcaaaaggcttgcagaatagccagacatgat

SEQ ID NO: 42548 - DNA, 330 bp, Glycine max
  Peptide Sequence Number=SeqID_134233
atgttggttcctaagttgtggttctttcttgttggaggtttgaaaacaaaaggttcccaacaaaacactcactatcctaaggaaaaattgcctaaaattattacacgcaaatggaagtttggtaacctattggaggctcccaacacacttccaatgaaaggcctttttgttacaaaacttgaaagcaatgaagtgcttcttagtccaatagctcttaaggtggttggcccctttcttcttgattcaaattcttcaagggatgacaccaatccttcttccaattccctatatggcaacccacaaccaaggaaacaaagagacaagcaataa

SEQ ID NO: 42549 - DNA, 121 bp, Glycine max
  Peptide Sequence Number=SeqID_134234
cgctgttcatgtgtcctccaccatcgagtctggagccccgctttcataccctaatttcgtccggggacctttggttgatgacatgcgacctttctttggtccttgtggtgggatcctctag

SEQ ID NO: 42550 - DNA, 417 bp, Glycine max
  Peptide Sequence Number=SeqID_134235
tcacatgaagaggtcaaacgatttcgattcaaagtcattcctaattgggatgatattgttgacctatgtgcaaaggatagagctactggactcggagcagaaaatgcattagatgcagatgatatcatgagcaaagaaacaaatgaagaggaaaaagaagggatgatttcctcaatgaaagaagtagccgagtcattgaaagaatttgttgaagtgacaaagaagaagatggagataaaagaagctcaagaagtggtacatgaagtggtgagtgagctagataatatacctaattttaatggtgcacttagacatagagcaattgattggttgacagaaaatcccattaagtttgcgattataaaagctcttccattggatgagaaagaggattacatcttatcttttatgccttaa

SEQ ID NO: 42551 - DNA, 231 bp, Glycine max
  Peptide Sequence Number=SeqID_134236
atggggtcgtttttgaagtatttccacgaggggactcttttggacgtaaaacgcatgcatgtagcacccaaaccgccagtggaactggtgagtttggtctccgtgaagaaatcgccagtgctaatggcgatatacgtgccagtgggaaccgccagtcaaactggcgagttccaggtggcaggttgcttttttcagatgacaggccaaaaggcaagttgctactgccattga

SEQ ID NO: 42552 - DNA, 204 bp, Glycine max
  Peptide Sequence Number=SeqID_134237
aagagactcttgttaatgttgcaatgtcggcttcccaatttggaggggagtgtgcttattgcaactctttggctgttgaagagagtgaatatgcttttatggatgttattgaatctaattctcttgaaattggttctactaatgttgattcagattcctctgaaatggaacttgacatgggtgatgagatgactacactttcaa

SEQ ID NO: 42553 - DNA, 273 bp, Glycine max
  Peptide Sequence Number=SeqID_134238
atggtcataacttttcacccagaagtccgattcggggacataatatatcgacgctcgaaatttaataacgaggaagctcgtccagaaactttcactcggacatccaattcagagcgcataacatatcgagacgctcggaaattgggcaaaggaaactcatcgagaaattcaaatggtcataacttttctaactcgggatgtccgattcagggaaataatttcaagacgctcaaaattgaaacaacggatgctctcgagaaattcaaatggtaa

SEQ ID NO: 42554 - DNA, 699 bp, Glycine max
  Peptide Sequence Number=SeqID_134239
tgctggatttacgagcactttccctcagttgcggagtccaccgctgatcaggactacgatgaggcttatccgcgtgcgtgcaggtggattgcgacgaagaagaccgtgaagagcattcgcacgccgtcgtacagggagcgcctggactggctccagattccggatgtctattggatcccgtatggggagcatccggaggtccaggacttccacgtcagatcatgctactccggtcccttgtgctgggggcctgttgctgtgtattaccgaccggagagggtcgtgcggcagtttggttacacgcagaccattcctgctcctcctgtcgattcatgggtctcgtatgatgatatacacgacaggtggatgcactacgaggatcatatcttacctggaggtgaggtgtgcgtggtgccaggggcgtgttccagtgactacatcgactggttcttccgcatctcccatcctttcatgacaccaggccacgcagtagatcctctgcctcatggtcacgccccgcagccccgagtcgtccctcaggccccgcagacggatatccctcgcgtgccggagctaggagcatcgtcgacatctgcggaggagcccaaatatgcagtggaagtttgtgatgacattgttgagaggttggagcgccatctgagtctaggggtggtcacgtctggctcatcgacacatgag

SEQ ID NO: 42555 - DNA, 177 bp, Glycine max
  Peptide Sequence Number=SeqID_134240
atggtaggagctggtgacaatggtggtgtatatcatcaactggatggatctcagcacttattactggacgcgatgactacacaaatgcaacgtttgttgaatcgtaacaaagaagagctctacaggcgaatagtcaaatcttccttgtttactcttaaacctctatcccttagagaa

SEQ ID NO: 42556 - DNA, 378 bp, Glycine max
  Peptide Sequence Number=SeqID_134241
atggccacaatgatggaggtcatgatgagcgtgaagaggataatggaagccaatgcggttgcaattgccgctaccagcgttgttgctaaggtgaacccgacgtccccatccggcctcaagcaaatgaatcatccaacctcaaatatggtaggcaaagattcgggaattccccaccacaatctagccgacttcgagccttgcctcggatatgccacggaagggaaagcagttggtggtatacccctacaaaaccctttggaaggccctcagtatcacccacaactgcacctcttgcattccgcagcggttaaaaaccctcatgactatggcaggaatgggaaagttggatcatctagaggaaagactcagggccattga

SEQ ID NO: 42557 - DNA, 384 bp, Glycine max
  Peptide Sequence Number=SeqID_134242
aggactacacgtcctcgccttgagagggactacgcgtcctcaccatcagagggctgcacgccctcaccatcagaggactacacgtcctcgccttgaggacacgccctcatcttgggtactagttaccctcaccattgagaggactacacgtcctcgccttgagaggactacacgactacacgtcctcgccaacagagggctgcacgccctcacctccagaggactacatgtcctcgccttgagagggctacacgccctcaccttgggtactagttaccctcgccttgggaggactacacgtcctcgccaacagagggctgcacgccctcaccttcagaggactacatgtcctcgccttgagagggctacacgccctcaccttgg

SEQ ID NO: 42558 - DNA, 702 bp, Glycine max
  Peptide Sequence Number=SeqID_134243
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccgaacgtgactatcatatcctcgtccgatccctagtcggcatcgtttacggtcaagactacgacgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42559 - DNA, 111 bp, Glycine max
  Peptide Sequence Number=SeqID_134244
atgaggtttatgttgcctgaagacctagggaatgtgaatcccgggcatgaatttatgttgaccttgttggatatccctggtgggggaaatagggtggttaaagagttttaa

SEQ ID NO: 42560 - DNA, 481 bp, Glycine max
  Peptide Sequence Number=SeqID_134245
gagcaaaagcctcgcttttgtcgaccacactgctttctgttaccatgacccaagagctggtagcctgcggagacaccttacggttatccgcacctcgagtgtgattgataagcgaaggccaatatggtcatctgcaccctttccgaagatgatacgtaggagcaagagccttgcttttgtcggccgccccataatctttgtcatactgaccctgagaggcggcgggcccgatgacacgcggagaaaaatacttacagttcgcacccttttgtcatccagaggcggcggcccgatgatcacgcggagataccttacggttatccgcacccttttgtcatccagaggcggcaggcccgatgacaacgcagagacaaaatttggtcattctgcacccttgtgtcatccagaggcggcggagcccgatgatacgcagagataccttacggattatccgcacccttgtgtcatccagaggcggcgg

SEQ ID NO: 42561 - DNA, 898 bp, Glycine max
  Peptide Sequence Number=SeqID_134246
agggctacacgtcctcgccttcagaggactacacgtcctttccttcagaggactacacgtcctcgtctttagaggactggacgtccttctcttcagagggctgcatgccctctccttcagaggactacacgtcctcgcttttagaggactgcacgtcctcgccatcagaggactacatgtcctcgccttcagaggactgcacctccttgcctttagagggctacacaccctcaccttagaggactacgcgtcctcgccttcaaaggactgcacatcctcgccttcacaggacatcacagggctacacgtcctcaccttcagggggctacacattcccaccttaagagaactagacgtcctcaccatcagaggactacatgtcctcgcctttagagggctacacgcccccacctttagagggctgcacgccctcaccttcagaggactgcacgtcctcacattcagagtactgcacgccctcgccttcagaggactacttgtcctcaccttcagagggctgcacgccctctcctttagaggactagatgtccttgccttcagagggctacacgtcctcaccttcaatgggctacacgttctcaccttcagaggactagacgtcctcgccttcagagggttacacgtcctcaccttcaatgggctacacgttctaaccttcagaggactagacgtcctcgccttcggagggctacacgccctccccttcagaggactacatgtcctcgccttcagagggctacacgtcctcacctttaggaggctacacgttctcaccttcagaggactagacgtcctcaccttcagtgggctacacgccctcgcccttcagaggactacacgtcctctccttcagaggactacacgtcctcgcttttag

SEQ ID NO: 42562 - DNA, 783 bp, Glycine max
  Peptide Sequence Number=SeqID_134247
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 42563 - DNA, 402 bp, Glycine max
  Peptide Sequence Number=SeqID_134248
atggatgagtttgatgcacaagtggcctggacaggagcccatccttctccttttggaggggatgaggcctcaatagcccaggagcctgaatcagaggagccaacagcagcagcaaagggggaggataagctcaccccttttgagcctttttattttgatgcaggtatacacatggctcaagaggaggagacttccactgaccagatcccagagccatccgcagcacccatacctgatgatgtcataccatctgcaccagcatctgagttagagcagcctatctctcaggattcaccagttgctcagccattagaagagaatgagcgtgtgattgtaattatgaatgaaaatgttagtcagtttgccagattgattgtgaaggaatgcattgaccgtatcccg

SEQ ID NO: 42564 - DNA, 447 bp, Glycine max
  Peptide Sequence Number=SeqID_134249
atgaagcacttcactgacaccctcatcagtgccaacatagtgattcgcccacctcggcctcccaaagtgctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42565 - DNA, 264 bp, Glycine max
  Peptide Sequence Number=SeqID_134250
atgagacaacgcggccataacagcggaatgacaccggtaaaccgaaaggcaggaacaggagagcgcacgagggagccgccagggggaaacgcctggtatctttatagtctgtcggggggggcagagcctatggaaaaacggctttgccgcggccctctcacttccctgttaagtatcttcctggcatcttccaggaaatctccgcccgttcgtaagccatttccgctcgccgcagtcgaacgaccgagcgtagcgagtcagtga

SEQ ID NO: 42566 - DNA, 288 bp, Glycine max
  Peptide Sequence Number=SeqID_134251
atgtcattaccaactggtagatcaaagatggtcaaggacaacaatgataaacctgtcatggccacacctttcaaaacaaaggatgtcaatgaggaaataaccccgaaggatattaggagcctaatggaacaagctaattacaccaacaaataccttcaggtgttaggggaatctattagtaaagaaaaggtttttactaaacccaaggaccacgagtcgtcatcatcaccctttcaaatgaaaaaacctttattcaaaccttttaaggttagcaaaaaagccaaatag

SEQ ID NO: 42567 - DNA, 288 bp, Glycine max
  Peptide Sequence Number=SeqID_134252
atggtgaaagttggaacctcttacgtgccgatcaacgtctcattttcgccaaaagttggcccagggcttcccggtatcaacagggacaccaggatttattttttctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 42568 - DNA, 168 bp, Glycine max
  Peptide Sequence Number=SeqID_134253
cgccttcaaaggttattttgatgatgccaaagaattcaagaatcaagagaaagattcaagagaagtttcaagtttcaagttttcaagaatcaagaataatcaagaacaagattcaagactcaagattcaagaatcaagagaaaacttaatcaagataagtatgaaaag

SEQ ID NO: 42569 - DNA, 534 bp, Glycine max
  Peptide Sequence Number=SeqID_134254
atgcgctcgtgggtaaggggtcagtggattcccttcgatgcaaatgccctcagccaattcctgggcgacccactaattttggaggatggccagcaatgtgagttcagccagaggaggaactgggtcgatggtttcgatgagaaagccattgcccagctgttgtgcataccggggcaggattttgcctggaccgctgcagggtggcgggtgcagatcatgcgcaccagcatgaccactctgacccagacatggaagacactgctgctcaacaatgtcttgcctagcgatcacaactccgacctccctttgcctaagtgccagttggtgcaccctctggaccaaaataagtccaacagggccctggggtttccggcgctgatcacaggcctctgccagtcctacggagttcccgtcacccacagtaaggtaatccgactgccgatcacccgagccttcatcgagaagtattgcacacctaggcaggcacagggtgacacacatcaagccgcaggcgcaccgccaccacctcggtag

SEQ ID NO: 42570 - DNA, 306 bp, Glycine max
  Peptide Sequence Number=SeqID_134255
atgaattttccaacaaagaggcctatagaattcaccctaattccggtgtcatatgctgacttactcccatatctactcaataatgcaatggtagccataaccccatccaaggttcctcaacctccatttttccgaggagacaactcgaatgcaacatgtgcctatcatggaggagtttcgggacattccattgagcattatatgactatgaaacataaggtgcaagtgacttgcacttctgagtttatctctgagtctgttcaattagaaattgctcgttctgcacgtttggtcgaggtgccgtaa

SEQ ID NO: 42571 - DNA, 201 bp, Glycine max
  Peptide Sequence Number=SeqID_134256
atgactacagatcaaactccaatccttattgatgcaatcctacccgcaagggcattggataaaagactccaagaagattgggccagagatgcaagagaaggccctagggttctcatgagccttaagggctccataatatgggtaaggtaccctagaaatgtaggatttttttgcccttgtattttagggcacctagactag

SEQ ID NO: 42572 - DNA, 255 bp, Glycine max
  Peptide Sequence Number=SeqID_134257
atggcctctgtggagacttctaccatggctaggtcccagattttaccagaagggatcaagatagaacccgtgcatgatgcatatgcaaaaggcagtgtgacaattgtcgcaacctacccttcggcgggagggcgacgcatgactcgcgggatgcgtgttccacgaaaggaatacgcgcggagtcgccaccaacgtttatttgaggaaaacgtcggaaaaaccggaaaagacgcgatctacgaactttttaagtga

SEQ ID NO: 42573 - DNA, 405 bp, Glycine max
  Peptide Sequence Number=SeqID_134258
atggaggccacgaaagagcaaatgaccgcaatgatggaggccatgatgagcgagaagaagataatggaagccaatgcggttgcaattgccgctaccagcgttgttgctaaggtgaacctgatgtccccatccggcatcaaccaaatgaatcatccaacctcagatatggtaggcaaagatttgggaagtagggacgacccctatgatgtgcaaaatcaaaacaagcacgccttcccgccatatggcctgcctcccaactatacgccacccaatgtgttgtacactcccaataagaatgtcaataactccactcctatacccattgagagccaacaacccgaaactatcatgcacttgtctcttaaacggtggggaagacacatgaaattcctcaccacaatctag

SEQ ID NO: 42574 - DNA, 383 bp, Glycine max
  Peptide Sequence Number=SeqID_134259
atggacatttccttccccacatacctcgggaagagaatgaaatgggatacactagccacccgggcaccatgtttcaacttgccccacacgggagatctgcgtacatcggaattcaaatctcaaggcaggccagcatattgttatgcaatagaggaagagcgggatagaggaaaccgtggtattttgacatcaagcagtattggaacaagaatacccaccagggatttcgacaaagatgacaaggatgtccacgagggttccttctcagaggatcaggcatgcctagaagagtcagaatgggctcagcacactacgaccaacttaaccttattgaagggggatcctcgtgctgaagaagatcacgctgttatgataatcggcaa

SEQ ID NO: 42575 - DNA, 905 bp, Glycine max
  Peptide Sequence Number=SeqID_134260
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccaccaccaccacgatcaagccaactactactactaccaccaccactactactactgtcgagccaattaccactactgccgagccgattaccactgccgaaacagccaccactgtcgaaacggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42576 - DNA, 432 bp, Glycine max
  Peptide Sequence Number=SeqID_134261
atgtgtcctcctccagaaaaggtcaacaacaaaggtgatcaaaagaaatcgatgaccaaacatcaaagatcaacaaagtgtgatccatcatactgggataattcttcagtcaaacatagtgcatcatcatttgaccaggaaattccaacaaggattatgccgatgttggatcaatttcatccgtgcattcacgattccattgaaaacattgtcgatgtcaaagctgatggtatgggtgaagatttatggtctttggtgtgcaaccattttcttaaagaacttgtcaaatggtctgatgagtatatcaacatcctcggtggcatagacagatttgaggaattaaagaggtccttacttgttgatagattatccacgatatgtttatttaagagactgttgtccattaccacctctaaatttgttatggtctag

SEQ ID NO: 42577 - DNA, 240 bp, Glycine max
  Peptide Sequence Number=SeqID_134262
atgggtaaaaaccttcatgctatgatagaaatgggaaagttggatcatctggaggaaaggctcaaggccattgaaggaggcgaagattatgcctttgctaacctagaagagttgttcctagtacccgaacatggtcattcccaagggactacttgccccaagaaccatctaaagatgtattgtcggaagatgggggtatacgcaaaagatgaggaactacggatacatttcttccaataa

SEQ ID NO: 42578 - DNA, 495 bp, Glycine max
  Peptide Sequence Number=SeqID_134263
atgtcatttcctagtgctgttcatgtgtcctccaccttcgagtctggagccccgcgaatgtcattgcctagcgctgttcgccaattctccattctccacttttattcggagacccatgaatgtcattgcctagcgctgttcatgcaccttccaccaacgagtctggagccccacgaatgtcattgcctagcgctgttcgccaattctccattctccaccttttattcggagacccatgaatgtcattgcctagcgtcgttcatgtgtcctccattatcaagcgcggagcctctgaagaaaaaagaaggagtagagatgagagtcgtcatcacggaaagggcaggacggacgaaatcagtgtcttatctttgctttcctcttatctccgatgagagatacttggcaccctttgttgcacaatatgtgaagtcccgaggcgtgccgaaaatcaaaaggaagcaggcttacgcgatccgtaaaaattccgtaatgtga

SEQ ID NO: 42579 - DNA, 75 bp, Glycine max
  Peptide Sequence Number=SeqID_134264
gacatgatctctaagaagatgatgcctaatttctatgtgcttggttctagagtggaggattgggttcttagatag

SEQ ID NO: 42580 - DNA, 1068 bp, Glycine max
  Peptide Sequence Number=SeqID_134265
atgtctcctttccttgtgagggatttcggcgcacaaaattccaagactatacaaagaatccataaggcatgggaaaccacgttaaggaaagatcaagagcttagaggcattcgtaatggcatcattggtgggtaccacaaatggctgaaagttcatatacgaggtttagattggctcgccaagttaaaagtcgtcagcgaagagagttttgaagcaccggaagaggacgaagaagtccaagctctcaaaagcgagttaggaaaggcaaaacttgccaaggagaagttcaagttggccgctacacacgttcggaaggagtgtgccaggttacgggaaaagaatgcaattaccgcaagagcccttgaacaagagaccaagagggctcgcaaggaagagtatggccggaacaaatttcgcggagctctatggggtagcaatagtgaactcaagttgcgaagggaagaaagagaccagtcgcgagcacatagcatggttctgaaagaggagttaattgcttgttcgaggtccaaaagaagcttgtctcagcgtttatgcgagacggagaccaacatgctagctatcatcgctaagtaccaagaagagttaggtctagccacggcccacgagcatagaatcgcggacgagtatgctcaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcagacacctactccacccccgaagagattcatgggcttctcggctattggaaaaacaccataactaaacgcgccgcaaggtatccctatcgcaccagatccaaatctagaacgatgggtgatcaagaggagacgcaggaacaggtgaaagccgacatgttggctttgaaagaacaaatggcctccatgatggaggccatgttaagtatgaagcagctcatagagaagaacgcggccaccgccgccgctgtcagttcggctgcggggatcctctag

SEQ ID NO: 42581 - DNA, 123 bp, Glycine max
  Peptide Sequence Number=SeqID_134266
atggcctttgtggataactgggtagtgggtaaggaggaggaatggcagtcattgcatgggtttctccctcatcctcacccttttcatttgccccagtttttctcattcgtccaagcaggatga

SEQ ID NO: 42582 - DNA, 439 bp, Glycine max
  Peptide Sequence Number=SeqID_134267
gcagttgtgtctctggaaaaaccaccacaaaagccctattcggaggtcgatgacccgctttatctgatgacattgaccatcccagagcttttcttgaggccttatcaggttacatgggatgccaccgtgtttggggtctttaatccatatttcccgctttacataaagcacgaagacctctacgaaatcacacacggtggtcaatgtctcagcatatcagtgttacagccagacaactaccttaaggggataattaacagtgtgtcgcaacctacccttttgcaggcgagcgaggcgaggctcacgggtgcgtctcccaaaggaggaaaatgcgcggagtcgccaccaatgtttatttgtggaaaacgtcagaaaaaccgaaggaaactggtcatgaagattattctagattcgggagttgtatttatgtttgaggaag

SEQ ID NO: 42583 - DNA, 411 bp, Glycine max
  Peptide Sequence Number=SeqID_134268
atggtagttagaatttactttctctggatttggttaactgctattctgtttagtgcttcttgtatgcgaggtaactctttagcagaagccacttgcaggagaaacaacgcagagagaaggagaaattttttgcaagaaaggacagtacaaccaagtttggaggaagctcaatcatctgagtcatcttcagcattcccagagttaagagaatccgaagtaggtgcatccaaagctcatatcatggctgaagatcaaccatggagggtaactcttgaagattattctagctcgaccgtgccgcaattctttacaagcattgcacgaccgaaggtgcaagctcacaatatcacttatcctcattccttgattaagctgattcaaggaaatctgtttcatggtttgccaaattaa

SEQ ID NO: 42584 - DNA, 375 bp, Glycine max
  Peptide Sequence Number=SeqID_134269
atgttcctccagaaggcggttgcttctggaggaagcaacttggctcgcctgggcgagctaggtggcaagctcctcccctattttcctataaatagggggaggaatgaaggagaaaggagttcagccctcctgccgaggcgcttccgtaacgtttccgtgggtgatttcgcgaagattttcaaccgttcttcgtcgttcgtcattcgttcttcgtcattctttggttttcaaccggctaaaatcaactcgcaaagtcaagctcgtccgcaaaaaatcactaaaaaggattttaaggttcaatgcctcagattttctcaccaagtaaaaatggatcattttaaggtccaacgccttaaaaggccaccttccaagtaa

SEQ ID NO: 42585 - DNA, 408 bp, Glycine max
  Peptide Sequence Number=SeqID_134270
atgaaaaaacaagttttgatatcaggtgcaagtttcgccggattaactttggcttattggttaaataaatatggttatgaggtaactgtcgtagaaataggtaaaggtcttcggaaaggaggttcacccatcgatgtccggggtaaagcactggatgtggtacaagaaatgggaatattacaaaaaattaaggaccgtgagtttatccataccgatgaaatcgtggatgctaaaggcgacacattgagtcgtttttcaataaatgcaatggaagaatatcttggtgatattgaaatccaccgcagtgacctggtagaacttatttttgatattgtccctaagaatgaggtagaatttattttcggaaacagcataaagacattagtccaacatgaagatcgtgttgag

SEQ ID NO: 42586 - DNA, 1736 bp, Glycine max
  Peptide Sequence Number=SeqID_134271
tatttggagttgaagacgttgaggcctttattctccatcgcgcccatgttgaagaaatccaccgcgacgatcataaagatatcgaggtcatattcgagaccgaaacgctcttcgtcccacttcatgctggctttgagcgaggtcatcgcccagtccgcgcggtccaggttgccgcgatcgacaaaaatttccagcgccacgttacggccggaacgagtggtaaagctgtcacgcaacacatcgaaatcgccggcgaccagcgcaaacaggtagcagggtttcgggaacggatcctgccatttcacccagtgacgcccatcctcgtgctgaccgctcgccagcttgttaccgttggacagcaggtacggatagctagccgcgtcggcgatcagggtggtggtgaagcgcgccagcacgtccgggcgatcgagataccaggtgatatgccggaagccttcggcttcacactgggtgcagagcgcctcgccggatttatacagcccttccagcgcggtgtttttatccggatggatttcattaatgatggtcagggtaaagttgtccggcagctggctgatgatcagtgcgccctgctcttcgcggtagtgcggccacggattgccatccaccgccagcgacagcagggtcagcgcttcaccgtccagacgcagttcagcctgctgcgcgccaaggcgttttacctgactgacggcggtgacgcgcgtggtcgccgcatcaagatcaaacgtcaggtcgatatcggtgatggtgtaatccggcgcccgagtctaagcgggttgcgcccgggttgccacgcacaatgcgtgagttgcgccaaaagtctacaattcattaacaatggcacaaatgaccctcgacctgtcacctgcaattatggtgtgatcgcggtgattactgttttatactcctgcgtctttatgactttgttgataccgggctctgctccgcggaagaggatgctgaaacgcaccatgactggacacgcttccccgattttgaccacgctgcttgataccgatgcctataagcttcacatgcagcaggccgtttatcatcgttactacgatgtcccggtaacggcagaatttcgctgccgcagcgatgagcagctcggccagtatgccgacgccatccgcacgcacattactgccatgcaatctctggcgctgagcgatgacgaatatcgttacctcagcagcttaccgtttttccagcaggattatctcgactggctgcgccagttccgcttcgatgcctcgcaggttgaggtgcgcgacgatcacggacatctgcgcattcagattcgcggcccgtggcgtgaagtgattctgtgggaagtgccgctgctggcgctgatcagcgaagtggtacaccgtcaccggacgccggaaagcggcgcggaacagtcggtggcgcatctgcagcagaagctggtgcacttccgtgagcaggtaggcgatctcgatatgtcgcgcttccagctgatggactttggcacgcggcgtcgttattcgcgcgcggtgcaggaagcgattgtcagcacgctgaaaaacgaattcccgtggctgctgggcaccagtaactacgatctggcgcgccggttgcagcttaacccggtcggaacccaggcacacgaatggttccaggcgcatcagcagatcagcctcggtactggccaacagccagcgcgcggcgctgcaatcgtggctggatga

SEQ ID NO: 42587 - DNA, 842 bp, Glycine max
  Peptide Sequence Number=SeqID_134272
atgagtacggccaaacacagtaagctgctcattctgggctccggcccagccggttataccgcagcggtttatgccgcacgcgccaacctgaacccggttttgattaccggactggaaaaaggcggccagctcaccaccacgactgaagtcgaaaactggccgggcgacccgcacgatctgaccggtccggcgctgatggagcgcatgcaggcgcacgccgagaagttcaacaccgaaatcatcttcgatcacattcacacggtcgatctgcagaaccgtccgttccgtctgaccggcgacagcggcgaatacaccgcggacgcactgatcatcgcgaccggtgcctcagcgcgctacctcggcctgccgtcagaagaggcgttcaaaggcaaaggagtttctgcctgcgccacctgtgatggtttcttctatcgcaaccaaaaagtggcggtgatcggcggcggtaacacggccgttgaagaggcgctctatctggcgaacatcgcctccgaggtgcacctgattcaccgtcgtgacagcttccgcgctgagaaaatcctgattgaccgcctgatggagaaagtgcgcaacggcaatatcgtgctgcacaccgatcgcacgctggatgaagtggtgggcgaccagatgggcgtcaccggcgtacaactctcctcgaccaaaggtgaagctccgctctcgctggaagtggcgggcctgtttgtcgccatcggtcatagcccgaatacggcgattttcgatggccagctggatctggaaaacggctatatcaaagtgcagtccggcctgcagggcaacgccacgcagaccagcgtgccgggcgt

SEQ ID NO: 42588 - DNA, 1051 bp, Glycine max
  Peptide Sequence Number=SeqID_134273
atgtcaacctggtcgcgccccgtcctgctgctgctttgcggcttaatgctgatgacggtgtctattgctgtgcttaatacgctggtgccgcacccacgatcaactgccgacctggcaggtggcatggcgaagctccgttgcttatacaccggcaacttactgggcaccttgctggcgggctggttgattaatcgctatggctttaaccgctgcttttaccttgccagcgtgttgttcgcgctggcaaccatgggcatggtactgctggacggcttttacagctggacgctgctgcgcttcactgcgggcgtaggctgtgcactgatttgggtggtggttgagagtgcactattgtgcagcggtaccgtgcgcaatcgcggtcagctgctggccgcttacatgatcatctactacctcggcaccgttgccggtcagctgctggtgagccgtgtctcgacagagttgctgcatgtcattccctgggtgagcgcgctgatcgtctgtgccgtgctgcccgtggtgtttgtgcaggtcaacgccggtgcggctactgaagaagcttcaaccgggcgtatctggagcatgctgcgccgccgcagttcgcggttaggtatcaacggctgcattatctccggtatcgttctcggttcgctttacggcctgatgccgctttatctttcgcatcagggcatgagcgatgccaccgtgggttactggatggcgctgctggtcagtgccgggattgtcggtcagtggccggtaggacgtcttgccgaccgctttggtcgcctgatggtgctgcgcgtgcaggtgttcgtggtgatactgggtgcgattgctatgctgagcggaacggcaatggcaccggcactgtttgtgctggggctggctggctttacgctttatccggtagcgatgtcctgggcgtgcgctgctgttcagttataccgttggcagtctggtcgggccggggatgaccgcgatgctgatgcagaactattccgatcgcctgctgtttgtgatgattgcggtggtggcgctggtctatctg

SEQ ID NO: 42589 - DNA, 1281 bp, Glycine max
  Peptide Sequence Number=SeqID_134274
atgcaggatcgtaactttgacgatctggcggaaaaattctcgcaaaatatttatggcacccgtaaaggccaggtgcgtcaggcgatcatctgggatgagctgaacgccattctgccgacgctgcccgctggcccgctgacggtgctggatgccggtggtggtgtcggtcagatctccagcggtctggctgcgcaggggcatcaggtattgctgtgcgacctgtcgggcgagatgcttaagctggccgccgcccatgcgcacagcgcaggtgtgagccacaacatgcaattcaaacaaattagcgcgcagcaggttggcgaacatttggataagccggtggatctggtattgtttcacgctgtgcttgagtgggtggcggatccgctggcggtgctgcaggcgctgtggcatacgctgaaacccggtggtgtgctgtcgctgatgttttataacgcgcacggcctgacgttccgcaccctgacgctcggcaatttcggctatctgcgcgccaacatgaacaagcgcaaaaaacgcacgctgtcgccggatttcccccgcgatcctgacgatgtacagcgctggctgacgcagtgcggatttatcaccgagcagcgtgccggtatccgcgtgttcagtgactacatgaagccgcagcccggcgccgggaagagcgttgaggaaattattgagatggaacggcgctactgtcgtcaggagccctttttgagtttagggcgctatatccacacggtccccgaactggtggcatgggcgcgcaagaatgacttttcccttgcgctgccggtagaacgtctggcgtttttgctggccatcgccaccctcaacggggagcgcatggacggcgagatgagtgaaggtgagctgattgacgcctttcgtcacgtcagcaaagcgtttgaacaaacccacgaaaccgttcaggtccgtgctaacaacgccatcaacgacatggtgcgtcagcgcctgcttaaccgttttaccagcgagttgaccgaaggtcacgccatctatcgtctgacgccactggcgatcggcatcaccgactattacatccgccagcgcgaattttccacgctgcgcctgtcgatgcagctgtcgattgtcgcgcaggagctgaagcgcgccgccgacgccgccgaggaagatggcgacgaatttcactggcatcgcaacgtctttgcgccgctgaaatattcggtcgcggaaatcttcgacagcatcgacatgacgcagcgcctgatggacgaacagcagcaggcg

SEQ ID NO: 42590 - DNA, 2817 bp, Glycine max
  Peptide Sequence Number=SeqID_134275
gcaaaagagggcgtggcgcagctcaaccgcatgctgccgtgcgttaacttgttgctgacgactcgctggccgaccgctgtgaagagattcagcgatctgcagcagcacgaacagctgacgtgtgactatcagcaggcgcagcagcagcagcgcgaagcgcgtcagcaggcatttgccctgacagaagtggtgcagcgccgcgcgcacttcagctatgaagatttggctggcatgatgaccggtaacagtgatctcaacgaaaaactgcgccagcgtttggagcaggcggaaggcgaatgcagccgcgcgcgcgaacgcctgcgcgaacatcaggcgcagttgacgcagtattcccaggtgctggcatcgttgaagagttcgtatgacgccaagcgcgacatgctgaaagagttgcagcaggagatgcaggacattggcgtgcacgccgatgccagcgccgaggagcgcgcgcgctgccggcgtgacgaactctacacggcactcagccacaaccgtgcgcgtcgcaatcagctggagaaacagctcaccttctgcgaagccgagatggatagcctgcagaagaaactgcgcaagctggagcgcgattatcacctgatgcgtgagcaggtggtcagcgccaaagcgggctggtgcaccgtgctgcgtctggtgaaagagaacggcgtcgagcgtcgtctgcatcgccgcgaactggcttacctgagcggtgacgagctgcgctcgatgtcggataaagccctcggtgcgctgcgcctggcggttgcggataatgaacacctgcgcgatgtgctgcgcatgtcggaagatccaaaacggccggagcgcaagattcagttctttatcgccgtctatcagcatctgcgtgaacgtatccgtcaggacattattcgtaccgacgatccggttgaagccatcgagcagatggagattgagctgaaccgtctgaccgaagagctgacggcgcgtgagcagacgctggcgatcagttcgcgcagcgcggccaatatcatccgcaaaaccattcagcgcgagcagaaccgcatccgtcagctgaaccagggcttgcaggcggtgagctttggccaggtgcgcagcgtgcggctgaacgtcaacgtacgcgaaacgcacgccatgctgctggatacgctgtcggaagagcatgaacagcatcaggatctgtttaccagcaatcgactcacgttctcggaagcgctggcgaagctgtatcagcgtctcaatccgcagattgatatgggccagcgcacggcgcagaccatcggtgaagagctgctcgactaccgcaactaccttgagatggaagtggaagtgaaccgtggctccgacggctggctgcgcgccgaaagcggggcgctgtcgaccggtgaagcgatcggtaccggtatgtcgattctggtgatggtggtgcagagctgggaagaggagtcacggcgtctgcgcggaaaagatatttcaccgtgccgcctgctgttcctcgatgaagccgcgcgtcttgatgcgcgctccatcgccacgctgttcgaactgtgcgagcgtctggaaatgcagctggtgatcgccgcgccggagaatatcagtccggaaaaaggcaccacttataagctggtacgtaaagtctttaacaatacggagcatgtgcacgtggtcggactgcgcggttttctccgccgatccgacgccggtgaaacaggaaaatcccggcgcaggcgtggatgctgtgtctttggtaagaagggggcagggatgttgctgaacaagaagagcagagttaatcgtgctgcaatagcactcagtttgtcactgatggcggcaccgctggttatcagccaggcggcagacgtcggcgcgctgccgcacagcacgctgtctgtggctgccagccagcagcaaattcagcaggcatttagccccagcgaacgacccttttatctgcccggcctcgccggcatctatgcggcacgcaacatggcgccgctgtggcaggatcgcgacgccgtgcaggctttccagcagcagctggcagaagtggcgctctccggcgtacagccgcagtttacccgctgggtagagttgctcactaatccggatatcaaaggcttcgcgcgggacgtggtgctgagcgacgccatgcttggctatctgcagtttgtcgctaacgtaccgacccagggcgaaacctggctgtacagcaatgtgccgtacaagctgaccatgccgtcactttccgccatcaatcagtggcaaaacgcggtgaacggcggcggcagccgcgcctttgtggtgtcgctgcaaccgcagcatccgcagtacgcaccgatgcacagcgcgttaaaagcattgctgaccgataaccggccgtggccgcagctgcgcgataagggcacgctgcgcccggtcagatccagcgatgatgtgccggcgctgcgtgagattctgcagcgcaccgaggatgctgaccggcacgcacagcgcgacgcccacgccagccgacgatgccgtcccgacggcgccgcagccggtgagtcagagcgatcagccgtggccgccagcggcaacatcagcacggtcaccccggctgccagcaataatgtctacgacaacacgctggtggagggggtaaaacgcttccagcactggcagggactggcagacgacggtgccatcggcccgcgtacccgcgagtggctgaatgtttcgccgcagatgcgtgcggcgctgctggcgctgaatattcagcgtctgcgtctgctgccggatgacatgcacaacggcatcatg

SEQ ID NO: 42591 - DNA, 900 bp, Glycine max
  Peptide Sequence Number=SeqID_134276
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcggggaggtcagcatacaccccgcgcagcaacattgttacatgttgcgttggggaaacgatgtgtgacacccaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaa

SEQ ID NO: 42592 - DNA, 309 bp, Glycine max
  Peptide Sequence Number=SeqID_134277
atgtggaccaccacggcaatttcgagagagagagaagtgcctaagaagctgacccttttcttcttcactcctccccctatttatagcaaaataggggagcagcttgccacccagcttgcccaggcgagcaaggttgcttcctccagaagcaacagccttctggaggaaggatctggaaggcccaagtgggccagattgctattttttttgaagaagttacggaaactcacgaattgcgcaaaaacacctctttttgatttccgccacattacggaatttcacggatcgcgcaagcctgcttccttttga

SEQ ID NO: 42593 - DNA, 614 bp, Glycine max
  Peptide Sequence Number=SeqID_134278
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccagaacggtgtcgatcatctgggcgatgttctcccgttcgttgtaggtgggtatgataactatgctgtcgctcttcatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgaggg

SEQ ID NO: 42594 - DNA, 279 bp, Glycine max
  Peptide Sequence Number=SeqID_134279
atgccatgcgctgaagagaagatgctggcgatcctcgcggcgcgcggcgcggagtatccggcagagcataacgttggccatctgtatgcggccaaaccgcagctgcaggcgttttaccgccagctcgatccgaccaatacctttaacccgggcatcgggaaaaccacgtgtaaggtcggcattgatgccgcccccgaatccaccctcacgttccacaagcgtgtagggtcggcattcatgccgactccaaattcaccctcacgttccacaggcgtgtag

SEQ ID NO: 42595 - DNA, 366 bp, Glycine max
  Peptide Sequence Number=SeqID_134280
ggcgcagaagacgacgttagtctctgcttgctagcaggctttttgtcttacagacagcaaaaagtttatacggatagccactcaggtattatcgtccgtcagcgtgactcaaaagtcagtatgacagatcttgtgagcgcggaagatgacgcttttcgtcttacagacaacaaaaagtttatacggataaccactcggtatttccgcccgtcagcggcgcagaagacgacgattagtctctgcgtgctatcaggcttttcgtgttacagacagcaaaaaggttatacggataaccactcggatatttccgccagtcagcgtgactcaaaagtcagtatgacagatcttgtgaccgcggaagatgac

SEQ ID NO: 42596 - DNA, 414 bp, Glycine max
  Peptide Sequence Number=SeqID_134281
atgacaagcagagaccaagtttggtcattctgcacccttgtatcatccagaggcggcgggcccgatgatacgcagagataccttacggttatccgcacccttttgtcatccagaggcggcgggcccgatgacaagcagagaccaagattggtcattctgcacccttgtatcatccagaggcggcggggcccgatgatacgcggagataccttacgggttatccgcacccttttgtcatccagaggcggcgggcccgatgacaagcagagaccaagtttggtcattctgcaccctttgtatcatccagaggcggcgggcccgatgatacgcggagataccttacggttatcccgcaccctcccagagggacaattggggcacccttttatcatccagaggcggcgggcccgatga

SEQ ID NO: 42597 - DNA, 863 bp, Glycine max
  Peptide Sequence Number=SeqID_134282
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaatcaagaaagctttggccgacgttaatgcagtcaaagggacacaaagcattggagaactgaccaaagcatttacgacatctcacactttgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42598 - DNA, 372 bp, Glycine max
  Peptide Sequence Number=SeqID_134283
atgcgaaatagacaacaattatttacattttacacagttcaacaattgcacacacgaagtttcacaaatccacaattccttaaaataggcctaactcacaaaaatagtccccagtggagtcgccaactgtcgcaacgtgcccttttgcgggcgagcgaaggcgaggctcacgggtgcgctttcccaaaggaggaaagatgcgcggagtcgccaccaacgtttatttgtggaaaacgtcggaaaaaccgaaggaaaccggtcaaaatgaaaattctaagttcgggagttgtatttacgtttgaggaaggtcgacaaaagcgaggcttttgctcctacgtaccctccatcgaagaggaaatcagacctacgtag

SEQ ID NO: 42599 - DNA, 454 bp, Glycine max
  Peptide Sequence Number=SeqID_134284
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaggactataaagataccaaggcgtttccccctggcggctccctcgtgcggctctcctgttccttgcctttcggtttaccgggtgtcattccgctgttaatgggccgcgtttgtctcattccacgcctgacactcagttccgg

SEQ ID NO: 42600 - DNA, 297 bp, Glycine max
  Peptide Sequence Number=SeqID_134285
atggcttacgaacggggcggagatttcctggaagatgccaggaagatacttaacagggaagtgagagggccgcggcaaaaccgtttttccataggctccgcccccctgacaagcatcactaaatctgacgctcatatcagtggtggcgaaacccgacaggactataaagataccaggcgtttccccctggcggctccctcgtgcgctctcctgttcctgcctttcggtttaccggagtcattccgctgttatggacgcgtttgtctcattccacgcctgacgctcagttccaggtag

SEQ ID NO: 42601 - DNA, 585 bp, Glycine max
  Peptide Sequence Number=SeqID_134286
atggcaaaagaaggttcgctgtatacgctcctcgaatttatcggcaacccgatcaccgcgatgtttatcgccgtgtttgtcgcctactacctgctggggatccgccagcatatgagcatgggggcgatgctgacgcacaccgagcacggttttggctctatcgccaatattttgctgattatcggcgcgggcggcgcgttcaacgccatcctcaaaaccagcggactggcggactcactggcgcatattctctcgaacctgcacatgcatcctatcctgctcgcctggctggtggcgctggtgctgcatgccgccgtaggctccgccacggtcgcgatgatgggcgccacggcgatagtcgcgccgatgctgccgctctatccgaacgtgagtccggagatcatcaccattgctatcggttccggcgccattggctgcacgatcgtcaccgattctctcttctggctggtgaaacaatactgcggcgcaaccctgaatgagaccttcaaatactatacgacggcgacgtttatcgcctcggtgcttgcacttggcggcacattcctgctttctttcattatctga

SEQ ID NO: 42602 - DNA, 489 bp, Glycine max
  Peptide Sequence Number=SeqID_134287
atgaccacggctgaagcgctagagcgaaaaacaaaaaaggcccaaaaggaagagtggagtaggaacaagttccgatgggctttgtggggcagcagtaatgagctcaaacttagaaaggccgagagggacaaatcaaggatggaaagcatggtgttagaggataaattgaagagttgtcagaggtcgaagagaagtttgacagagcagttgagcaaaatagaagagaatatgttgataatcatttatcaatataaggagaagattgaaaaggaagcgagagaaggggtgatagagctattgcacaaggaagccatgaaatggatgaatagatttgctctcactctaaatgaaagtcaagagcttccaaggttgttagccagagccaaggcagtggctgacacgtactctgctcccgatgaacttcacggtctttttgattactgccaacatatggtcgaactaatgacctacattattaggaatcgttga

SEQ ID NO: 42603 - DNA, 584 bp, Glycine max
  Peptide Sequence Number=SeqID_134288
ttgcttcttgtatgcgaggtaattcttcagcagggtatttagctccactagatttggagattgaagctacttgcaggagaaataatgcagaaaggaggagaaaaactttacaagagaggacagtacaaccaagtgtcgagggaactcattcatctgaatcatttccagcaaacttgagggaatccaaagttggtgcatctgaatttcacatcatggtggacgagcaaccacaaagggttactcttgaggactactcaagctctaccgtgccgcaatttttcacaagcattgtgcaaccggaatccaagaaattgttagatgcttttttcgggggaaagattaagttgaagactccagaagaagcaatggaactcattgagaatatggttgctagtgatcatgctattttgcatgatagaactcatgtacccaccaagagaagcctattggaactctcttcacaagatgcattgttggcacagaacaagcagctagctaagcaactcgaattactcatcgatacactcagtaagttgccaacacagttacaagcggctcagccctctcattcagttgttatgcag

SEQ ID NO: 42604 - DNA, 225 bp, Glycine max
  Peptide Sequence Number=SeqID_134289
atgactaggggcaatccaggtgatttacaaccctttgatcttgaaatagatagagcctttcatagattagttaggcatagtgtgcatccttgtctatctgtgcattttgagcattctgagcattctgttgagggtgattctgaatattctgattttgaacattccactactaactttcatactaagaacatggctcaacctctacctcgtgagtcggactcttag

SEQ ID NO: 42605 - DNA, 552 bp, Glycine max
  Peptide Sequence Number=SeqID_134290
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggccaaggcttctccacagtcgcacgatggagtgatggggatagtttatggattaggcacactctttaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 42606 - DNA, 210 bp, Glycine max
  Peptide Sequence Number=SeqID_134291
atggcgtatctgtttctatcagctgtccctcctgttcagctactgacggggattgttatccgctcacaattcggcaaaagcatacacgccggacatcaaagtgagaaaaaaggctgcaccggctcagcagaatatgtgaatacgactcactattccgcttcctcgctcactgactcctacgctcggtcgtcatgcggcgagcggaactag

SEQ ID NO: 42607 - DNA, 132 bp, Glycine max
  Peptide Sequence Number=SeqID_134292
atgggaggtactggagctgtggaagaagaaagagctagtgtctctggtgctgctgaagtagtggggacctctgatctcttacccctagccttccttggccctctaaatggctcaagttctccagggatatag

SEQ ID NO: 42608 - DNA, 353 bp, Glycine max
  Peptide Sequence Number=SeqID_134293
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccgg

SEQ ID NO: 42609 - DNA, 219 bp, Glycine max
  Peptide Sequence Number=SeqID_134294
atggctggtacattattccttttgaaacagcaaaatagtttagaggttatgagcagacgtggtagggatccaaaccgtgacgtcctcgaccgcatcacagctgtgctggaaactctggtgcaggaacgtgatgtggagccggcggagtatcggggactcatggctttccgtaagaacacgggcaaagttcagtggagactatcgatccggaagtgctag

SEQ ID NO: 42610 - DNA, 408 bp, Glycine max
  Peptide Sequence Number=SeqID_134295
atggtgaaagttggaacctcttacgtgccgatcaacgtctcattttcgccaaaagttggcccagggcttcccggtgctccagtggcttctgtttctatcagctgttcctcctgttcaactactgacggggtggggcgtaaacggcaaaagcaccgccggacatcagcgctggcaagtgtagcggtcaccctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 42611 - DNA, 783 bp, Glycine max
  Peptide Sequence Number=SeqID_134296
atgaggggagcaccggcggaagagagcctctctcttttccttgtgagagatttcggagggttagattggctctccaagttgaaaataatcaacgaggagaacttcgaagttccggaagaggatgaagaagtccgagctttaaaaacagaactaggaaaagcaagacttgccaaagaaaaattcaagttagtcgctacacacatccggaaggagtgtgccgagttacgagaagaaaatgcagctaccgcaagagcccttgaacgagaaaccaagagggcttgcaaggaagagcatggccgagataaattccgtggagctttgtggggaagcaataatgagctcaagcttcgaaggggagagagagaccaatcacgagcacatagcatggtcttaaaagaggagttagctgcttgctcaaggtccaagagaagcttgtctcagcgtttatgcgagacagagaccaacatgttacccatcgtcagcaagtaccaagaagaattaaatctagccacggcccacgagcacaaagtggcggacgagtatgcccgagtgtacacggaaaaggaggctagaggaagggtgatcgaatcgttacatcaagacgcaacaatgtggatggaccgatttgctcttactttgaacgggagtcaagaacttccccgattgctaggcaaggccaaagtaatggcggacacctactccgcccccgaggagatccacggacttctcagctattgtcagcatatgatagacttaatgggccatataattagaaaccactag

SEQ ID NO: 42612 - DNA, 114 bp, Glycine max
  Peptide Sequence Number=SeqID_134297
atgaatcgaggtgctcggggacgagtacgaatggatgctaggcccgtgatcaacagatcgttgtcccgcgtctggcttcggacgatcaagaagtgctactgggaggcagcctag

SEQ ID NO: 42613 - DNA, 396 bp, Glycine max
  Peptide Sequence Number=SeqID_134298
atgggaacaaggggttgtatcaattataatcccatccttgccataagacaacttggctaccccatgagaggagcgtcgtcggaggaaagcatcacacctttcatcgcaaggggtttcagtgaccccaatgcgaggatatttcaaggagttcgcaaggcgtggtgtgcagtgcaaaggaaagataaagagatcaagggaagtagcaatgggatcatcgacggctatcataagtggctgaatgctcggacgcaagggttggattggctcctaaagctaaaggttttaagagaggaagaggccgaaacccctgaggagagtgaggaggtgcaagccctaaaggcagaacttgaaagggcacaagcagtcaaagaaaagttcaagacaatgaccatcaag

SEQ ID NO: 42614 - DNA, 366 bp, Glycine max
  Peptide Sequence Number=SeqID_134299
atggcagccatatatgcacaaattcgttccacaagcaaaatttcacaataccacacgcaaaagccattgaggcatttcaccaaacacttggggcaatgtgacatgcccattcatctcagaattcaaaataggcctacggccatcccctatagccccccaacccaaccaatcaagcatgaattcacacataattcatctcacgcaatttgcaaaaagcaagcaaccaaagcactaaaatactacaatggaaagccaaagatcaaagggaagtggcacttacttgtagggagtgaacaaaaatgcagaaaaatggaagcaaagatgcaaaaagcttgcttgaggctgttgaactcgaaaatcccgtga

SEQ ID NO: 42615 - DNA, 933 bp, Glycine max
  Peptide Sequence Number=SeqID_134300
atggggacaaatcaaatcggaaaaagattctatcaagtcaagattaagggcctagatgtcaccagccttaaagagttagggcagttgatgggtcagctccagcgccaagcttttcgcaaagcttacggtaaaatctgggacctagccatggtagaagtctccacagaagccgttgtatccctcacccaatactatgaccagccattgagatgcttcacgtttggggacttccaaatagtatcgactgttgaagaatttgaggagattctaggatgtcctcttgggggaagaaaaccatatcttttctccggatttcttccctccttgagcaagattgcagttgtggtcagggattcggcgagagagttggattgtgtaaagcaaactcaaaacggcgtagtgggcctaccgcggaagtacttggaaggcaaggtaagtgatacggcgaatcaagaggagtgggtcccgtttggggatgtactagctttgctaatctttggggttgtcctctttccaaacgtggacggtttggtggacctagccgcgattgatgctttcctttcatatcaccatagcaaggagagcccggtggtagctatcttggcggacttatttgatacattagaccgaaggtgcgagaagaacagcgcacggattgtctgctgcttacccgctctttgtgtgtggttggtttcgcacctattccaacatgacataaggcacccatgtccgctccaaagttatcgctcgtgtgtcaaaaagagaggagtagattgggaccaatacttggctgggataggaggcagaacaatcaactggtttcctcgatggaaggaaggaaaggagggagttctcttctcatgtgaggactacccaaacattccgttgatagggatgagggttgtattaactacaatcctgcacttgctataa

SEQ ID NO: 42616 - DNA, 312 bp, Glycine max
  Peptide Sequence Number=SeqID_134301
atggcttccataatagaggccatgttaggaataagacaactcatggagaataatgtggccaccactgccgctgttagttcggctgccgaagcagacccaactctcccagctaccgcacaccatcctctcccaaacacggtaggacgagaaaggagcacactggggcacaccaacaacatccatttgggatacaaccgggtgacttacccttatggattaccacctaattacacgccaccagtcatgcgtgatgaagcgggtcatgtcccttcccccgtccttgaaggggaacctcctcgacagtcggatgag

SEQ ID NO: 42617 - DNA, 399 bp, Glycine max
  Peptide Sequence Number=SeqID_134302
atgggggtttttccctttctgctttgtaatctttctgcaatgccaggtgccaactttttggcaatgggttcctcatcagattctacttcttctaggtcaatgaggtcacctggagcagagcggacttcagcatttggggtggaagatgatggaacatctttatcagcatcagggacagaagcatttttcaaaatgctattcacaagactgcagatcttcttatccatctcagtgtcttcttccctagggcttgagaaagctagggttgttcctgggtttgatggagttttggaggatgatggagatgatggtacagagggtgaaacaggggatgaggtttcttttggtgaggtagccatggagaagcagagcttttggagtggtttcgtgaatatctga

SEQ ID NO: 42618 - DNA, 322 bp, Glycine max
  Peptide Sequence Number=SeqID_134303
gataagcgctatccattgagtaaagggagggtttcctacactacagtgattcgggcggcggttggtggccccttcgagagttgcgggtccttgccgctgcatgagtggggtcagtcaagcggttcgggttctcggtcggttcccggcgcccgcctcctcttcagacgtgtcttcgacaacctggcggttgttcggtctccgcttttggaggcgggagtgcttggtcgctggggtttccttttcctcaaccaattcggttgtgtcagccctgagattggttggtctaacatttatgagctggctggacaaagatggatggaag

SEQ ID NO: 42619 - DNA, 282 bp, Glycine max
  Peptide Sequence Number=SeqID_134304
atgccccatgggttgtttccttacaaaagtcacgcgctaatgccactgaggcatttcaccgaacacttggtgggcgcgcgtttaggtaacaatagcaagagaacggggacaatgtggcatagcaccaaaaggagatcgaaatacaccaatgaaaagctagaaagctcagggatggaacacttacttgttggtgatgaacaaaagcgcaaagcggaatcaaaaaagcgaaaaatgatgaccctagggctgcaaactcgtcaatcccgtgggtatggcttttga

SEQ ID NO: 42620 - DNA, 303 bp, Glycine max
  Peptide Sequence Number=SeqID_134305
atgcaacatggcttaattgggtttaatcccttccttttggtgttcttcctcgaacaaattctattgaagatgtttatgaatcccttcacatttggagattaccctgatataatgaaaaagaatgctggctcaaggcttccttcttttactcaaaaggaatcaaatctggtcaggggctcaatcgacttcattggaataaacttttactactcattttatgttaaaaacagtcctggcagcctgcagaaggaggatagagattacattgcagatctatcggtggaaattgaaagtatgtcataa

SEQ ID NO: 42621 - DNA, 504 bp, Glycine max
  Peptide Sequence Number=SeqID_134306
atgagtcttcattcttcatctagtgttaatggtgagggttctactcctaaggaccccttgtataagatattagatgagttgagatcccttaagttgtggaaagaaaaacaagagagaaaagaaaaaggaaggcataggtcacatcttagacctcactcccataggagagaaaatgaaagaaagcctcaagaggttaacattaaaatcacatacttccatgggaaggacaatgtagaggctaatttagattgggaaataagggtagagcaacaacttaaaaggaagtctacttcaaaatcttatggctctcactcttatccaaagaaagaccaaggtcaaggaatcttaggggtgagaccttctaagcccaaagatgataaggggaatacaatagaaaagaaaccccttaaggctagtatgcaagagaagactagctccatgaagtgctttaaatgtcttggaagaggacacattacttctcaatgccccaccaagaaaccatga

SEQ ID NO: 42622 - DNA, 200 bp, Glycine max
  Peptide Sequence Number=SeqID_134307
tcttggaagtcaacactcaggagcgcaggtcgcttgagcaaatagaccaatggcttgcacttgaaaatcctgatgagtcattagagacatctaacaacagttttcaaaattgccccattgctcaatggaatgccccagggctcccccacgatatgcacatgttgcgttcgagtcatatcctcagaaaaatgggggtttga

SEQ ID NO: 42623 - DNA, 231 bp, Glycine max
  Peptide Sequence Number=SeqID_134308
atgacagtggaatggagaaggaagagagagaggagacgccacttcaaggagaagatgagtctagaagaagctcaccaccataggaggccatggataagagcttggaggaagaaggagatgaatgaagggagagggagagaagaacacgaaattttgtgctctaaaatagatttgaaatctgaacccactaatccaagatcaattccaagattctccactaagtgtgcttag

SEQ ID NO: 42624 - DNA, 468 bp, Glycine max
  Peptide Sequence Number=SeqID_134309
atgctggatgaccacaatgtccatgcaaaaagttttagaatggtcatggatagattgtcagatagtcaactagataatttgaaattgagattgatagctggacgtgaaaaggatggtcgtacatacaatctcccaaatgtttatgaagttgttgccctgattgttggtgatttagatgcagactcaataagggatattattgttaaaactcaaaatggagaattacaaagaatccatgaattacactctagctatctaggactgcagtaccctttactcttcccttatggtgaagatggatatagacctgacatacttcaccgttctacatctggcagcaaaaaaaggaagagaaatcgtctaacgatgagagactggtttgcttatagacttcaatccagagtacttgcatctttgaatctgaaagcaatagatagaccaaatcttgtctcccgtgttttcatatga

SEQ ID NO: 42625 - DNA, 252 bp, Glycine max
  Peptide Sequence Number=SeqID_134310
atgggggtggttgaagatgttttggtcaaggtgcgacaattcaccttccctgcagacttcgtgatcatggatattgaagaggatgctgaaatcccactaatcttgggttgtcccttcatgttaactgccaattatgtggtggatatggggaaagaaaagcactcacttgaccggaatatttgttccaagatggatgaagttaagaatgagatggttctgatggctagagccaagcttgctccagacccttga

SEQ ID NO: 42626 - DNA, 608 bp, Glycine max
  Peptide Sequence Number=SeqID_134311
acgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtagtaaatgatgcggaaaagggtagtgacattgatccacaagaagcacagcaaactcttgaaatagcagaagctaatttgaataaggcggaaggcaagagacaaacaattgaggcaaatttagctcttagacgagctaggacacgagtagaggctatcaatgtgatttcataa

SEQ ID NO: 42627 - DNA, 396 bp, Glycine max
  Peptide Sequence Number=SeqID_134312
atgacggagaaaaaaatgatgacaatgatagtagacacattaccagtattctactatgaaaagatggtgggctacacaccttcaagctttgatgatatggtcttcaccgaagaaaggatcaaagtgggtctaaaaagaggcaaatctgatcatcatgctttgataaatgcaaaaaaaaaaaaaactagggcaaatgaagagggtgaaaatgtgggagaagcctatgctgtgactgccattcctatacagccaagtttcccaccaacccaacaatgtcattactcagccaataaaccaaccttctccttacccaccgcccagttatcgacaaaggccatccctaaatcaaccacaaagtatgtctaccgcacttccaatgacgaacatcacctttag

SEQ ID NO: 42628 - DNA, 456 bp, Glycine max
  Peptide Sequence Number=SeqID_134313
tggaggaatcaccctggaaaccagttcaacaaagaccagggtggtccatctaacaggccacaacaacaagggcctagtctctatgatcgaacaacgaagctggaagaaactctagctcaatttatgcaggtatctatgtcaaaccataagagcacagagtcagccattaagaatctggaagtccaagtgggacagctggcaaaacaattggtggataggccgtcaagcagctttagtgctaacactaagaagaattcgaaggaagaatgtaaagctgtaatggcaaggagcagaatggcaattcaggctaatgaaggtagagctgaagagaaggtggagggatataaacaacagtcggcaattgagccggcactggaaccagtttttgattttgttaaacttgaggaagttgtggaagatgaagatgaccaacaggagagagagagacaccaataa

SEQ ID NO: 42629 - DNA, 504 bp, Glycine max
  Peptide Sequence Number=SeqID_134314
atgggcccatcggtggctaccgaggaagttgaggcaccggaggaagatgaagaggtgcaggcccttaggacaaaactcgagcaagctcaaacagtcaaagaaaggttcaaattagcagctctgaagatccgaaaggagaatgccaaactgagagatataaatgtagctaccaccaaagccttggaacaagaaaccaagagggctcgtagggaagagcacggctggaacaagtttcgaggggctctgtggggcagcaacagcgagcttaagctccgaagagaggaaagggaccaatcacgagtagacagtttgatcttgaaagatgagttgaagacttgctcgaggtacaagagaagtttgtctccgcggttatgcgagacagagaccaacatgttagccatcatcaccaagtaccaagaagaactaaatctagccacggcccacgagcatagagtggcggacgagtatgcccaagtatatgcggaaaatcaggctagaggaaag

SEQ ID NO: 42630 - DNA, 366 bp, Glycine max
  Peptide Sequence Number=SeqID_134315
tacaatctaaatcccttaacgaggatccattggagggcaagtctggtgccagcagccgcgttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgg

SEQ ID NO: 42631 - DNA, 159 bp, Glycine max
  Peptide Sequence Number=SeqID_134316
atgtcggtgaaaaacctcatcgggcgcctaggagtacatggcaagacaaaccatacactagcaagtcaggtcactctcactaggcttaaaggagcactcaaaccgggtgatcaccaaggcctacactccgaaaagttcgtcagggcctctgcctcctga

SEQ ID NO: 42632 - DNA, 592 bp, Glycine max
  Peptide Sequence Number=SeqID_134317
gtatatcatgaattcaattattacagtgttgtatttcaacggaagagtatatgaagacaatgatggcgtaatatttgaaggcagtaaaaaggccattcagattaaacgcggaattagtttcaatgctttgaaaaaaaaattggagataagatttttagtttcaggaaaatatgttgcgttgcaaatttgtgatgacgaagatgttgaaactatgatcgaaagttttcaacaacaacaacaaatgtcagttctagaattgtatgtagaaaaggatgttgctggtgatgatgatgatgatgattaccttgcatctaactcatacgttgaagagtctttcgatgaagatgatagtgatgatggaatatctgatacagacgatgaagtcactgacattgttgaaccagtttcaattattcacccaaccgaaggtgtaccacaaattcaaaatccattttggaatgatgctatgcattataataatatcaattggagtcatccggatgaggaggacatttgtggtctggacatgccaacgacttttaatgttggacaagaattatatgttggcatggattttgacagtaaagatgcg

SEQ ID NO: 42633 - DNA, 681 bp, Glycine max
  Peptide Sequence Number=SeqID_134318
atgggcaaccctgtcgagcaaccggacttaccacaagaacaacctaccgtcgaggtacaacaaaatgtttctgtagaagaaataccctcatgtgctcgaacctctcctgctcctgagacagatacagtgaatgttgaggaacagggtgaaggtcaaggtattcgatccagcagtcctcatggatcgagtcagaaaagttcatctgaagaaaacttctccgatgaagaggccatacaagaggctgaagctggaggttcggacatttacccagcgtcttcaacctctaagctttccgccagcgtagggatcgcagaagaaacgttcattaaaatgcaagacgaagacccagctgcagcccttcgactcctgctgaacaccagtcaagcccacacctcaagtgaaaagattcctggtgcttcgtcctcatctgatgctgaaataaactcttcagtacgccaagattgtctgctcttgaaattatcaatggaatacgcacgggcagacgtacttaaatccattgaagagaacccctctgctgcttttgggcacctgaactttttgaagaaattgcacaacccccttacctctgacgagattctaggcaaagttatccaatcgagtccattatcaatcaatttgcaagcactgtgcagaaaaagcgcgaaaatgacgccagactag

SEQ ID NO: 42634 - DNA, 435 bp, Glycine max
  Peptide Sequence Number=SeqID_134319
atgaaagataagagagatgatgaggaaaaactagaaaaacaaaagaaaaagaaggatagtaaggccttgtcttcaaaagctaaggggaaggaaaaggaggaaaatgattcctccaagaagattgttaagaaggaaaatcattttgcaacaaaaggtattattaggcaccaaatcccaatgataggtggtatgatgaattttttgagtggtgcaacactcttttgtaaaatcactcatgcacccaacatcttcatgatttgtgtacatagggactcattaggcaggaataatcaacatgaaaataaagaaaaaggtatattttattccattactttccttaactttttaaatagtgatcaaggacttcccatggaccctaagagaataaaggtgttgaggaaagaatccatgagtttcaagaacctctggatttga

SEQ ID NO: 42635 - DNA, 171 bp, Glycine max
  Peptide Sequence Number=SeqID_134320
atggcgactagtaggtttttaactgctcctagggcctttggcagtggtcctagtatgtccattccccacatggaagggagctcagactgtggagtttgtcaggaggggcatttgagtagaggtgttatcaaccctcttttgaatagtttgccgtcaaggatgatgcagtag

SEQ ID NO: 42636 - DNA, 411 bp, Glycine max
  Peptide Sequence Number=SeqID_134321
aattatacggataaccactcgggtatctccgcccgtcagcgtgactcaaaagtcagtatgacagaacttgtgagcgtggaagatgacatagcaaaaaagaattatacggataaccactcgggtatctccgcccgtcagcgtgactcaaaagtcagtatgacagaacttgtgagcgcggaagatgatgtaaatctccgcgtgtcaacgggcttgtcggccgcgattgacgaagggcttttcgtcttacagatagcaaaaaagaattatacggataaccactcgggtatcttcgcctgtcagcgtgactcaaaagtcagtatgacagaacttgtgaaagtggccgacaaaagcgaggctcttgctcctacgtatcctccaatgaggaactcagacctacgtagttctggataa

SEQ ID NO: 42637 - DNA, 300 bp, Glycine max
  Peptide Sequence Number=SeqID_134322
atggtagcctcattctccaattcatctaatgttgttgggtcaatgactttgctacatatagcattaaaaacaaagcatagacgtgttatggcaacccaaactttgtcaggcaagattcctcaaatcgctacagcatacgcaaacaatgacaaaaactcctcttctcgtttgttgacattgtgtgacatgctagaggtggatatgttcggtaaccttgtgagattggatgcaactgctctcgtatacccatttcgaccaagtcctgacgaaatttcaaaccatcctatgttttgcctttaa

SEQ ID NO: 42638 - DNA, 540 bp, Glycine max
  Peptide Sequence Number=SeqID_134323
atggacccttgggtactagttaccctcaccttcagaggactacatgtcctcactttgagagggctacacgccctcgccatcagaggactgcatgtcctcaccttcatagggctacacgccctcacctttagaggactacacgtcctcgccaacagagggctgcacgccctcaccttgagaggactacacgtcctcgccttgagaggactacacgtcctcaccatcagagggctgcactccctcacctccagaggactacacgtcctcaccttgagagggctacccgccctcgccttggatactagttaccctcaccttcagaggactacacgtcctcaccttcagagggctacacgccctcgccatcagaggactgcatgtcctcaccttcgtagggctacacgccctcaccttcagaggactacacgtcctcgccttcagaggattacacgtcctcgccatcagaggactacatgccccccattttcaaagggggacaggccctcacctttagaggattgcatgtcctcaccatcatag

SEQ ID NO: 42639 - DNA, 303 bp, Glycine max
  Peptide Sequence Number=SeqID_134324
atgagaaagcaacatacctcttatgcaagtggtgcattgaagtatttacatgatttacgcacaaaagatccaatgatgtatgtttcatgcaccgcggatgaaggctcaagactacaacgattgttttggtgtgatgctgagagacaattgctttatgagtcctcaagcaacccacttgagattttccactctctttgtaaaaatccttttacaaagtctgaatcacacagggacaacccttcccttgtgttcaagaatccttacaacttaagagaccctcggtcccttaatcaatctctttga

SEQ ID NO: 42640 - DNA, 219 bp, Glycine max
  Peptide Sequence Number=SeqID_134325
atgtggtcatctgcgccctttccggagatgtcagcatcttccgatggagacttttcaagtctcacaagttatccagaactacgtaggtctgagttcctcattggaggatacgtaggagcaagagcctcgcttttgtcgaccacaccaccttttgttgtcatgacccaagagctggtagcccgcggagacaccttacggtcttatccgcgcattcagtga

SEQ ID NO: 42641 - DNA, 824 bp, Glycine max
  Peptide Sequence Number=SeqID_134326
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataagatattcgacatcaaacacgccaaaacgacaccttcggacatgcatttgatggtcatgatacacattcgatatattgcaccaatgacgacgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42642 - DNA, 678 bp, Glycine max
  Peptide Sequence Number=SeqID_134327
atggtggaagaatttgaagagatcctaggatgccttctagggggaaggaaaccttacctcttctcaggattttatctctctttagctagaatttataagatagtccaaatcctggcgcaggaattagaccacagaaagcaagtcgaaaatggggtggttgaagtaccgagaaaatgtttggaggcaaaagcaagaatcttggcaggtaaaggcgaatgggccccgttcatagacatcctcacacttttgatcttcggaggagtcctctttccaaatgtggatgggttggtggacctagcagcgatcaacacttttctcccctttcatgaccgcaaggaaagctcggttgtcgctatcctagccgatctatatgacaccttcgaccgaagatttgaaaagagcagtacaaggattgtttgctgtactccggccctctatgtatgctggttccctcgatggaaagaaggaagaactggcgttcttatttcgtgcggaggatttccaaatgtttccttgatggggacaaggggttgcatcagttacaatctcgttcttgctataagacagctgggctaccctatgagaggggcaccactagaggaagatctcgcacctattattgcacgaggtttcaataacaccaatgtggagacgcttcagaaggtccgcaaggcatga

SEQ ID NO: 42643 - DNA, 334 bp, Glycine max
  Peptide Sequence Number=SeqID_134328
ggatcgcgcccacaagacacccagtggacccgaagaagtccaacagggtcttggagttgccagctatgattacgggcctctttcagttctatggagtgcctgttgccccccagcaaagtcatcaagccccctactaatcgagttttcatcaagaagtactgtgcccctaggcaggcgcaaggcgagacaccacaacagcctggagatggacgacaacgggcaacaaacacaccaccaccacctccaaagcccctcagctcatccacaaaaagttagatcgttgcctacgacacatggtcgaccaataggcaaccaagtccaaagccaaaggtaa

SEQ ID NO: 42644 - DNA, 683 bp, Glycine max
  Peptide Sequence Number=SeqID_134329
atgagaggggcaccactagaggaagagctcgtgcctgtcattacgcgaggtttcaataagaccaacgtggaggcacttcagaaggtccccaaggcatgggaggtggtgcaaaagaaggacaaagaactcagaggcagtaataatgggcccatcggtggctaccgtaagtggttgaaagcccacgtgcaaggtttggattggctcccgagtttgagaaccgctaaaggggaggaagttgaggcaccggaggaagacgaagaggtgcaggcccttagggcagaactcgagcaaacccaaactgtcaaagaaaggttgaaatcagcatctcttaagatccaaaaggagaatgccaaactgagagatataaatatagctaccaccaaggccttggaacaagagaccaagagggctcatagggaagagcacggccggaacaagtttcgaggggctctgtggggcagtaacagcgagcttaagctccggagagaggaaagggaccaatcacaagtagacagtttgatcttgaaggatgagttgaaggttttcctaaggtccaagagaagcttgtctcagcggttatgcgagacaaagaccaacatgttagccatcgtcagcaagtaccaagaagaattaaatctagccacggcccacgagcacaaagtggcggacgagtatgcccgagt

SEQ ID NO: 42645 - DNA, 264 bp, Glycine max
  Peptide Sequence Number=SeqID_134330
atgactaggggcaatccaggtgatttacaatcctttgatcctgaaattgatagaacctttcatagattagttagacatagtgtgaatcctgatcattctgtgcattttgagcattgtgagcattgtgagcattctgttgagggtgattctgaatattttgattttgagcattcaactactaattttcatactaagaacatggctcaaactccaccttgtgggaggactcttagggagatggctgcacctgatttcacttattga

SEQ ID NO: 42646 - DNA, 133 bp, Glycine max
  Peptide Sequence Number=SeqID_134331
tggtagcaaaatgatgcaatcttaccctctaagggcattggatagaagactccaagaagattgggccatagatgcgagagaaggccctagggttctcataagccttagggtagatttcgggaccatgggctaa

SEQ ID NO: 42647 - DNA, 801 bp, Glycine max
  Peptide Sequence Number=SeqID_134332
atggctaggtttgaccctgaggtagtcctggagttttatgctaatgcttggcccacagaggagggagtgcgagacatgcattcatgggtgaggggtcagtggattccctttgacgcagatgccctcagccagttcctgggtgacccactagtgttggaggaaggccaggagtgcgagttcagccagaggaggaatagggccgacgggttcgatttggaggccattgcccagctgttatgcacaccgaggcaggatttcgcccggaccgctgcagggaggcgggtgcggatcatgcgcaccagcatgaccaccttgacccagacgtggatgacattgctgctcagcaatgtcttgcctagcgatcataactttgatctccctctaccgcagtgtatgccacccaccaggcaccctttagacccagataagtctaacagggccttggggtttctggcattgatcacgggcctttgccagtcattcggggttcccgtcacccctagtaaggtgatccgaccgccgatcacccgggccttcatcgagaagtattgcacgcctaggcagacgcatggtgatgcacctcaggacgcaggtgcaccgccaccacctcatcaggccgatcccactggatcactaggcatggaacattatctacagcacttggttcgccagcaggcggccaaccaccgagggcaggtacagatacatgagtgtctctaccggttcagcctcagtcaacaggggcagggtttcggtccttttgtgtgccctactgatcgaggccgtacccgaatcaaataa

SEQ ID NO: 42648 - DNA, 291 bp, Glycine max
  Peptide Sequence Number=SeqID_134333
atggcgtgctcgggcgtgatctccggcaaggcgcgcggcgcgcggacgccattaccttggccgcttcctggttcaggcgctggatgccttcgggtgaatcggaatggacgatggcacagctgttcttcggccgtgtcgacccagcgcgatgttctcgggaatcccgtcgaaaggctttccatcttgaagccccaccagtcgacccagaagtgcgccgcagacgccgtcggcggccagccgctcggccagcttgtaggccttccaccccgtggtggaaagcggccaccttga

SEQ ID NO: 42649 - DNA, 233 bp, Glycine max
  Peptide Sequence Number=SeqID_134334
atgcctatgggttggacctcccagaagagtggagctaatactgaggatgaggaaccaacaaatttgaggtcaaatcctcttcaagggggagaggatgatgcaatcctccttaggaagggaccagtcaccaaagccatgagcaagaggctccaagaggattgggctagagctactgaagaagacccttgggttctcatgaacctcaggatagatttctcagcccatggcccaag

SEQ ID NO: 42650 - DNA, 619 bp, Glycine max
  Peptide Sequence Number=SeqID_134335
atggcatctaagaagaggaaagctccttctacacctacccaggccagatttgatagatccaggttcacatcccaagaggctagggagagatatacagacattgttgtgcctcgcaagctactaccagagaggaatgtggtagtttattacacagagtttgatgagttcaaggaggaactcgagaggagacattgggatgagaagatgactgatttttctgacagtagcatatacattgctattgtaaaggagttttacgccaacctctatgaccccgaggataaatcacctaagcaggtgagggtgagaggtcatttagtgaagtttgatgaggataccttgaacacattcttgaagacccctgtagtgctggaagagggggagaacttgtgtacttattccaaatttgcactcctgaggcctgatcctcagaagttggctactaagctttttatcccagggaggggattcaagcttaatgctgatgggcagcctttgaagattttgatgaagaacatgaccattctagctcagacatggagcgttctctccttttctaacctcattcctacctcccacacatctgatgtcaccttggacagagccaagttgatttatg

SEQ ID NO: 42651 - DNA, 537 bp, Glycine max
  Peptide Sequence Number=SeqID_134336
atgggtgccaagtacctcaaagcggtcaagcaaagtttgcatgccatcaaacaatggtccccggacaaaataaggggtaacattcctaagtggattccctttgaaaagcggtccaccaccacgaagataaccgtattgccacagtacgcaggcaaacccacaataaaatccagcgaaagatcttcccagggacggtatggaaccaatgtgacctttgtgaagaacaaggttttgtgcaacagagaagtcaagatggatggtcggagaatccaaaatagcgcggcgttaatgtctgtattcggcttggttgtccagttgactctggtgatcggtggtgatcatgaagtggtgatgaagcagaagcttggaggtgaaaggctaactaaagaaggcaatggggtggccttgttgagacaaaaccgtgcccatccctaccctaatgcatcagtctcaagtgttaatggtttgttgaagtccggtagggccagaatcaacgctatggatagaacttcctttagacgatcaaaggctacatga

SEQ ID NO: 42652 - DNA, 1617 bp, Glycine max
  Peptide Sequence Number=SeqID_134337
atgagtgcttcctctgtcgatgaggaggataaccttgtggtcaccgcaacatttttggtgccacgtgacccactaagcgtcaccagtgctaagcgcgccctgtgcgctaagcctgagtgtcactctattaaagctaagctaagcgcagcttgctgcgctaagcccgaagcttgggacagatataatgacattgttgtacctaggaagttgcttccggaaagaaatgtggtagtataccacactgaatttgatgagttcaaggaggaactagagagaagaaaatgggatgaggaactgactagctttgatgaaggtagcattgatgttgtcatagtaaaagagttttatgctaacctttacgacccggatgataagtcacctaagcaagtgcaggtcagaggtcatttgattaagtttgatgaggacacgctaaatacattcttgaagacccctatgattatcgaggagggggagacattatcaacttactctagattttcactcttgaggcctgatcctcaagagttggttgttaagctctgcatcccaaggaggggatttgagctgaatgttgatggtcaacctctgaagatcctcagaaagaacatgaccacactcgctcagacttggagtgttctttcttactccaacttggtccctacctctcacacttctgacatcacactagatcgagccaagttgatttatggcattatcatgaagatggacatgaatttgggctacctcatctcccaccagatttctatcattgcccagcatgactcctctaggcttggatttccatccttaatcacaactttgtatgatccaacagtgacattcagagggccaaggaaggccaggggtaagagatttgaggctccccctacttcaacagcaccagatgcttctgctccttcttcatctactttaccagatccttcagcaccattcacttcgactccacatcttccacaagatgtttcactccacaatgtagagccttcacaaagggcaggagtccagccttctccttctggagggggtggggcctccgcagcccaggaacctgactctgctgagccagtggaggagcacacagaggagcaggtagcaaaggagccagttctagcagacgatgagctcactcctcttgagcccttttcatttgctgcaaatacatctatggctcagaaggaagagacttctccagatcccatgctagagccatcccatgcccctccatctatctctgaggatgcacctatatctgaggacaccatgccatcagcaccagccatggagccagagcagcccattcttcaggatgtaccagctgctccagtgctggatttaaatgaagatcaaccacaggatgagcaggatgtgtttgtgaatgacttgaatgagcaaatgtatgaagtgagtggattggaatgtatggattttgttttgatcaagcttgagccattagaagagaaagaacatgaatctggcagagttcaagagtcaaggcctcacgttaagtgtgtgatcaactcgctaagcgcgagggttgtccttagccaggctcaatacatgactggcgctaagctcaaaaccacttactcgcgctaa

SEQ ID NO: 42653 - DNA, 807 bp, Glycine max
  Peptide Sequence Number=SeqID_134338
atggcatctaccatcttgcttgtgactttcctcgccttcttgatgcaagtagtgaaaagtacaagctcatggaaccttttttcggagatcaaccatcaagttattggtttttttgtcaaatcatgggaaggagtaacaaggattatcatggtttttctaatggcaatagccttcactttagccacccctaggttcactttacctaagattatcattacttggatgtatttggctattcccatcatgatttacctatcagaaaggttgactagagcactcagatcaagcatcaagcctgtgagaatattaaagattctcgaaaggcatccattttctataaccttcgcccctggtgatgactaccttagcgttcatatcagaacacttggtgattggacctggagtctcaaagtcaagttctcagaggtgaattcaggatcctactgttgtgacatcctgaaatttctacccggaattttagaaacgtggggaactggaactagagaggcggcatgcaaatcgaggcaggatttcagcattcaaaagaaatttcagaagcttttcctctcttcccacgttgcttttcttcttccttcttctccaccattgttgtccattgaagctccaaaattccttctcatttctactctaaattgcaaggagaagccattttcggagtcttggagcacacctctacattgtggggcttcgaatttcaagtatgggtggacttcttctcacatgaaattcgtgggtgttgggtatttgggagatatgatgggtaattctactaggttattgccttag

SEQ ID NO: 42654 - DNA, 1452 bp, Glycine max
  Peptide Sequence Number=SeqID_134339
atgtcttattggcttaaacccattgttgaagttgactggcatcagggttgggagtggaaagagcgaagagaactccatggatgtccaacatggtatgaacacgcagtgaaaacctcaatttttgaaatgtcaggcagctgcttggcaaaggttgcagttaatggcgtggggttggaagcatcgacattgttgacagtcgtggcagtcactgacctaaaagatttatccacaatgtctctcgtaaacctcacaggatacaacaagaatgtcttagcagagctaagcgaacgcgcgaatccccgccacgaagcgaaagtcgtcgacgtcgatctctccctcctcgaagccattgagaaatcgcagagcgccgtcgaagccctcgacctccgagccctaaagaagcacgttctctccttcgagcgtcgcctgaaagaaaacatcgaagcgcgcctcaaataccctaaccaaccggaccgcttcgccgattccgaagtcgaactccacgaagagcttcagaagctaaaggtcctcgctagcgcgccagagttctacccggacctcgtgagcctcaacgttgttccctccatcgtcgacctcctcaaccacgacaacaccgacatcgccatcgatgtcgtgcaattgctccaggacctcaccaacgaggacgttctggacgacaacgacgactccgctagggttttggtcgacgcgcttgtcgagaatagcgcactcgagctcctcgtgcagaacctgcaccggttgaacgactccgatcccgacaagaacgccgccgtgtacggcactctcgccacggtggacaatatgcttcggagatttttggcgatttttcatggctcatattctcatttgaacatactatgttttccctcactagatattcagagagtcaaagcagaaactaaacagttggatcaagttgagcctgatgacttggagatagatgaagatgaaaaatacaactgtaaactagaatctgggctatatactcttcaggggtgcaaaccacccaacacttacgaccctcccaagggatgcaaaccacccaatagttacgacctgcccaaagtgtgtaaaccacccagcagttacgacccacccaaggtgtgcaaaccacccaatagttacgacccacccaaagggtgtaaaccacccaatagttacgattcacccaaagggtgcatggttagaagatgtgaatcaaagggacatgacccttgggaacagtcacaaccaaccattatgatccgctcaaggggtgcaaggtcaggagatgcgaatcaagggaatgacccttggaaacagtcacaaccattcagaataattgtgtcaattagatgtagtataaatataagtaaaccagaatgggaaagacacttgggaattaggaagaatctgaattgtggagaaacagactctcgaaaacttgtgtaa

SEQ ID NO: 42655 - DNA, 516 bp, Glycine max
  Peptide Sequence Number=SeqID_134340
atggctaggaagaaagatttggtaagaacaaatactgacagtaggaaatgtaagctgcgtgggaaactagtggttggaagccaaggatggatggtgaagttaatgtgtgagagtcacaatcatgaaatggaaaattcattagttggacatccatacgttggtcgattgactaaggataaacagattattattgctaatatgacaaagtcaatgggagaacatctaaataatgttgtatgggatctagaacggtttcgaggtctttttcttagacgtgatgtcctccctgaagttattgttgccgacaaagatttagcattaatgaatgcagtgaaaattgtatttcctaagtgtaccaacttgttgtgtcagtttcacattgataagaatgtgaaggcgaagtgtaaatccccgatatggataattccccacagagaaaaatttgttaaagcctggacgaatacagtgatgtacttaggaaacacaacaacaaacaggattgaatttgctcattga

SEQ ID NO: 42656 - DNA, 336 bp, Glycine max
  Peptide Sequence Number=SeqID_134341
atggaaagcatttgtgatggacagatgaagcaacggtgccacatcatcgaagcttctctcagggttcctgctgaaccaaattctgacttatcaaggttgtttccttgtggcgtcaccgtgacttatcttccatctctggaagtggcgtccctctccgtcaacaatcttgtgtcaaacgttctgccccgagcaggagcaggtggtagtggtggtgatgagtatcatcagttggacggagctcagcgtatgttactggacgcgatgaacgcacagatgcaacatttgttggattgtaatgtaacgacccgcctcgtcgctacgatatccacactctaa

SEQ ID NO: 42657 - DNA, 342 bp, Glycine max
  Peptide Sequence Number=SeqID_134342
atggttgatactatctcgacggagaacgtcgagatggaaatcgagtctactatagaggtagtcgattgggtcgatcatgagaaccatgatacccgaaccctaatctttggagtggataatcaccttcatacggataacgagatttttgtcgttagagacaagaaccatcactggtggaaacctgtttcttttctcaatctcatggaggaggtaagagtcagcttcaacgaagagatgaagtctagccgcgaccactggaggaagcggagagccagtcctgagagactagataaactcatcaagatgagattcttgaatgaggccccgattttcatcgggtga

SEQ ID NO: 42658 - DNA, 235 bp, Glycine max
  Peptide Sequence Number=SeqID_134343
atgacgaacgatagttcgaagatgacaagcaagtttgcgaagttggacaagtttgaagggcaggatttcaaaagatggcagaagaagatgtcctttctcttgacaacactgaaggtggtgtatgtgctgagtacaccaatgtcggtgtttatggaagacgaaactctggatcaaacaaggaagcgttcgaaatgggagaatgacgattacatttgtcgtagacacattctgaacg

SEQ ID NO: 42659 - DNA, 276 bp, Glycine max
  Peptide Sequence Number=SeqID_134344
atgctttctatttttttcctttctcaggatgataatgtagaaacttatcagtgcaaggaaactacaaaagaaaatactcaacaaatatatgatggtaacaacaatgaggatcacccttccttccttgaaagtaaatttgaaactaaccaacagattggaactctgattgatgaagcacctggtgataccacaaattccatgagtagttcaacttgtgaagatcctcctccaccacaatcagaatggtatccaccttacacatctttattccattga

SEQ ID NO: 42660 - DNA, 102 bp, Glycine max
  Peptide Sequence Number=SeqID_134345
atgaagaagatcctaggcctacaagcttcaatggagcttacatcacgtttgaccttgttagatatccctggtgggagaaatagagtggttaaagagttttaa

SEQ ID NO: 42661 - DNA, 432 bp, Glycine max
  Peptide Sequence Number=SeqID_134346
atgtggaggaactggagattttgtaaatttatattaaaggatgaagaaggacgtctcacgggtgtcagtacttcaaatcttctaattgccaactccagaaatgatttacctttgttggcctatgatgccagttcattgacttgcttctttcttgttttgttcaatggattccatgttattgatcttacaagggtgtcacaagaacttgcataccttgctaatgatgtagatcttgtcatgttagaagggatggtaaaacatcctgaggttgcagaatttcttgggtcatgtttgtatgactgcataaccaaatacgatgaagctctgattcagttcattgatgctgagaccacttcttcagttagggatgcgctggatggaagaagcataccaaggcaaatacctgcttccagcccatggaggttcttgtaa

SEQ ID NO: 42662 - DNA, 162 bp, Glycine max
  Peptide Sequence Number=SeqID_134347
atggatccttcctcctccacttcttctcataactctgatttagattggcccattgccctcaggaaaggtaagaaaactgttggttgtagatgggtctatactattaaagttgggcccaatggtggtgttgatcggcttaaggctcggttagtagctaaatga

SEQ ID NO: 42663 - DNA, 675 bp, Glycine max
  Peptide Sequence Number=SeqID_134348
atggctacgatcggacacaacaatctcaatgccaaattggttcttctcggggacatgggtgctgggaaatccagcctcgttttgcgctttgtcaagggtcaatttctcgaatttcaggaatcaacaataggggcagcgttcttttcacagacgctggcagtaaatgatgcgacagtgaagtttgagatttgggacacagcaggacaagagaggtaccatagcttggctcccatgtattacagaggcgctgctgctgctatcattgtctatgacatcactagctcgttatcatgggatatggaaaaaattgcagcttgtttgtactggctgcttggtctcaaaatcatgatgggaatggactcctttacccgagctaagaagtgggtccaagagcttcaaaaacaagggaatcctaatatggtcatggctcttgctggtaacaaagctgatttggaagacaagaggaaagtgacagctgaagaagcacgtgtatatgctgaagaaaatggtttgtttttcatggagacctctgccaaaactgcatccaacgtgaatgatatattctatgaaatagccaagaggttaccaagggctcagccagctcagaacccagcaggaatggttcttgttgacagacccgccgaaggaactagggctgcatcatgttgttcataa

SEQ ID NO: 42664 - DNA, 348 bp, Glycine max
  Peptide Sequence Number=SeqID_134349
atgatattaagatattggcagctagaaacctccacaaaatgtgcacatatataccctttaacaagtctacaagaacagatcggggaaattgaggagaatgtcatgcttccaacctttgctgaaggcagatcgaagaaattgaggtttgggaagagagggtcagtggtagtggtgatcacgacatggttgtggcagtcgttggtgatcacgacatggttgtggaaaaaatttattttgagaagaattcggcgaaggagagggcctcggggcctcgaaggagtgatcgttggtggcgaagcggcggttcatggagtcggcaatcacagtaacgttgggaaggaaaattga

SEQ ID NO: 42665 - DNA, 579 bp, Glycine max
  Peptide Sequence Number=SeqID_134350
atgtcacaacaaacactaacactaacgattcttctatttacactccttagtcttacttcttcaccagccacttgtttatactcttctccttcaccccccgccgcgtcattttccgaaactacccccgatcccgaacctcgcgccgaagaatggttacccgcccaagcaactcactacgccgccaccgacgcggtcggcggcgcgtgcggatacggcgacctccttaacggcggttatggcatggccaccgccgctctcagcgaggctctcttcgggcgcggccagatctgcggcgcctgcttcgagctccggtgccgcgaggaggactccgactttgaccggcggtggtgcatctccggcacgacggtggccgtcaccgccacaaatttctgcgccccgaactacggctccgacgcggagagcgtgggaggacattgcaaccctccgaagcagcatttcgtggttccaattgaagcattcgagaaaatggcaatctggaaaactggcactggcaacatgcccgtggagtatcgcaggttctccttcacgcactcttggtgttatcatatagtcatatag

SEQ ID NO: 42666 - DNA, 387 bp, Glycine max
  Peptide Sequence Number=SeqID_134351
atgagggtgcagttgcactctcgaagaggaagaacagcgctgcttcgaaattccttgacctctctcttcaaaattgtttcgagtttcatggtacttggccacccaactgagacatccaggaatctcctttcggaatccacaacacttgaactaattggggagcgagctccaaccgaacaggtgcggagctcgaacagacgaagaagaggcgcgacagtcctccgatggagagatccagaagcggcgggcgacggtggggcaggggacttcgtgtgtgaggcgagagagggtgaaaatggaggtgaaagcggcggaaataggcttcgcgatgcggcggagagaggttattcgtcgtttctagattacaatagaaaacaaaaagtgtaa

SEQ ID NO: 42667 - DNA, 531 bp, Glycine max
  Peptide Sequence Number=SeqID_134352
atgtggctggggtgcaatctatcccattgcaatctatcccactgcttgtcagttgaacatagcagcatacaaggttgtctacccaaaacaaatcgtagggcattcaatgttgggtgctttattgtagaagcaaagcttcatgatgaatcaagattgattcaaagatgttatgatgataacaaagatgatgacaaaaagctcaaaggtcaatcaaagaatgagttcaagatgttcaagatagaatcaagaacacttcaagattcaagaggaaagttgaagaacactttaagattcaagaggaaagttgatttcaagaatcaagaatcaagattcaaggatcaagcttccaagaatcaagatcaagattcaagactcaagattcaagaatcaagagaagacttaatcaagataagtatgaaaaggttttttcaaaaactgagtagcacatggatttttctcaaaacatgtttaccaaagagtttttactctctggtaatcaattaccagattattgtaatcgattaccagtag

SEQ ID NO: 42668 - DNA, 1257 bp, Glycine max
  Peptide Sequence Number=SeqID_134353
atgagatgggtagtggttgaacaaagcaagaggtacctcattcagctcatggattcagctccttctagttcttggctgcaagccttctccttcttagcattggtttggttatttaactgtggatgtgtccatggagcctccccagcagtgaaagtaggtaacttttcaaaggtggaagatgctggaaacttccacatctactatggccagaccttcaaagtcattaagaattctgctgatggccagagctaccttcttctccagcctactcaattttcttccatcaattctggcagaataattcaaggattgcatcaaggactaaatattgcacatcaagaatcaaatcatttgtcattccattgtcaaactattctgttgatacaactttttttccggcttttaggtttagtggagagcttgaaaggcataacctcagactatgtggcttctccatgtgtgttgaaactgtatcaaggaggacagctagaaatgttcaataatagtgattaccaaaagcttgcagagttctcttcatactttcttagtgacactgatcagcagccagcttgcaattttgcaacttttgttccatttatggaagatactcctttgcagagagcagaatggatcaaattcatgggagcttttgcaaatgttgaagctagagccaatcaagtctatacagcagttaaggtgaactatttgtgcttggctaaagttgccacaactaggacaacattcaagccaacggtagcttggatgaggtataaaaatgaaaagtatcaattgaagtacgtgcaagatgcaggcggagagattttgggtgccaacaaaaacacttacaatgtctctgatcctgatgacttggaggaatttcatgccatcctatgtactgcggaagtagtcattgatgaaacactaacatctgatccagtcaactacaccatgtcagcatttatccaaaatctaaatgttgaagatcgttcttgtttttcctttatttcaaacacaagtctatggagatatgacaaaagggtttataattctgtagctcttgactggtataatggagctgtgtcccaacctcaattggcactagcagatcttattgaagttttatttcccactggaaattacacaatgacatattttaggaacattgcaaagggagaagtacctataaacattggtcccgaaatgtgtgatagggacacatccacagcaatggagcctaccatagtagcatgtggatga

SEQ ID NO: 42669 - DNA, 612 bp, Glycine max
  Peptide Sequence Number=SeqID_134354
atggcttgtcacattgatgaggacatgaccaagagcaagggcaaggatccacttgaaggacttggaggacctaagacaagggctagagcaaggaaagccaaggaagctcttcaacaagtgttgtccatactatttgaatacaagcccaagtttcaaggagtaaagtccaagggcccaattggcaacctaggcatcagccttttgggagaccaaatggtggctgacttgttggctgttgggggtttaatcctagacgatcctaagtcagcccttgtgccatgtgggttcatatcacacattcaggatctggttaatgtcaatgcaaaacatgttagagtggttaagaatcctttagacttcttctacaaggcttcagacctcaaaactaatgagacctctcactttggtatgatagatggactaccaaaggcattatttataaacaacttggtgatgttgagattcaattacaagatgttgatcacgctaaaggacttgcaaaattgtggtaattgtaattgggataaggtgtggttatttgtaggagtttatcctacatcttcttcttctttgcctgaaggctactcagatttggaatcttctccagcttga

SEQ ID NO: 42670 - DNA, 462 bp, Glycine max
  Peptide Sequence Number=SeqID_134355
atgcagaatcgatgtgttaacatgatagctcatcttttcaatgcaccactagaagagactgaggctgcagttggtgttggcacggttggctcatcagaggccataatgttagctggattggcattcaaaagaaagtggcaaaacagaaggaaacaagagggaaaaccttttgacaaacccaacattgtcactggagccaacgttcaggtttgctgggagaaatttgcaaggtactttgaggtggagttgaaggaggtgaagctccgtgatgattactatgtgatggaccctgaaaaggccgtggaattggtggatgagaacactatttgtgttgctgctatccttggttcaacactaaatggagaatttgaagatgtcaaacgcttaaatgatctcctaattgaaaagaataaaataactgggtgtgtctctgccttcctccctctagctccctttacttaa

SEQ ID NO: 42671 - DNA, 393 bp, Glycine max
  Peptide Sequence Number=SeqID_134356
atggtgggttacacaccttcaagctttgcggatttggtcttcgtcgacgaaaggatcaaagtgggtctggaaaaaggcaaatctgatcatcctgctttgatgaatgtgaaaactggggcaaatgaagaggatgagaatgagggagaaacccttgctatgactgccattcctacacgatcaaatttcccatcagcccaacaatgtcattactcagccaataacagtccctctcacccaatcatccacaaaagtcatccccaaatcagccacaaggcctgcctgcttaccacatgcccagggttcctcaacctccatttttctgaggatacgactcgaacgcaacatgtgcatatcatggaggagttccgggacattccattgagcactgtatga

SEQ ID NO: 42672 - DNA, 252 bp, Glycine max
  Peptide Sequence Number=SeqID_134357
atgaatgttgaaaacctatctggattacaccaccacccacacccacacccacctccacctccacctccacccccacctccccaagacatgatgtgtgggaccgggttgatcaaatggtctgtgattgatgaaggaaccaaccaacatcattggaatggtatagggtctgcaccgaatatactaagtttgatagcacaagctattccatattctccaccatacattcttgtcaacctgacaaccaataaatga

SEQ ID NO: 42673 - DNA, 702 bp, Glycine max
  Peptide Sequence Number=SeqID_134358
atggcaattgctaatgctccaatgtatatagctgtaacaaaagcaaagaaaagagccaggaatcctcctgcagctgccaaagatatcagcagcgatatgacaatggcatttatggttgcagctagaaagaaaagcataaatacaagcaatgacgaagagcgggcggaagggagtgccgcggcgagtccagaggagaacgtcgcgggcggagtttttggaagcttcgggaaggagaggagcgtggtcggcgacggagagtttgatccggcgaagttccgggaagagaatggcggaggcgatgcggttaaggacctccggcaaggtttctttcactctttgcgttttctgcttcaactttactacttcttgttcttcttcatcgacgtagacgccgttgccgttggaagtctctgccattttcagttgcaggaagcggagaaaaagccaaagaagagaaggtgcaaaaagctactgatgaactcgcttagcgaggcaaattggctaagcaagcctcatccgcttagtgaggcagccagctggcttagcggatgggaaaccctagaagaggataagtcagagatctgcatgctcaacgcgcagcaagcttgcccagcgaggacattgtctcttcttgcgcttagtgcccccaagctcactaagcgaattttcacttaccctggctcagcgagacatgctcgctaa

SEQ ID NO: 42674 - DNA, 1122 bp, Glycine max
  Peptide Sequence Number=SeqID_134359
atggttggagcatttttgcaaaatagcgcgaccctaactggtctccctatgattttacttagtaagagtaatctgacatactcattttgtgatgaatgtgataactcactccccgcgtgttgtttgtgtttggatcctgtgatgatcttgaactttgtgttcaagggagcagatgactacgtgaattgctttaaggaaccttgtgctgaaggactagagggtgtcaccggtctcgaaggcgacgaggaggtcggggtcagccttagagtggatgagggagtcgtggacctgtgcactgacgatgagtcagttttgctcgacgccagagatgccagtgctcaagcggttggcgaggatgtcaattcggccaatgattttgaggatgccgaattgggagggaaggggcatcaggggagggcagaagggctggtagacttgatgctgcagcggcagaggctgttagggcttcttgaaggaaaacgagttaaggacgatggagatgggtttcacgaaggtgcaggggtttgtgcgtggaggatgaggtcgccatcgttgtgggatggtgaagtaggtggcgtgatgtactggacgaggtcacaatcgtcacgggtaaaggaggtgtcgttacggtgcaagtatgcttgtgaggaaggtgttatcgcaggtcttaagactatgattagtctaagggaggccataagacccacctcaaggctcctcctcggttcccaaaaccctaccacttttctcctccgaaccatcgtctccaagcctgagcttcggaatcccgaagccagcgccgcacagccggagcagccgccggcgcccgatctcccgccgcggactccgctcgccggcgcccgcgtccacttctcgaaccccgaggacgccatcgaggtgttcgtggatggctaccccgtgaaaatcccgaaaggaatgaccgttcttcaggcctgcgaggtcgccggcgtcgacatcccgaggttctgctaccacagcagactctccatcgccggaaactgccgcatgtgcctcgtcgaggtcgagaaatcgcccaaacctgtcgcctcttgcgccatgcccgctctccctggtcagcctcttcaatttcctgattttggt

SEQ ID NO: 42675 - DNA, 201 bp, Glycine max
  Peptide Sequence Number=SeqID_134360
atgaaggatttccggagccagcacaaggataaaggattagggattggtgaagagggaaatacggtggatgcaaggggtgttgcacgtgtttcggtgaaaaatggaatggataaggagaatgaagaaggtggttggaagaatcgctcctccagaattggtgtcacacacaaggttgtgttccttgataaaccaatttcttga

SEQ ID NO: 42676 - DNA, 1461 bp, Glycine max
  Peptide Sequence Number=SeqID_134361
atgcctccatcatcactgttttcaaacatgcatttcttgttcttttttcttctctcctccatacacctctctgtacaactcaaccacaccaccaccaccactaacaactcaacctcattattctcactctctttccctctcacatcactctccctctccaccaacaccgctctcaagatgatgctacgcaactcactcattgcaaacacaaacaacaacaacacacaacttaaatcaccaccttcttctccttacaactacaagttgtctttcaaatactccatggctttaatcgtggaccttcccattggtaccccaccgcaggtccagcccatggtgttggacaccggaagccagctctcgtggattcagtgtcacaaaaaagcacccgcgaagcctcccccaacggcgtcgtttgacccttctctctcctctaccttttctacccttccgtgtactcaccctgtctgcaagccccgaattcccgattttaccctccccacctcctgcgaccagaaccgcctctgccactactcctacttctacgccgacggcacttacgccgagggcaatctcgtcagagaaaaattcactttttcgcgttccctttttaccccccctctcatcctcggctgcgccaccgagtccaccgaccccaggggcattttgggaatgaaccgtggacgcctctccttcgcttcccagtccaaaattacaaaattctcctactgtgtccccacccgcgtgacccgacctgggtacactccaaccgggtcgttctaccttggccacaacccgaattccaacacgtttcggtacatcgaaatgttgacttttgctcggagtcaacgcatgccgaatctcgatcctttggcctacactgtagccttacaggggataagaatcggaggaagaaaactcaacatctcgccggcggtttttcgtgccgatgctggtgggtcgggtcaaaccatgcttgactccggatccgagtttacttaccttgttaacgaggcttatgataaagtgcgggctgaagtagttagggctgtgggccccaggatgaagaagggttacgtgtacggtggtgttgcggacatgtgtttcgatgggaatgcgattgagatcggacggctaataggggacatggtgtttgagttcgagaagggggtgcaaatagtggttcccaaggagagggttctggctaccgtggagggtggggttcactgcatcgggattgcgaactctgataaattgggtgcggccagtaacattattgggaatttccatcagcagaatctgtgggtggagtttgatctggcatatgatcatgatgatgtggttgaaatccaacggtccaagagcgaggaagaaaaagaaagttctacaactgttgccatgatgacgccaactgcttttggaagatgtgtgaaggcacacaagttatatcttgtacactga

SEQ ID NO: 42677 - DNA, 1431 bp, Glycine max
  Peptide Sequence Number=SeqID_134362
caacaacaaagtcttatcccactaggtgaggttggatacatgaatcacacggctaaagatcagcttgctgatgttttcacaaaatctttgtgggaacctagcataatggttggggttgctgttcacaaccttgggcagttctaccttggacagcggaagttggaagaagctcgtgttagctatgagtcagaatgtcattgttcattggtgacttatttttctctttgctgcttttccgaagttggaatttttgctcaaatgaggattttattctacaataattgtgttcaggtactgtatcttcaaggaaaagaaagggatgctgaggcccttattaaggactctataaggatgctagagggatggtatttcttggacactgttattgcagctgaatctttggctctgaccctgcaagcatctggcaatacaaaagattctaaagagcttcttgaaagatgtcttaatgtccggaaggacttacttcccagtgaccatattcagataggtgcaaacttacttcatctagcaagagtggcaatgcttgattgcagtcaacataaaaagttggatgtttctagagctaaagctgagcttgatatggcaaagaatcatttgtataattccataagggagaaacctggtagaacaatcaactacctcaccgcagtgagccattatgctttcaacctccttggacctgcttcgaaaggaaggccaagtagcactggccatattggtcagtccccctccccggattgttacactcctcttatgcatttgcaatcactctatacgttgtcatcagtggagttagataagcaagaattgcaggagattcaggaaagagataatattaacatcgaggctcaggaggcacttcttcaatgcatttctacttacaaggagaattctgatcacatcgatcttgttgtgcaccacaagggtagattcaacaaggatgatatgacacattggaatatgtggacggtgagttctgtgtttgggagaattatgaaagatgacagtggtgtgcctgataaggttgtggtgaatcaaactgaggatgaagttcaagatattgatgttgatcttgacaaggaaattgaaaggattgttaaccaaattcagaatcaagatgagattgattgttctcaatttgcatccactgcagaacaacctccaacagtgtcaatggttgactctggaggtcaacctaagcctataacagtgcaaacaagtcttctaccacaagaaccaaatttcgtgtctgttcagccaacacctacatttaggcctcttctaactaggcctactgcacctatcaggataccattcctagctggaccttcaccaaggatgataaaacctaacttcatgagcttcattctcagaccagggatgccacaaagggaaaacaagaagaagtga

SEQ ID NO: 42678 - DNA, 249 bp, Glycine max
  Peptide Sequence Number=SeqID_134363
cactagcaccacaacacaaaaacttagagataagtggactgaagaagatagaagaagaatccagtatgatcttaaagccaaaaacatcattacttcagccctaggaatagatgagtattttagagtgacaaactgcacaaataccaaggagatatatttggcaccctttgttgcacaatatgtgaagtcccgagacgtgccgaaaatcaaaaggaagcaggcttacgcgatccgtgaaaatttcatgat

SEQ ID NO: 42679 - DNA, 90 bp, Glycine max
  Peptide Sequence Number=SeqID_134364
atgggttttcagaccttaccttacttcaacttcccaaacaccactaatatgttatttggggcctccagtaaaggagttgttggagagtag

SEQ ID NO: 42680 - DNA, 511 bp, Glycine max
  Peptide Sequence Number=SeqID_134365
gtgaggacgtgcggccctctaaaggcgaggacgtgtagtcctctaaaggtgagggcgtgtagtcatttgaaggcgaggacgtgtagccctctgaaggcgagggcgtgcagtcctctgaaagcgagggtctgtagccctctgaaggcgagggcctgcagccctctgaaggcgaggacttgtagtcctctgaaggcgaggacgtgtagtcctctaaaggtgagggcatgtagccctatgaaggcgagggcgtgcaaccctctaaaggagagggcgtatagtcctctgaaggcaaggacatgtagtcctctgaaggcgaggatgtgtagtcctctgaaggcgaggacgtgtagccctctgaaggcgagggcgtgtagccctttaaaggcgaggacatgcaaccctctgaaggtgaggatgtgcagtcctcttaaggcgaggacatgtaaccctctgaaggtgaggacgtgcagtcctctgaaggcgagggcgtgcaaccctcttaaggcgatag

SEQ ID NO: 42681 - DNA, 345 bp, Glycine max
  Peptide Sequence Number=SeqID_134366
atgaagaggaaaagcctgaagtctccatactctagaatatccctccttggccactatggctatgttggagggaaagataaaggtagattggaactcagtgtggaggatcaaaagatctcttttgacctctttgaggccatgaaacactcagacatcggtgatgcctgtttcgaaaaaagaataggtggagaaggaaatggcactgttagcctcaaccatgcttgtgatgaagagctcgatgattcaaaagacagttgtgttgaccaggtggtttttgaagaattggaaaaattgagaccaacagaaaagcccaaagcagaattaaagacctttccagcacattga

SEQ ID NO: 42682 - DNA, 365 bp, Glycine max
  Peptide Sequence Number=SeqID_134367
atgtacatcaagtatggcccaaaatacatcatgaagcatagccaacaaaacaagttatccaatgaaacaaaaaccccccacacttattcccaaaacaattccaaagctccaaaattccttaaggatatggtgagcttcaaaacaaggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaagcaatcaatggagcaaacacaccaaatgattatgatgatggatggctcaaattctcacaaag

SEQ ID NO: 42683 - DNA, 397 bp, Glycine max
  Peptide Sequence Number=SeqID_134368
atgattgagtctcaaaaactcaactatgttagacaacatcaacaggaactcagagttgacaagtacatgaatttgaatgcatgcaataatgatcccgaaacacatggcaatgagaaaggaaagagaattataccgccgagctcctttgttggttgtcgtaggtatatggaacaactatattttgatggtatggaaatttgtggccatattggatttccagacctgttcttgacattaacatgtaatccagcatggcaaaaaattcaacgaaaagttaggaaatgcaatctaagacatgatgattgccctgatgttgtctcacgaatatccaaaatgaagctcagtcatttgatgaatgatctcaaaagtggacatgcctttggtcccattgttggat

SEQ ID NO: 42684 - DNA, 153 bp, Glycine max
  Peptide Sequence Number=SeqID_134369
atgaatttgaactcaagtccaaacgattcaaatattttagattcaagcagaaggactaatctctccactcaactccctatagggagagcccgcagtgaacccctggccatgtacagcaatccgatttgtcagaccatgatgaaagctgtttga

SEQ ID NO: 42685 - DNA, 201 bp, Glycine max
  Peptide Sequence Number=SeqID_134370
atggaggttgatgggggttggctggggttgttgcaacgtgcccttcgcgggcgagcgaaggcgaggctcacgggtgcgctttccaaaggaggaaagatgcgcggagtcgccaccaacgtttatttgtggaaaacgtcggaaaaaccaaaggaaactggtcaaaatgaaaattctaagttcaggagttgtatatacgcttga

SEQ ID NO: 42686 - DNA, 661 bp, Glycine max
  Peptide Sequence Number=SeqID_134371
gggttgtattaactacaatcccgcacttgctataagacagttagggtacaccatgaggggagcaccgacggaagagagcctctctcctttccttgtgagagatttcgggttagattggctctccaagttaaagattatcgacgaagagaacttcgaagctccagaagaggatgaagaaacgttcggaaagagtgtgctgggttacaagaagaaaatgcagctaccgcaagagcccttgaacaagaaaccaagagggctcgcaaggaagagcatggtcgtgacaaatttcgtggagctttgtggggcagcaacaatgagctcaagcttcgaagggaaagagagagaccaatcacgagcacatagcatggtcttaaaagacgagttagctgcttgcttaaagtccaagagaagcttgtctcaacgtttatgcgaaacagagaccaacatgttagccattgtcagcaagtaccaagaagaactaaatctagccacggcccacgagcataaagtggtggacaagtatgcccaagtgtacacggaaaaggaggctagaggaagggtgatcgacgcgttacatcaagaggcaacaatgtggatggaccgatttgctcttactttgaacgggagtcgagaacttccccgattgctagccaaggcctaa

SEQ ID NO: 42687 - DNA, 963 bp, Glycine max
  Peptide Sequence Number=SeqID_134372
atggctaagtttgaccctgaggtagtcctggagttttatgctaatgcttggcccacagaggagggagtgcgagatgtgcgttcatgggtaaggggtcagtggattccctttgacgcagatgccctcagccagttcttgggtgatctgctagtgttggaggaaggccagcagtgcgagttcagccagaggaggaacagggccgacgggttcgacgaggaggccattgcccagctgttatgcacactggggcaggatttcacccggaccgctgcaaggaggcgggtgcggatcatgcacaccagcatgaccactttgacccagacgtggatgacattgctgctcagcaatgtcttgcctagcgatcaaaactccgatctccctctggcgaagtgccaattggtgtatgccatcttgacacggatgagtgtccatgtggcccaggtgattgttgacgccatctatttgtttgcaggtatgccacccaccaagcaccctctagacccggataagtctagcagggccctgggatttccagcattgatcacgggcctctgccagtcgttcggggttcccgtcacccccactaaggtgatccgaccgccgatcaccaaggccttcatcgagaagtattgcacgcctaggcaggcgcagggtgatgcacctcaggccgcagacgcaccgccaccacctcatcaggccgatcccgctggatcactaggcatggagcgttatctatacacttggttcgccagcaggcggccaaccaccgggggcaggtgcagatacatgagtgtctctaccggttcagcctcagtcaacaggggcagggtttcgctccttttgcatgccctactccatagcagtttggggctgaggtcgcatggcccagagattaacccgaggcccaggcaggggaggagcccgcaggatcccctggtgaggcagagaggttcgtatggatga

SEQ ID NO: 42688 - DNA, 774 bp, Glycine max
  Peptide Sequence Number=SeqID_134373
atggcttccagaaagagaaagagtattggaagacatatattgcctgaaaggaaggtaaagatatatcactctgagctagatgagtttaaggctgaattggagaggcgtaatttccataaacgcctcaccaatttagtcgatgggagcatagacctagctttggtgaaagaattctatgtaaatttatacagttctgaggaccatccaccaaagcagtccagagtcagaggtcatttggtgaagattgatgttgacagtctcaacacattcttggagacacctatggtattagctgagggggagaccttacctgcttactccaatactgcagggccatcctgggaagattctcaggaaggatctgactacactagctcaggagcgctgatctctggccagatgaccactatagcccagtctaacacttctagacttgtgttccctactctaatcgtcgcattatgtagagccagaggggttgtctctgatagcctcacttttgagcgcctaagcccggtcattaacttggcctacatcaagaagaactgttggaaccccaaggatctaacagtttctattcgaggggctaggaggggcgaggctcctactccagcatccacttcagcagctccttctgtcccagctcagacagattctcagcactttgcagccatgcttcaaagcattcatcagggacatatcattttattacagagtttacaggtggtggcacctccaggatctattccttcaactgagcagtttagggagatg

SEQ ID NO: 42689 - DNA, 165 bp, Glycine max
  Peptide Sequence Number=SeqID_134374
tccagggcagaggtcgcatggcccagagattggcctgaggcctgggcaggagaggcaccagcagagggcacccagcagaggctcccgacgaggcagatgaggccccacgaggacgaagagatgaccgatttacttgatttcttaggagggagcggggccacatga

SEQ ID NO: 42690 - DNA, 270 bp, Glycine max
  Peptide Sequence Number=SeqID_134375
atgaaggatctagacatgggtgactcagacaaatgttggttgtacgtcgaagaaaatcctccccacctggttgccacaggaagactttatgaggggtccacaaccgttcacaacattcctttgcaccatgatcaagtcaaggtcgatgctgaggaagttacagatgcagatgctcacattcttgtacccactgaagaggctaaggagcagtgggactggcaaaacctgcagataggtcggatcatgatgttgatgatcccctatatctga

SEQ ID NO: 42691 - DNA, 216 bp, Glycine max
  Peptide Sequence Number=SeqID_134376
atgtcgagacagctccaaattgagaacagaagctctgaggaaaatccgaacgacaataactttttactcggatgtccgagtgaatcccgtaatagtatcgagatgctcctatatgaaaacggaagctctgagcaaattctagcgacaataactttttctcggatgtccgattgtctcgaatatcgagactctcgaaattcagaacagaagctctga

SEQ ID NO: 42692 - DNA, 381 bp, Glycine max
  Peptide Sequence Number=SeqID_134377
atggcgttcatgtttctatcagctgttcctcctgttgtactgaaacggggtgtgttatccgctcaaattcggcacaaagcaccagccggaacatcagcgctggcaagtgtaagccggtcaaacgtgacgcgtaaccaccacacccgcttaattgcgttgccgctacaggctgcccctttccagtcaggaacctgtcgtgccaactgtatgaggaacgcgcgggcgatcgagtgcgggtttgcgctattacccagcggcgaaagggcggatgtgtatacggcattaatgttggctgtgcagggtgtcccaggaagtgagagggccgcggcaaagccgtttttccataggctccgcccccctgacaagcatcacgaaatctga

SEQ ID NO: 42693 - DNA, 222 bp, Glycine max
  Peptide Sequence Number=SeqID_134378
atgatgacaaaggtgatgaacaaaaagctcaaaagatcaaagaacaactcaagtgaatcaagaacaagtcaagagttcaagaatcaagaagaattcaaaactcaagaagaaagactacaatcaagaatcaagattcaagattcaagatctcaagaatcaagatcaagattcaagactcaagattcaagaatgaagaaaggactccatcaagataagtattaa

SEQ ID NO: 42694 - DNA, 345 bp, Glycine max
  Peptide Sequence Number=SeqID_134379
atgagtcatctttcatctagtgttaatggtgagggtactagtcataagaacactctatctaaaatcttagatgagttgagttccctcaagttctggaaagaaaaactagaaagaaaacaaaaaggaaaagagagggtagaaataaatcaagatgagagggaacaaataagcgaagaacaaagaaagaacacactaaaagaattaagaaaagaaaaatatgtctcatatagtagtcatgacccttgcaagagcctaagtgaagaactttgtgactattatgaaggaaggcataggtcacatcttagaccccactcccataagatagaaaaggaaagaaagccttaa

SEQ ID NO: 42695 - DNA, 402 bp, Glycine max
  Peptide Sequence Number=SeqID_134380
atgaagaaagctggagttgctgcacatgatgtccaacgttatgtcaaggaatcagattgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatccacgatccaccttgatgttactctaacatcaagtgttggacctgaatgtgtagagttgatctctattgttcagagagcaatctctggtgcacgggtaagtggtagacagggggagcagaagcagaaagctgatgtcacgagagatgtcttgacatcctggaaacgatttgcaacttaccaattccgctgtgcttga

SEQ ID NO: 42696 - DNA, 327 bp, Glycine max
  Peptide Sequence Number=SeqID_134381
atggtggcccgagtaatgttggggaatggctacgagcccggaatgggtttaggcaaggacaatggcggcataactagcctgataagtgccaaaggaaatcatgggaagtttgggttaggctacaaacccacacaggcatatataaggaaaagcattgcggaaaggaaaagcggaagtcaaggctcacgattaagacatgaagacgaaggaagcccgccctgccacataagtaggagctttataagcgcgggtctaggagatgaagcccaagtcattgcaatatgcgaagatgatgctctgagtgggtcgaatttggtacgtccatga

SEQ ID NO: 42697 - DNA, 218 bp, Glycine max
  Peptide Sequence Number=SeqID_134382
gtatcttcgcgtatcatgggtgcagaatgaccaaacttggtctctgcgtgccatcggacacgactgtgtctgaatggcaaaggggtgcggataaccgtaaggtatctccgcgtatcatgggtcagtatgacaaagattgtggggcggccgacaaaagcaaagctcttgctcctacgtatcctccaatgaggaactcagacctacgtagttctggataa

SEQ ID NO: 42698 - DNA, 1416 bp, Glycine max
  Peptide Sequence Number=SeqID_134383
atggaacccctccaaatgcaagccttccgcaagacttacggaaagatcttagagttgaccatagcagaggtgtccatagaagccattgcatcacttacccaatactacgaccagcctttgagatgcttcacattcggggacttccaattagtaccaaccattgaagaatttgaggaaattctaggatgtcctctcgggggaagaaaaccatatctttcctccgggtgtctcccctctttgagcagaattgcaactgtggtcaaggattcagccagaggtttggaccgcataaaacagactcggaacggcatagcgggcctgccacagaagtacctagaagacaaggcgaggggtatggccaatcaaggagactgggtcccgtttatggatgtgttagctttgctaatttttggggtcgtcctctttccaaacgtggatgatttgatagacctagcagcaatcgacgctttccttgcctaccaccatagcaaggaaagtccggtggtagctgtcttggcagatctatttgacacatttgaccgaaggtgcgagaagagtagcgcacggatcatctgttgcttacccgccctctgtgtttggttggtttcacacttgttccaacaagacacaagacatccatgtccgctcctgagccatcgctcgtgtactgaaaagaggagaatggattgggaccagctcttggccgggataggaggtagaacaatcagttggttcccccgatggaaggaagaagacaaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatgcaatggttttgaaagaggagttagttgcctgttcaaggtccaaaagaagcttgtctcagcgtttatgcgagacggagaccaacatgctagctatcatcgccaagtaccaagaagagttaggtctagccccggcccacgagcataggattgcggacgaatatgcccaagtatacgcggaaaaagaggctagaggaagggtgatcgactctttacaccaagaggcaaccatgtggatggaccggtttgctcttaccttgaacgggagtcaagaacttccccgcttgttagccaaggccaaggcgatggcagacacctactccgcccccgaagagattcatgggcttctcggctattgtcagcatatgatagacttaatggcccacataattagaaatcgttag

SEQ ID NO: 42699 - DNA, 1119 bp, Glycine max
  Peptide Sequence Number=SeqID_134384
atgcaagaagaagaggaaagacctcttataagagaaagaaagttacctgcgacttcgaccaagtctgctgaacaaacagaggcaggcaatttccaggctcaaatgcctaagaagaaaaagaaaatgaagcaggtcgagcctgaaccttctgtggctgttgagggtggtgagccaatcaagaagaaaaagaaaaagaccaagccttcaaaagaacaaggtgacaatcaacctgttgacgtccaaccaccttcgaccgatattgacggcactgaagtagaggctactccttctattgctgagatgggcaaccctgtcgatcaaccggactcaccacaagaacaacctgccgtcgaggtacaacaaaatgtttctgtagaagaaataccctcacatgctcgaacatctcccgctcctgagacggatgcagtgaatgttgaggaacagggtgaaggtcaaggcattggatccagcagtcctcatggatcgagtcagaaaagttcatccgaagaaaactttttcgatgaagaggccataaaagaggctgaagctggaggttcggacatttacccggcgtcttcaacatctaagctttccgctagcatagggatcgcagaagatacattcatccaaatgcaagacgaagaccctgctgcagcccttcgactcctgctgaacacaagtcaagccaacacctcaagtgaaaaggttcctggtgcttcatcctcatctgatgccgaaataaactctttaaaattgcacaaccccctcacctctgatgagattctaggcaaagttatccaaatcgaggccatcattgaccaatttgcaagtactgtgcagaaaaaacgtgaaaatagcgccagactggatgcccagaaacaggcacatatccttctgctcgagaaagcccgagctgctcaacatgaagtcgaacgtctcaccaaagaggcgaaagaaggatcttctgaaatcaaagcctgtgatgataacatctcctcctgggaggcaactattacgaatttgctgtctcaggtcgatgatctaaggcagaaaattgtaacagagcaggccaaacgcaaagaactccaggagaaggccgctaactcgattcagaaactg

SEQ ID NO: 42700 - DNA, 345 bp, Glycine max
  Peptide Sequence Number=SeqID_134385
atgcttccatttgatttccggtgtgtcacggaaacttacggattgtgcatcaatatttttttggtttttcggcatgtcctggaatttcacaaattgcctaatgatggatgccaagctcctcacaaggaccaaagaaaggtcgcatgtcatcaagcaaagggcttcgcttctttttcatgccctactccagaccagttcagggcagaggtcgcatggcccggagattggcccgaggcccaagcgggagaggcgcccccagaagctcccggcgatggagaagaggcccacgaggacgaggagatggccgatttgcttgacttcttgggagggagtggagatacatga

SEQ ID NO: 42701 - DNA, 548 bp, Glycine max
  Peptide Sequence Number=SeqID_134386
atggagttcttctcaaatgagaattttgaatactttcaagcatttgaaaactccaatcttattccattcatgtctctgaaattacctgtttattctgaactagtcaaaactttcaattctaatttagaaatccatgaaggtaccctaatgtctgaggtttatgggattaagatggtcattgaccaatccctattttatgatttaacaaaattgcctagtgaaggtgtgccttttgagggtgcactgattgatgattggaaattcgatttttctgtgcatgatgtccgctggttagtttgcaccaaccaagcagatatgaccggaaggcttcttgccggttcattggcttttgaaagccgcatcctccattaccttattgttcgcattttgcttcctagatcttcaaaccttgcccaggagcatgatggctcttggataaagaagggtgctagaaatgttggtgaagaaggacatgagggagaagattcatctcttctttcaaagattttggaaaagtttgatggtcttcaaacctttgttggtgagag

SEQ ID NO: 42702 - DNA, 518 bp, Glycine max
  Peptide Sequence Number=SeqID_134387
atgactatagacaatccatctgacttacaaccctttgatcctgagatagataggacatttcatagattagttaggcatcttgttgtaccttttgagcatcctaagcattctgttattggtgagtctgagcattttgtggttggtaattttgaacatcctgattttgagcattatagttttgaacattttgattttgaacattctgagaacatggcacaacctccaccccgtgagaggactctaagggaaatggttgcacctgatttcacttacgaaagcttgtgcatccaataccctgatgaggatgtcccatatgttcttaaaactagactgatccatttgcttccaaagtttcatggccttgcaagtgaagacccgcacaaacatctgaaagaattccatattgtctgctccaccatgaaacccccagatgtccaagaggatcacatatttctgaaggcttttcctcattctttagaaggagtggcaaaggactggctatattaccttgctccaag

SEQ ID NO: 42703 - DNA, 96 bp, Glycine max
  Peptide Sequence Number=SeqID_134388
atgaaaatcacgtcttctccttaccgcaagcaaacctccatgtcgccgcctccgtttcctcctttgcagtggtacccattacccaatgccatttga

SEQ ID NO: 42704 - DNA, 441 bp, Glycine max
  Peptide Sequence Number=SeqID_134389
aggggtgcacgccctcacctccagaggactacatgtcctcgccttgagagggctgcacgccctcaccttgggtactagttaccctcaccgtcagaggactacacgtcctcaccttgagaggaatacacgtcctcaccatgagggagttcccggagagatttgcaaaaaagataggataagaggactacacgtcctcgccttgagaggactacacgtcctcaccatcagagggctgcacgccctcacctcagaggactacatcgtcctcgccttgagagggcttcacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgg

SEQ ID NO: 42705 - DNA, 240 bp, Glycine max
  Peptide Sequence Number=SeqID_134390
atgtcgcggaacttcacggattgcctaacgatgggtgttaagtacctcgaagcggtcaaaagaaggttgcatgccaccaaacaatggtccctggacgaaattaggggatattgtgtgctagaatttgttgatacaaagaatcagcttgctgatatcttcacgaaacctctccccaaagaaacattcttttccattagaagagaattaggcctcttagatattagtgatttggataaataa

SEQ ID NO: 42706 - DNA, 213 bp, Glycine max
  Peptide Sequence Number=SeqID_134391
atgctacaatgtgagggaattcccaacggtgagaattcgcataatttggttgcaaacgtggcactcaaatttcacgacgctccaacggtgaatgaatccgagattgtcatttttctgagacaggttaggtggcctgcgagaaaaagagagggttttgggagaagagagaaaaaacgaaattgtgaggcagaggaggctgaggagtccgtctga

SEQ ID NO: 42707 - DNA, 231 bp, Glycine max
  Peptide Sequence Number=SeqID_134392
atggtgggttgcacaccttcaagctttgcggatttggtcttcgctggcgaaaggatcaaagtgggtctgaaaagagaggatgagaacgagggagaaatccttgctatgactgccattcctacatggtcaaatttcccatcagcccaacaatgtcattactcagccaatatcagcccttctcattacccaccacctagtcatccacaaaggccgtccctaaatcaaccataa

SEQ ID NO: 42708 - DNA, 915 bp, Glycine max
  Peptide Sequence Number=SeqID_134393
atgaggggagtaccgacggaagaaagcatgtctcctttccttgtgagggacctcggcgcacaaaattccaagactatacaaagaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcaaagagaattttgaagcaccggaagaagacaaagaagtccaagctctcaaaggcgagttaggaaaggcaaaacttgccaaggagaagttcaagttggccgctacacacgttcggaaggagtgtgccgagttacgggaagagaatgcaattaccgcaagagcccttgaacaagagaccaagagggctcgcaaggaagagtatggccggaacaaatttcgcggagctctgtggggtagcaatagtgaactcaagttgcggagggaagaaagagaccagtcgcgagcacgtagcatggttctgaaagaggagttaattgcttgttcaaggtccaaaagaagcttgtctcagcgtttatgcgagacggagaccaacatgctagctatcatcgccaagtaccaagaagagttaggtctagccacggcccacgagcatagaatcgtggatgagtatgctcaagtatatgcggaaaaagaggctagaggaagggtgatcgactctttacaccaagaggcaaccatgtggatggaccggtttgctcttaccttgaatgggagtcaagaacttccccgcttgttagccaaggccaaggcgatggcaaacacctactccacccccgaagagattcatgggcttctcggctattgtcagcatatgatagacttaatggcccacataattagaaatcgttag

SEQ ID NO: 42709 - DNA, 729 bp, Glycine max
  Peptide Sequence Number=SeqID_134394
atgaccagtcctctcaatgagtcaatctcatgctttctcataaatgtggacccttgggtactagaacctattgcctttagaggactacacgtcctcgcctttaaagggctacatgccctcaccttcagagggctgcacgcccttgcctttagaggactacacgtcctcgccttcagaggtttacatgtcctcgcctttagaggactacacgtcctcaccttcagagggctgcacgccctcaccatcagaggactacacgtcctcgcctttgtagggctacaagccctcaccttcagaggactacacgtcctcacctttaaagggctacatgccctcaacttcagagggctgcacgcccttgcctttagaggactacatgtcctcgccttcagaaggctacacgtcctcaccttcaggggacaacacgtccttgccttcagagggctacgcgtcctcgccttcagaaggttacacaccctcaccttcagagggctacacgccctcaccttcaaaggattacacgtcctcaccatcagagggctgcatgccctcgccttcagaaggttgcatgtcctcgccgttagagaactgcatgtgctcgccttcaaaggtcgacacgtcctcgacttcagagggctacacgccctcgcctttagagggctacacgtcctcattttcagtgggctccacatccgcaccttaagagaatttaaggtcctctgcctttaa

SEQ ID NO: 42710 - DNA, 216 bp, Glycine max
  Peptide Sequence Number=SeqID_134395
atggcactcagagttttaggatttctggatagattgagaaggattcgaccatctaaggttgggatgattcctccacccaggattctatctgttgctggaaagattgctgcacagaagggcaaaggtctgtgtggtggtcaacagaggagcataaaccatagagtatggcgacaagtgcagattttttattcatggccaattgggttaccaggttaa

SEQ ID NO: 42711 - DNA, 330 bp, Glycine max
  Peptide Sequence Number=SeqID_134396
atgtgcatgatcagattgaggttgttagctttcaatgagtatgggagcggagttattgacatccttactgggagtgtatgccacattgggtggtgtatagttgggaggcaagccatatggtgggaagccagatgggggcgtcgggttcacctagcaacaacgctggtagcggaaactgcaactgcattggcttccattatcttcttcatgctcatcatggcctccatcattgtggccatttgctctttcatggcgtccatgtcggccttcatctgctcttgcacctcctctacttcacccattactctagctctagcatgggttcggtaa

SEQ ID NO: 42712 - DNA, 294 bp, Glycine max
  Peptide Sequence Number=SeqID_134397
atggtgaaagttggaacctcttacgtgccgatcaacgtctcattttcgccaaaagttggcccagggcttcccggtatttattcggcgcaaagtgcgtcgggtgatgcctgccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 42713 - DNA, 648 bp, Glycine max
  Peptide Sequence Number=SeqID_134398
gccctcaagacagagcttaagaaagcccaaacagttaaagaaaagttcaagtcagcagctgttaggatccgaaaagagaacgccaaactgagagacgtcaatatagccaccaccatagccttagagcaagagaccaagagagcccatagggaagaacatggctggaacaaattccgaggggctctatggggtagtaacagcgagcttaagctccgaagagaagaaagggaccaatcgcgagtagatggcttgattctgaaggacgaattgaagacttgcctaaggtcaaagaggagtttgtctcagcagttatgcgagaccgaaacaaacatgttagccatcatcagcaagtaccaagaagaattaaatttagccaccgcccatgagcacaaagtggcggacgaatacgcccgagtgtacgcagaaaaggaggctaggggaagggtgatttactcgttacatcaagaagcaatgatgtggatggaccggtttgctcttactttgaacgggagtaaaaaacttccccaattgctggcaaaggccaaagcaatggaagacgcctactccgcccccgaggagatccacgggctcctcagctattgtcagcatatgatagacttgatggcccatataattaggagccgttag

SEQ ID NO: 42714 - DNA, 750 bp, Glycine max
  Peptide Sequence Number=SeqID_134399
cttttggccgggataggaggtagaacaatcagttggttcccccgatggaaggaaggaaaagaaggagtccttttctcatctggaggatacccaaacattccgctggtaggaacgaggggttgtattaactacaatcccgcgctcgctataagacaactagggtaccccatgaggggagcaccgacggaagaaagcatgtctcctttccttgcatgggaaaccccgttaaggaaagatcaagaacttataggcattcgtaatggcatcattggtggctaccatgaatggctgaaagttcatatacgaggtttagattggctcgccaagttaaaagtcgtcagcgaagagagttttgaagcaccggaagaggacgaagaagtccaagctctcaaaagcgagttaggaaaggcgaaacttgccaaggagaagttcaagttggccactacacacattcggaaggagtgtgccgggttacgggaagagaatgcaattaccgcaagagcccttgaacaagagaccaagaaggctcgcaaggaagagtatggccggaataaatttcgcggagctctatggggtagcaatagtgaactcaagctgcgaagggaagagagggaccagtcgcgagcacatagcatggttctgaaagaggagttagttgcttgttcaaggtccaaaagaagcttatctcagcgtttatgcgagacggagaccaacatgctagctatcatcgccagtaccaagaagagttag

SEQ ID NO: 42715 - DNA, 222 bp, Glycine max
  Peptide Sequence Number=SeqID_134400
atggtgattttccaccatggagatgcaacggaagataaaggagatgagaagaaggagcttcaccaccaagagagtgccttggataaaaagcttagagaggatgcttcaatggaggaaaagaaagagatagagaaagagagaggggggatcacgaaattgaaggaggaaaagaggaacaatctagtgaagaaatcttccctcaagaagaaggactacctttaa

SEQ ID NO: 42716 - DNA, 204 bp, Glycine max
  Peptide Sequence Number=SeqID_134401
atggctaccattgcgttatcaagtagatatgggagcaagttagcatatgacaccggaatttggggtgaatcctacaggcttttcgctgcaaaattcatttcttggttggtgttttttttggaatggcagtcacagcatggggtttctccctctttctcaccctcttcatttgccccagttttctcagtcgtcctagtaggatga

SEQ ID NO: 42717 - DNA, 945 bp, Glycine max
  Peptide Sequence Number=SeqID_134402
atggcttcaaagaaaagaaaatcatctgcttcttcagcttcccaaattagatttgacagatcaagattccattcacaggaagcttgggacatgtataatgacattattattcctaggatgttgctgccagagagaaatgtggtaatctaccacactgaatttgatgaattcaaggaagaattggacagaagaagatgggatgaagaattgaccagctttaaggaaggcaacattgatgttgccatagtaaaagaattctatgctaacctctatgatccagaggacaaatcaccaaagcaggtgagggtcagatgtcatttgataaaatttgatgaagaagccctcaacacattcctaaagacccctatgatcattaaggagggggagacattatcagcttattctaggtttgcactcttgaggcctgatcctcaagagttagctgctaagctctgcatcccagggaggggatttgagctgaatgctgatggtcagcctttgaatatattaaggaagaacatgactacacttgctcagacttggagtgttctttcatactccaacttggtccctaactcccacacttctgacatcacactagatcgggtcaagttgatctatggtatcatcatgaatatggacatgaatttgggctacctcatctcccatcagatttctattattgcccagcatgactcctctaggcttggatttccagccttaatcacaactttgtgtaaagttagtgatatgaatggcagcagaatagagaaggaagagagagagatgagacgccacttcaaggagaagatgagtctagaagaagctcaccatcataggaggccatggataagagcttggaggaagaaggagatgaatgaagggagagggagagaagaacacaaaattttgtgctctaagagagctctgaaatctaaagtttaa

SEQ ID NO: 42718 - DNA, 519 bp, Glycine max
  Peptide Sequence Number=SeqID_134403
atgaattgcccatggctcctcattggtgacttcaactccattttgtctcccaccgaccgtttcaatggagctgagcccaatgcttatgagttgcaagattttgttgattgctattctgacctggggttggggagcatcaacactcatggccccttgtacatgtggactaatggcagggtgtggagcaaactggacagagctttatgtaaccaggcctggttcaattcctttggaaattctacttgtgaagttatgaagtttatttctatttcagaccatactcctctagttgtcaccactgagttgatggctggaagcaaaatattcatggctgtagcatgttcatggtctgagttcagcaacatctccaaccgagtagagctagttgaggctgaatataacagtgtgcttaattctctaaagcaaaatcctcaggatccttcccttcttgctctggcaaaccgcactagagggcagaccattattcttagaaaagcggagtctatgaaatttgcttag

SEQ ID NO: 42719 - DNA, 605 bp, Glycine max
  Peptide Sequence Number=SeqID_134404
atgaattcattgcctagcgctgttcatgcgtcctccaccatcgagtgtggagccccgcgaattgattgcctagcgctgttcgccaattctccattctccacttttattcggagccccatgaatttattgcctagcgctgttcatgcatcctccaccttcgagtctggagccccgcgaattgattgcctggcgaagttcgccaattctccattctccacttttattcggagccccatgaattcattgcctagcgctgttcatgtgtcctccaccttcgagtctggagccccgcgaattgattgcctagcgttgttcgccagttctgcattctcaacttttattcggagccccatgaatttattgcctagcgctgttcatgtgtcctccaccttcgagtctggagccccgcgaattgatcgcctagcgctgttcgccaattctccattctccacttttattcggagccccatgaatatattgcctagcgctattcatgcatcctccactaatgagtctggagccccacgaattgattgcctagcgaagttcgccaattctccattctccacttttattcggagccccatgaattcattcctagcgct

SEQ ID NO: 42720 - DNA, 162 bp, Glycine max
  Peptide Sequence Number=SeqID_134405
atgtcatcgggctcaccgcctctggatgacaaaagggcgcagaatgaccataatttgtctctgcgtgccatcggacacaatctcctctggatggcgaaaagggtcagagattgtggggcggctgacaaaagtgaggctcttgctcctacgtatcctcaatga

SEQ ID NO: 42721 - DNA, 490 bp, Glycine max
  Peptide Sequence Number=SeqID_134406
gtcgactctagaggatccccaacacaggcatctgactgagacaagtctgcaagcggggaattccgatgtgtatggattcctcgatccacaatccattcaaagatctgggcaatcgcaatttgaatcgaaaagttacatcaagagttggatgcagagtttaaaacgagatgtctaccttggagcctacctgaatgggccagacaactatcttaagggaataattaacagtgctttgaaaggacttgatgatactccacaacctaaatccaagactactgctaggtggattgttgttaagtgtaatagacaaaaaggaagcactgagtgcggctattacgtcatgcactggatgtccatgataatcttaggatcttttaggaataattgggaaacgtattttaatgaagttagaccattggaagcagaaagactcaaggcgcttcgcatccaatgggcacagtattatctaaaagttagaaatcaaatatag

SEQ ID NO: 42722 - DNA, 225 bp, Glycine max
  Peptide Sequence Number=SeqID_134407
atggtcatgtacttgacgatgctcacgttcatacgtcagtggttaaaggatttaagcatttctgaggggatgctttggcgctttaattcatctatggtcaagtacttgacgccgcccttggttcatgcctcgtatgacatgggaaatagtataaattgtggcaatatgtactttgtactagggggtatgtcacctggtggggaacttccttgtggcccaggttga

SEQ ID NO: 42723 - DNA, 657 bp, Glycine max
  Peptide Sequence Number=SeqID_134408
atgtttgtggcgcagggcaaccagatattcatgaacgacgtgttcctgaagcgcctgacggcccccaccattaccagcggcggcaatcctccggccttttccctgacaccggacggaaagctgaccgctaaaaatgcggatatcagtggcagtgtgaatgcgaactccgggacgctcagtaatgtgacgatagctgaaaactgtacgataaacggtacgctgagggcggaaaaaatcgtcggggacattgtaaaggcggcgagcgcggcttttccgcgccagcgtgaaagcagtgtggactggccgtcaggtacccgtactgtcaccgtgaccgatgaccatccttttgatcgccagatagtggtgcttccgctgacgtttcgcggaagtaagcgtactgtcagcggcaggacaacgtattcgatgtgttatctgaaagtactgatgaacggtgcggtgatttatgatggcgcggcgaacgaggcggtacaggtgttctcccgtattgttgacatgccagcgggtcggggaaacgtgatcctgacgttcacgcttacgtccacacggcattcggcagatattccgccgtatacgtttgccagcgatgtgcaggttatggtgattaagaaacaggcgctgggcatcagcgtggtctga

SEQ ID NO: 42724 - DNA, 89 bp, Glycine max
  Peptide Sequence Number=SeqID_134409
aacttgtaaaaggaatttacaagatagtggactctcaagcgggttgcttggggactggacgtaggcacaagggtgtggggatcctctag

SEQ ID NO: 42725 - DNA, 551 bp, Glycine max
  Peptide Sequence Number=SeqID_134410
atgtcaacttcgaatttggatgaagtgatcgttgctcttagagaaaatgagagaatgatgagaactgaaaatattgatgatgaacacaatgcaataactatggtggagtctgagcgagggaggaatcattcaaggagacatgatggtgagatgcaaacaaatgaaggagaacttgaaaaaaaaataagagatatgaacaaagatagcgtcaactcccaaattagtgaagaaaaaagtgttgaagatgaaaataatgtgtttttggcaacaaatgatgaggttgctaaaacaaaatgggtgatagattctgctacctcaaagctcatttgtcgagatcgagagatgtttgatactttgaaaactgatggagaatttgaccatttcaagttagggaatggtggaaaaatgaaggttgaagacatagggaatacgaggatgaagctccatgatgatactattcaaactttctcaaatgtgaggtttgtaccttctgttaccgtcaatatgatattacagggtacaagtatattggttcaaagtggggatggaag

SEQ ID NO: 42726 - DNA, 242 bp, Glycine max
  Peptide Sequence Number=SeqID_134411
gaatgcttactcctacggcttaccccccccccctaaattatatgcaacctaccatgcacatgcccaacgagaacgctaatcatgccattctcattgagggacagcaaccccaacctatgggaggcacccgtgaagaaccaccgaagcaggctcagggtgacttcgacccatatcccatattcaccgccgagggaccggcgtttaatgctatgcctcaacccaatactgcgggagctccttaa

SEQ ID NO: 42727 - DNA, 453 bp, Glycine max
  Peptide Sequence Number=SeqID_134412
atggttatccacacctttcatcaaccaggggcaaacgagcccgttgacgcgcagagactaacgtcgtcttctgcaccttttgtcgtccagggacagcgagtcaggtggcaagcggagataccttatgatcgttcgctcctttcatcaaccaaggcaaacgagttcaacggtatcaagatgatgttggtttttactctcgtcgtccggagacattcaagcccgacgatgcacaagattcttctctgctgggcggggacgatcaagttcgatagcatgtggaaacgtcgtgataggggtgtaaataggaattcgaatctagacccttccggaacattttggaaattgggttgcttaaggaggaagcaacggggcggcaagatcctccacgttgttgaaaaatggtttccgtggcttccgttatgcttccgtaaaatttttgaaaaccttcagtaa

SEQ ID NO: 42728 - DNA, 231 bp, Glycine max
  Peptide Sequence Number=SeqID_134413
atgacagtggaatggagaaggaagagagagaggagacgccacttcaaggagaagatgagtctagaagaagctcaccaccataggaggccatcgataagagcttggaggaagaaggagatgaatgaagggagaggaagagaagagcacgaaattttgtgctctaatagagctttgaaatatgaacccactaatccaagatcaagtccaagattctccactaagtgtgcttag

SEQ ID NO: 42729 - DNA, 189 bp, Glycine max
  Peptide Sequence Number=SeqID_134414
atgaggaagcttgagaaggcagcttgtcagaattctaggactgttgttgattcaattgggaatgtatggtctgcttgggccagcagcattttggaaggaaggagcaggctgctgttgttgttgccgagggctggaccatctgaggttagggtgattcctccatccagggttgtatctgttgctggaaag

SEQ ID NO: 42730 - DNA, 69 bp, Glycine max
  Peptide Sequence Number=SeqID_134415
atggaagagaagcttgcttgtggggcttctatggaggttggatctttgagcttcaatgaggtcctttaa

SEQ ID NO: 42731 - DNA, 593 bp, Glycine max
  Peptide Sequence Number=SeqID_134416
atggcccctaggaaacttgcctcaaagagatccaggaaagataaagtggccgaaggaaccagttccgctcccgagtatgacagtcaccgctttaggagcgctgaacaccagcagcgcttcgaggccatcaagggatgggacgatgagtatactgatttccaggaggagatagtttgccggcggtgggcatcactggttacccccatggccaagttcgatccagacatagtcctcgaattttatgccaatgcttggcctacagaggagggcgtgcgagatatgaggtcctgggtgaggggtcagtggatcccgtttgatgcagatgctatcagccagttcctgggataccctttagtgctggaagagggtcaggagtgcgagtatggccagaggaggaaccggtccgatgggttcgatgaggaggccatcgcccatttgctatgtataccggggcaagattttgcccggactgctgccgggagatgggtgcggatcatgcgcaccaacatgaccaccctgattcagatctggatgactttgctgctcagcaacatccagcccagcgatcataatttcgactttcccctgccgaa

SEQ ID NO: 42732 - DNA, 405 bp, Glycine max
  Peptide Sequence Number=SeqID_134417
atgacccaagagctggtagcccgcggagacaccttacggttatccgcaccttgtcattcagtgaccccaagtgtgattgatgagcagaggccaatgtggtcatctgcgccctttccagagatatcggcatcttctggtggagactttttcaagtctcacaagttatctagaactacaggcggcgggcccgatgacatgcggagacaaaatttggtcattctgcacccctttaccattcagacacagtcgtgtccgatggcacgcagagacaaaatttggtcattctgcacccttttgtcatccagaggcggcggacccgatgacatgcagagacaaaatttggtcattctgcaccctttgtcatccagaggcggcgggcccgatgacatgcggagacaaaatttg

SEQ ID NO: 42733 - DNA, 280 bp, Glycine max
  Peptide Sequence Number=SeqID_134418
atggaatctaagaaaaggaaggctccttctacacctacccaggccagatatgatagatccaggttcacatctcatgaagcttgggagagatatacagatattatggtgcctaggaaatgtagtagtttattacactgagtttgacgagttcaaggaggaactcgagagaagacactgggatgagaagttgactgattttgctgacaacaacatagacattgctattgtgaaggaattttatgccaacctctatgaccccgaggataaatcacctaagcag

SEQ ID NO: 42734 - DNA, 282 bp, Glycine max
  Peptide Sequence Number=SeqID_134419
atggggtcatccgtacttcccaaatctttgcctaccatatttgaggttggacgattcatttgcttgaggccagatgggagcattgggttcaccttagcgacagcgcttaatagtggccatttatcattggcttccattatcttcttcatgctcatcatggcctttatcattgtggccatttgctcttttatggcctccatttttggcattcatcttctcttgcaccttctctgcttcacccattactctagctctagcacgagttcggaaagaatgcaatga

SEQ ID NO: 42735 - DNA, 105 bp, Glycine max
  Peptide Sequence Number=SeqID_134420
atgtgggaccaccacgggggaggagcttgtcacccagctcgcccaggcgagctcagctcgcacaggcgagccaggttgcttcctccagaagcaaccgccttctag

SEQ ID NO: 42736 - DNA, 211 bp, Glycine max
  Peptide Sequence Number=SeqID_134421
atgtcgacatctccggaaagggtgcaaatgaccacactgctttgctctggtgatcaatcacacttggggtcactgaatgacggatgtgcggataaccgtaaggtgtctccgcgggttaccagctcttgggtcatgacagcaaaaggtggtgtggtcgacaaaagcaaggctcttgctcctacgtatcctccaatgaggaactcagacctac

SEQ ID NO: 42737 - DNA, 443 bp, Glycine max
  Peptide Sequence Number=SeqID_134422
ggatcgcacccaagagacacccagtggacccggaaaagtccaacagggccctggggtttccagctttggttacgggcctctatcagtcctacagggtgctcgtacccccccgacaaggtcacatcatcatagggatcgcgcctgcaagacacccagtggacccgaagaagtccaacagggtcttggagttgtcaagctctaattacgggtctctatcagttcaagggagtgcctgttgcccccagcagggtcatcaggccccctaccaatcgagttttcatctagaagtgctgcgtctccaggcaggggcagggcgaaacaccacagcagcctggggatggccggcagcgggcaacagacgcaccgccatcacctctagagttcacctcagctcatccacaaaaaggttagagcgttgcctacgacacatggccgaccaatag

SEQ ID NO: 42738 - DNA, 234 bp, Glycine max
  Peptide Sequence Number=SeqID_134423
ggggaaacgcctggtatctttatagtcctgtcgggtttcgccaccactgatttgagcgtcagatttcgtgatgcttgtcaggggggcggagcctatggaaaaacggctttgccgcggccctccaccttagcctccgctgagcccgtcgttttttctcctgccacacacgtcactgggaaacaccctggcgttacccaactagtaatcgccagtatgcacacatccgccctttag

SEQ ID NO: 42739 - DNA, 341 bp, Glycine max
  Peptide Sequence Number=SeqID_134424
tgaacttcttgagtattttcttcaatgggaatgcattgacctatttcatgagcctcaccacagatgacagtttgcttagagttgcaacaaaaagtcttatcctctcagaagcaaagatcattttgatcctcttaagaattccttggccaatacacttacaattcaataaggatgatgccaaaggtcatgttcaaccttctcatattcaagaggatttcttcttctcttctttctatttcaaaaagggattcaagagacttcaagggtctcttgatcaagataatctcgaactacaaaggagggttgatcccaagttgaacagtagaggttcaagatcttga

SEQ ID NO: 42740 - DNA, 192 bp, Glycine max
  Peptide Sequence Number=SeqID_134425
atgaagaacgtcgaagaacggtcaaaacctttgcaaaattcctcacggaaacgttacggaaatgtttcggaagcgcctcggcttagattttcttcacggaaacaatttttccaacaaaatagaggagatgcttgccacccagctcgcccaggcgaacagggttgcttcctccagaagcaacagccttcttga

SEQ ID NO: 42741 - DNA, 156 bp, Glycine max
  Peptide Sequence Number=SeqID_134426
atgcgcggagtcgccaccagtcggaaaaaccgaaggaaaccggtcagaatgaaaattctaagttcgggagttgtatttacgcttgaggaaggtcgacaaaagcggggcttttgcccctacgtaccctccatcgaagaggaaatcagaccaacatag

SEQ ID NO: 42742 - DNA, 444 bp, Glycine max
  Peptide Sequence Number=SeqID_134427
atgaccatgattacgccaagctcgcaattaaccctcactaaagggaacaaaagctggtaccgggccccccatcgagtcgacgcccgggggatccacgtagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42743 - DNA, 432 bp, Glycine max
  Peptide Sequence Number=SeqID_134428
atggaaatacacgatggtcaaatatattgcccacacgtcatgaaaaaactttgggaaaatcaagaaaaggcttgttctcacattgttcgaatatatgatattcagagaacaatatttgaggttgaggaggcttttgaccctatgactcaacgagatgttgtgtacacaaatgactacatattacgtgcttactccgcacaatggtggcctcttgggaatgacgatgtgattctcccatctaatgagccgtggaaacttgtgcctgatccaagttttattcatgacaaaaaaggaaggccaagatcaacacggttaagaaatgaaatggattggagggagccatcgcaaactcgatacaagtgtggcagatgtgggacagtaggacacaaccggcgtaattgtccattgcaatctcaagaaggcagttgttga

SEQ ID NO: 42744 - DNA, 1008 bp, Glycine max
  Peptide Sequence Number=SeqID_134429
atggcaccagtgactatgggattatgtactgtcattgttcagattcaatgttggttgggtattgtgatgctgattgggctggaagtgcagatgacagaaaaagcacttctggtggatgcttctatttgggcaacaatcttatttcatggttcagcaagaagcagaactgtgtgtccctatctactgcagaagcagagtatattgcagcaggaagcagctgctctgcttctccatggctaccgcaccaaaagaaacttcagctccggttcaccctctgtaccatcatctccatcatccaccaaagcaccatcaaaccaggaacgacctgaattcaatatccaacccatacaaataattcctggtccagcccctgttcctgaaaaactggtccccaaacgacaacagggagtgaagatttctgaaaaccctagccttgcaacaagtcctagggaagtagacacagagatggataagaagatccgcagtattgtgagtaacattctgaaaaatgcttctgtccctgatgctgataaagatgttccaacatcttccaccccaaatgtttctgttcctgatgctgagaaagatgttccaacatcttccaccccaaatgctgaagtcctctcttcctccaacaaagagagatcaacagaggaagatgatcaagccacagaggagacccctgcaccacgggcaccagaacctgctccaggtgacctcattgacctagaagaagtagaatctgatgaggaacccattgccaacaagttggcacctggcattgcagaaagattacaaagccgaaagggaaaaacccccattaagaggtctggacgaatcaaaactatggcacagaagaagagcactccaatcactcctaccacatccagacggagcaaagttgcaatcccttccaagaagaggaaagaaatttcctcatctgattctgatgatgatgttgaactagatgttcccgacatcaagagggccaagacatcagggaaaaag

SEQ ID NO: 42745 - DNA, 189 bp, Glycine max
  Peptide Sequence Number=SeqID_134430
atggtcgtcattttgcctaaggaaaatcttgtcgcttggttttgttcgttgcataatagaccagacaactacctgaaaggaataattaacagtgctttgaaaggacttgacgatactccacaacctaaattcaaggctagtgctagtgtaatagacaaaaaggaagcattgagtgtggctattacgtga

SEQ ID NO: 42746 - DNA, 777 bp, Glycine max
  Peptide Sequence Number=SeqID_134431
atgacaagcatcattggtggttatcatgaatggctgaaagttcatatacgaggtttagattggctcgccaagttaaaagtcgtcagcgaagacagtttcgaagcaccggaagaagacgaagaagtccaagctctcaaaaacgagttaggaaaggcgaaacttgccaaggagaagttcaagttagccgctacacacatccggaaggaatgtgccggattacgggaagagaatgcaactaccgcaaaagcccttgaacaagagaccaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagttgcctgttcgaggtccaaaaggagcttgtctcagcgtttatgcgagacggagaccaacatgctggctatcatcgccaagtaccaagaagagttaagtctagccacgacgtacgagcatagggtcgcggacaagtatgcccaagtatacgcggaaaaagaggctagaggaagggtgatcgactctttacaccaaaaggcaaccatgtggatggatcggtttgctcttaccttgaacgggagtcaagaacttccccgattgttagccaaggccaaggcaatggcggacacttactccgcccccgaagaaattcatgggcttctcggctattgtcagcatatgatagacttaatggcccatataattagaaaccgctag

SEQ ID NO: 42747 - DNA, 336 bp, Glycine max
  Peptide Sequence Number=SeqID_134432
atggcaaaggggtgcggaatgaccaaattttgtctccgcatgtcatcgggcccgccgcctctggatgacaaagggtgcagaatgaccaaattttgtctctgcgcgccatcggacacgactgtgtctgaatggaaaggggtgcggaatgaccaaattttgtctccgcatgtcacatggctcgccgacctcagggtcagtgcggataaccgtaaggtgtctccgcgggctaccagctcttgggtcatgacaacaaaaggtggtgtggtcgacaaaagcgaggctcttgctcctacgtatcctccaatgaggaactcagacctacgtagttctggataa

SEQ ID NO: 42748 - DNA, 729 bp, Glycine max
  Peptide Sequence Number=SeqID_134433
gtacgcctggggagtgactgctctggtgcatatgtacgaccagctgaatgatgcatctatgagccacagccaacaacttggcggttacatcacactactgcagtgttggatttacaagcactttccgtcagtcgcggactccactgctgatcaggagtacgacgaggattctccgcgtgcgtgtaggtggattgcgacgaagaagaccgtgaagagcattcgtacgtcggcatacatggagcgcttgaaccgactccagattccagatgtctgttggatctcatatggggagcaccgatcggtcccggacttccacaccattcctgctcctcctgtcgattcatgggtgtcgtatgatgatatacacgacaggtggatgcactactcggatcatatcattccagcaggtgaggtgtgtgttgtgccaggtcagtgtgccagtgactacatggactggttcttccgcatctctcatcctttcatgacaccaggccacgcattagatcctctgcctcatggtcacaccccgcagccccgagtcgtccctcaggccccgcagacggatatccctcacgtgccggagccaggagcatcgtcgacatttttggaggagtctagacatgcagtggaagtttgtgatgacattgctgagaggttggagtgtcatctgagtctaggggtggtcacgccaggctcatcgacacaagaggtgatcgaagaatgtctcag

SEQ ID NO: 42749 - DNA, 375 bp, Glycine max
  Peptide Sequence Number=SeqID_134434
atgtcctcaccttcagagggctacatgtcctcgccatcagagggctacatgtcctcgccatcaagaggagttcatgtcctcgccatcagagggctgcacgccctcacctccagaggactacacgtcctcaccttgagaggactacacgtcctcaccatcagagggctgcacgccctcacctccagaggactacatgtcctcgccttgagagggctacacgccctcaccttggttaccctcaccgttgagaggactacacgtcctcgccttgagaggactacatgtcctcaccttcagagggctgacgccctcgcctcaaaggagttacatgtcctcgccatcgagagggctacacgccctcaccttgggtactag

SEQ ID NO: 42750 - DNA, 147 bp, Glycine max
  Peptide Sequence Number=SeqID_134435
atgtctcacctcttggcgaaaaaggcgagaaaagcgtcgatcgctgctagatccaccaacccatccacatttggaaagaggactcctccgaagatcaacagtgcgagaatgtctatgaacggggcccattcgcctccacctgcaaag

SEQ ID NO: 42751 - DNA, 162 bp, Glycine max
  Peptide Sequence Number=SeqID_134436
atgactttgagcttagctcatcaatgggctaagcacgcatccactgctaagtgcagcttcagcacgcttagcacaacagaagaatctggcaaagcattaatatcaaggcctcgtgctaagcacgagatcagtgcactaagcgcaacagttgtcttaaggtag

SEQ ID NO: 42752 - DNA, 240 bp, Glycine max
  Peptide Sequence Number=SeqID_134437
atggggggtgtaaatagcaaccaggcccacttgggccctccagaatattcctccagaaggctgttgcttctggaggaagcaaccctggctcgcctgggcgagctgagctcgcctgggcgagctgagctcgcttggccgaggcgcttccgtaacgtttccgtgagtaattacgcgaagattctcgaccgttcttcaagattcatcgttcgttcttcgttttcttcagtcttcaacgggtaa

SEQ ID NO: 42753 - DNA, 513 bp, Glycine max
  Peptide Sequence Number=SeqID_134438
atgacctcaccttctgaggactacatgcccgctccttcagaggactacacatcctcaccttcagaggactacacatcctctccttcagagagctacactttagaggatacacacccccttcagagtactccacgtcctccccttcaaaggactacatgtcctcacctttcagaggactacacgtcctcaccttcagaggactacgtcgccctcgccttcagagggctacacatcctccccttcagagggctacaagccctcgccttaataggactacacgactacacgtcctcgccttcagatgcacgccctcgcctccagagtgaacacctcacctttaagagggctacacgtcccgtcaccttcagaggactacacgttctcgccttcagagggctactgccctcgccttcagaggtctacacatcctcgccttcagagtacttcacgtcgtcgcctttagagggactacacgtccctcaccttcagaggactacacgtcctcgcctttag

SEQ ID NO: 42754 - DNA, 714 bp, Glycine max
  Peptide Sequence Number=SeqID_134439
atggcttccaacttccagcagtttagcgccagaaatgatgccatagtcattagaggagtgcatgaggtagctacaaacccatctgcatcatctgaaactaagaagcttgaaggcaaactggatgcattggttaacttggtaacccagctggccttgaatcagaaatctgtacctgttgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagaacaattatgacctctccagcaacagatacaaccctggatggaggaatcaccctaacctcagatggtccagccctcagcaacaacaacagcagcctgctccttccttccaaaatgctgcgggccctagcagaccatacattcctccaccaatccaacaacagcaacaaccccagaaacagccaacagttgaggcccctccacaaccttccctcgaagaacttgtgaggcaaatgactatgcagaacatgcattttcagcaagagaccagagcctccattcagagcttaaccaatcagatgggacaattggctacccaattgaatcaacaacagtcccaaaattctgacaagctgccttctcaagctgtccaaaatcccaaaaat

SEQ ID NO: 42755 - DNA, 766 bp, Glycine max
  Peptide Sequence Number=SeqID_134440
gtaacaatcttaagacttgggatgaagtggttgaaaaattcttgaagaaatacttcctagagtccaagactgctgaaggaaaagctaccatctcatcctttcatcaatttccagacgagtccttgaggggaaaaataaaattgaaaacacctgaagaagccatggaattgattgagaatattgctgctattgaccatgcaatcttgcgtgatagagcagacatcccaaccaaaagaagcctgccagagctttcatcacaagacgctttgttggcccaaaacaatatgctatccaagaaacttgaagctttaaatgaaacattaagttgtgttatatgtggtggagcacatgattctggttgttgcattcccacagaagatacaacacatgaagtgaactacatgcggaaccagccaagacccaactttaatgcagaccagggtgggccatctaacaagctggaagagattcatgctcatttcatgcaagtatccatgtccaatcaaaagagcacaaagtcaaccatcaagaatctagaagtccaggtgggacaattggcaaaacaactggcagaccaaccgttaagcagctttggagccaatatagagaagaatcctaaggaggagtgcaaggttgttatgactagaagcaaaatggtgagcgtgaatgaaggtgagaagaggataggtgaagaaaaacaacagctggtgactaaaccagcaattgacccagtggtggaacctttgagtgagactgaggaagaaat

SEQ ID NO: 42756 - DNA, 229 bp, Glycine max
  Peptide Sequence Number=SeqID_134441
acatttgccggtgtcatcgttggttgaggagacgtacttcaagactgcgcaactctttgctattagaggtcgacaaactcaggcaatgattaactctggctcacaatattctgaagtcgtctctaaggcaatgaatagaggagatcagtggggtcctgatccatggagaaagaggactgcaaagggtcgtcctgtttcaactcgcatttatactaagatggacgaagac

SEQ ID NO: 42757 - DNA, 258 bp, Glycine max
  Peptide Sequence Number=SeqID_134442
atgacattgaccatcccacaactgtttttgaagcctctccaggttatgtgggatgctaccgtgtttagggtgtttaatcaaaacttcccgttgtacataaagcatgaaaatctctctgaaattgcacacggtggtcaatgtctcaacatatctgttatacagttgtggattcttgctttgaaaggacttgatgatactccgcaacctaaatccaaggctgttgctaggtggattgttgttaagttaacgttgaattaa

SEQ ID NO: 42758 - DNA, 451 bp, Glycine max
  misc_feature (437)..(437): n is a, c, g, or t
  Peptide Sequence Number=SeqID_134443
atgtctcctttgccttttgctatctttggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaacgntgcgcctttatccg

SEQ ID NO: 42759 - DNA, 416 bp, Glycine max
  Peptide Sequence Number=SeqID_134444
tccccagtggagtcgccaactgtcgcaacctacccttcggcgggagggcgacgcgagactcgcgggatgcgtgttccacgaaaggaatacgcgcggagtcgccaccaacgtttattcgaggaaaacgtcggaaaaaccggaaaagacgcgatctacgaacttttaagttgaaagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgattcctcgctcactgactcgctacgctcggacgtacgactga

SEQ ID NO: 42760 - DNA, 183 bp, Glycine max
  Peptide Sequence Number=SeqID_134445
atggagagaagtatgatagatgctgccagtggtggagcccttggagacatgacccctgctgaagccagaaatttaattgagaagatgatgcaatcctaccccccaagggtattggatagaagactccaagaggctcgggctagagctactaaagaaggccttagggttctcatgaaccttagg

SEQ ID NO: 42761 - DNA, 414 bp, Glycine max
  Peptide Sequence Number=SeqID_134446
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacgccaatccctgggtgagtttcaccagttttgatttaaacgtggccaatatggacaacttcttcgccccgttttcaccatgggcaaatattatacgcatgcgacaagtgctgatgccgctggcgattcagggtcatcatgccgtttgtgatggcttccatggtcggcagaatgcttaa

SEQ ID NO: 42762 - DNA, 254 bp, Glycine max
  Peptide Sequence Number=SeqID_134447
gtaatccttgtggcgtctaccctgacttatcttccttcactggaagtggcgtctacccagacttatcttccttcaccggaagtggcgtctaccctgacttatcttccttcaccggaagtggcgtcatccaaaaactctacagcctgtatcaagtgatccgccccgtaaggttcacatcatctggtatcagagcttcggctcttgatacagtgggcctcaaacagacaaccgtagcaaaagttatgagcatttga

SEQ ID NO: 42763 - DNA, 669 bp, Glycine max
  Peptide Sequence Number=SeqID_134448
aggactccacgtcctcaccttgagaggactacacgtcctcgccttgagaggactacacgtcctcgccttgagaggactacatgtcctcaccatcagagggctgcacgccctcacctccagaggactacacgtcctcgccttgagagggctacccgccctcgccttgggactacacatcctcgccttcagaggactacacgtcctcaccttgagaggactaaacgtcctcgctttgagaggactacatgtcctcaccatcagagggctgcacgccctcacctccagaggactacacgtcctcgccttgagaggactacatgtcctcaccatcagagggctgcacgccctcacctccagaggactacacgtcctcgccttgagagggctactcgccctcgccttggaggaccacacgtcctcaccttcagagggctacacgccctcgccatcagaggactgcatgtcctcaccttcgtagggctacacgccctcacctttagaggactacacgtcctcgccaacagagggctacacgccttcacctttagaggactacacgtcctcgccaacagagggctgcacgccctcaccttgagacggactacacgccctcacctccagaggactatacatcctcgccttgagagggttgcacgccctcacctttag

SEQ ID NO: 42764 - DNA, 699 bp, Glycine max
  Peptide Sequence Number=SeqID_134449
atgagcacgggcgcactgtccggtctggtccaggcgggagaagtgccgaacggaccgcacgtggtgacatcaggacaggccagcgtggatgcccgtccggatatggcgacgctctccatcgtggtgaatgtttcgtcgaaagacgcggcggatgcaaaaaaacaggctgacgaccgcgtggcgcaatattttgatttcctgcaaaagaacggcatcgagaagaaagatattgatgcggctaatctcagcacccagccggagtatgactacaccaaagagggtaaatcggtgctgaaaggctaccgtgcggtgcgtcaggtggaagtgacgctgcgccagctggataagctgaatgagctgctggacggcgcgctgaagtcgggcctgaatgagattcgttctgtcgagctgggcgtggctaacgcagacagctacaaagatcaggcgcgtaaagcggcgattgccaatgccacacagcaggcgagcgccctggcggaaggcttcaacgccaaactgggcccggtgtacagcattcgctatcacgtggctaactaccagccgatgccgatggcgcgcatgtacaaagcggccggtgccgcagcggacaccaccgcgcagcagacctacgagcagcagagcatccattttgacgatcaggtggatgtggtattcgaaatcaaaccgaatacggcgcagtaa

SEQ ID NO: 42765 - DNA, 1190 bp, Glycine max
  Peptide Sequence Number=SeqID_134450
atgaatccgtctcgtctgtttatcctgcgcccggtggcgacgattctgctgatgatcggcgtgctgatcgccggtctgttcgcttatcgctttctctccacctcggcgctgccgcaggtggattatccgaccattcaggttaccaccctttatcctggcgccagcccggacgtgatggcctcatccgtaacctcgccgctggagcgtcagctcggtcagatggccggtcttagccagatgacgtctgccagctcgggcggatcatcgattatcaccctgaagttcagcctcgatctgtcgctcgacgtcgccgaacaggaagtccaggcggcaatcaacgcggcgaataatctgctaccggacgatctgcccaatccgccgacgtataaaaaggtcaatccggccgacagtgcggtgatcacgctggccgccagttccgacacgctgccgctgactgaggtgcaggatttggtgaacacgcgcgtggcgctgaagctgtcgcaaatcaacggtgtggggatggtgaccctggcgggcggcaatcagccggcgattcgcgtgcagatggatccaaaagcgctggcggcgcacaagctgtcgctggaagacgtcaatacgctgatcgccaacagcaacgtcaacggttcgaaaggcggtttcgacggcaaatatcactcggtgaccatcgacgccaacgaccagctgcgcaccgcggccgaatacggcaatctgattctcacctggcagaacggtgcggcgctgcggctgaaagatatcgcccatatcgagcaggggccggagaatcgctttcagtcggcgtgggccaataaccgtccggcgattgtcatcagcgtgcagcgccagcccggcgccaacgtcattcaggtggtggatagcattaaaaagcagctgcccgtactgcaggcggcgctgccggatggcgtgaaaatgcgtgtgctcgccgatcgcacgcagaccatccgcgcctcgatcagcgacgtacagtttgaactgatgctgtcgatcgcactggtggtgatggtgaccttcctgtttctgcgcaacgtggcggcgacgctgattcccagcgtggcagtaccgctgtcgctgattggcacctttggcgtgatgtatctcgccgatttcagcctcaacaacctgtcgctgatggcgctgaccatcgccaccgg

SEQ ID NO: 42766 - DNA, 843 bp, Glycine max
  Peptide Sequence Number=SeqID_134451
atggcacagcagcgcggcaacgcgcacgtactcaatcacctcttccagcgactgttcgagctcttcctgatcttcatcttcatcgtagccaagttgcgcaatggtgcgcagatcgtcaatcgcttcgccggtctcaccggtcactttgtccagcttcggctgcgtcacgcccaggcccagcaggaagtgattgacccagccggccagcgcgtcagcacgatcgaacaccgtgatgtcctcctcatccggcagcatcagctggaacaggaaaccctcttcatccagcgtgttggaccagctgctgtcctgattgccgccgcacagaatgccacacagcagtccgtgcatctcggcgggcgtcatgcctacgccctgctgggaaagtgccgcggccagcgcgttgtaagtggaaaaggggttgtaacttatcacgcgggtctatatagttgcgcacctcccaacccattgacaggtaagggagatgcgaacgaagtaatcagtcaggatggtggcatgtctgcacaaccggtagatattcagatttttggtcgttcattgagagtgaattgtccgcctgaacagcaagatgcgctgaatctggccgcagaggatctcaatcaacggttgcaagatttaaaagttcgcactagagtcacaaatacagagcagctggtgttcatcgccgcgttaaacatttgccacgagctggcacaagagaaaggtaaaacgcgcgattacgcagccaatatggaacaacgcatccgtatgctgcagcagaccattgagcaggcattagttgagcaaggtcgcataactgaacgtcagggccctaaattcgaataa

SEQ ID NO: 42767 - DNA, 2260 bp, Glycine max
  Peptide Sequence Number=SeqID_134452
atggaagtgtgggatcaggacagctttggctcgatcagctttgatgacgagcagcaggggctgtcgcacctcggacatatcattgaaaacgaggtgatccacagtgcgctgtggcagcgcgccagccagtgtagcgacgtgacgctgattgcgccggctcagctgcagcaggtggcgtttggcgataacgaagcctttattaccctgcaggacggcagcatgatgagcgcgcgcctgctgattgctgcggacggggccaactcgtggctgcgtgacaaagcggatatcccgattactttctgggattacgaacatcacgcgctggtggccaacgtacgcaccgacatgccgcacgatgccattgcgcgccaggtgttccacggcgacggcattctggccttcctgccgatgcaggatccgcacctgtgctccatcgtctggtcgctgtcaccgcaggaagcggcgcgactgcaatccatgccggaagcgctgtttaaccagcagctgtcggtggcattcgatatgcgccttggtctgtgccaggttgaaagcgaacggaaaactttcccgctgatggcgcgttacgcccgcaactttgctgcgcaccggctggcgctggtgggcgatgcggcgcataccatccatccgctggccgggcagggggttaacctcggctttatggatgccgccgagctgattggcgaaatccgccgtctgcatcagcagggcaaagatatcggccagcatctctatttgcggcgttatgaacgcagccgcaagcacagcgcagcgctgatgctggctggaatgcagggtttccgtgagctgtttgccgggcaccatccggcgaaaaaactgctgcgcgacgtcgggctgaagctggccgacacgctgcctggcgtgaagccgccatgggcctcaacgacctgcccggctggatccgctaaccctccttattacggcaccgtttcaggtgccgtttttcctgcactgacgttacgcgatcgccctcaagggtgggcgtggcagtcggctgccgctcatgaatcaccgaactgcacagcgttgtcgccatccatcgcgaccctgtgcgcacccggtaacgccactacaaaacccgccccagcaccattattgttcaattattcggctgaattactgcgcaacagcacaaaggatgataaggtttcaccctcgttttccttatggttaattgccgggatggttatgactcagcaaacgcctctattcgaacagcatcaggcctgcggtgcccgcatggtggacttccacggctggatgatgccgctgcactacggctcgcaaatggatgaacaccatgcggtacgcaacgatgccggaatgtttgacgtttcccacatgaccattgtcgatctgcacggcgcgcgcacccgtgaatttctgcgttacctgctggccaacgatgtcgccaaactgacccagcccggcaaagccctctataccggcatgctgaatgcttcagctggcgtcattgatgatttaattgtttactttatgagcgaagatttcttccgcctggtggtcaactccgctacgcgcgagaaggatctggcgtggatcgctgagcatgcgcagccgtttggggttgcgctcaccgagcgtgacgatctggcgctgatcgccgtacagggaccgaacgcgcagcaaaaagcacagagcctgtttagcgcggcacagcgtgacgcggttgcaggcatgaagccgttctttggcgtacaggccggcgatctgtttatcgccacgaccggttataccggtgaagccggttatgaaatcgccctgcctgccgctcaggccgcagatttctggcagcagctgctggccgcgggcgtgaaaccagccggactgggcgcacgcgatacgctgcgtctcgaagctggcatgaatctgtatggtcaggagatggatgaaggcgtttcgccgctggccgccaacatgggctggaccatcagctgggagcccggcgaccgtgatttcattggccgtgaagcgctggaagcgcagcgcgagaacggcacggaaaaactggtcgggctggtgatgaccgaaaaaggcgtgctgcgtaacggtctgacggtgcgctttaccgatgcgcagggccagccgcagcagggcatcattaccagcggctccttctcgccaacgctgggctatagcattgcgctggcgcgcgtgccggccagtatcggtgagcaggcgattgttgaaatccgcaatc

SEQ ID NO: 42768 - DNA, 1464 bp, Glycine max
  Peptide Sequence Number=SeqID_134453
atgacccagactctcagccagctcgaacataacggtgcttttattgagcgccatatcggtcctgatgccgcgcagcaggccaccatgctggaagcgattggtgccagctcgctggcttcgctgatcgcttcaattgtgcctgctgatatccagctgccaggcccgccggcggtaggcgatgccgcgactgaacagcaggcgctggcagagctgaaagccattgccagccagaatcagcgttacaaatcctggattggaatgggttacagcgccgtgatcaccccgccggtgattctgcgcaacatgctggaaaacccgggctggtacacggcgtacacgccatatcagccggaagtgtcgcagggccgtctggaagcgctgctcaatttccagaccctgacgctcgatctcaccgggctggatattgcttcagcttcactgctggatgaagccaccgcggccgccgaagcgatggcgatggctaaacgcgtcagcaagctgaaaaacgcgacaaaattctttatcgccgatgacatccatccgcaaacgctggatgtggtgcgcacccgcgccgaaacctttggcttggagctgattattgatcgcgccgaaaaagcccgcgagcacgacgatctgtttggcgtgctgctgcagcaggtcggcaccagcggagaggtgcacgactaccgtgaactgattgctgagctgaaaagccgcaaagtggtggtgagcgtggcggcggatttcatggcgctggtgcagctggaagcgccgggcaaacagggtgctgatatcgtttttggttccgcccagcgctttggcgtaccgatgggctacggcggtccgcacgcggccttctttgccagccgtgatgagcacaagcgctccatgccgggccgtatcatcggtgtgtcacgcgatgccgccggtaacaccgcgctacgcatggcgatgcagacgcgcgaacagcacatccgccgtgagaaagccaactccaacatctgtacctcacaggtgctgctggcgaatatcgccggcctgtacgcggtttaccatggcccggccggactgaagcgcattgcctcgcgcattcaccgtctgacctcgattctggcagcaggcctgcaaaacggcggcctgaagctgcgccatcacagctggttcgatacgctgaccgttgaagtcgcggacaaagcggcggtgctgaaccgtgcgctgagcttcggcgtcaatctgcgcagcgatatcctcaatgcggttggtatcacgctggatgaaaccaccacgcgtgaagacgtgctggcgctgtttgccattctgctgggcgacgcgcacggtcaggatatcgaggcgctgggacgccgcggtggcggcgaaaaacagcgccattcccggcaggccagcaacgtaccagcgaattccttaacccatccggggttcaacccgtcatcacagcgaaactga

SEQ ID NO: 42769 - DNA, 772 bp, Glycine max
  Peptide Sequence Number=SeqID_134454
atgccgattttcacccttccgcctcgccagcccgctgcggcgtcgcgcctgcctttaacgctgatatcgctcgacgagtgggcgctggtgtcggtgcagggcaaagacagcacctcttatctgcagggtcagctgacgctggacgtggcggcgctggacgcagcgcagcatcgcccggcggcgcactgcgatgccaaaggcaaaatgtggagcaatctgcgtctgttccatcgtggagaaggttatgcctatgttgtgcggcgcaatctgcgcgagcagcaggtgaccgaactgaagaagtatgcggtgttcgccaaagtgaccattgcggccgatgatgacgcagtcctgctcggcgttgccggttttcaggcgcgcgccgcgctggctaacgttttcgccacgctgccggatgccacaaccccagtggtacagcaggatgacaccaccctgctgtggttcgccgagccagccgagcgttttctgctggtcaccacgccggcgcaggccgaagcgctgcaacagaagctggccggggaagcgcagctgaatgacagcacgcagtggctggcgctggatattgcggcgggcgtgccggtgatcgacagcgccaccacggcgcagctgattccgcaagccaccaacctgcaggcgctggatgccatcagctttaaaaaaggctgttataccggccaggagatggtggcgcgcgccaaattccgcggcgccaataaacgtgcgctctactggctggcaagcagcgccagcaaaa

SEQ ID NO: 42770 - DNA, 366 bp, Glycine max
  Peptide Sequence Number=SeqID_134455
atgatgcccactttattgctggcggccgtggccggcaccgcaggttcaacgaccggcgtgaccggggtcagggtgctgccgccgccgctaccaccgccgccgccgccgccaccacaggcgctcagcagaaacgggatgatgagcgccagcaggcgcggtgagggtcgaaaaggcatgttgtcgcccgttcacgttaacgggcctgaatgcagtctttccctgtcacgaatactcctgagcaacgtggctgacagacagaacgcaattgatgaagcacgaacccctgagattccgtcagggtgcagaaaggataaggtgcgcactggccggttgatggccaggacagcgcagcattgcgcaggctaa

SEQ ID NO: 42771 - DNA, 517 bp, Glycine max
  Peptide Sequence Number=SeqID_134456
ccatatcggcgacaacgttaatctgtatgggtatagctttatctccgcgctgccggtggcatcaagcggcaaaaatctgatcaatacgacgctaagcaatgactggaataaggccagctgcgtagtggtggcggccaatgccggcgtggtgaaaggcatgtccggcggcgcggtgtataacgccagcgacgacacgctggccggggtgattgtcggctatagcagcgtggctggatggggtggtgaagtcttaggttgggtgcgcgctgatgccctcaccccggccctctcccaccgggagagggagaaaaccacagcggtcctctgccacagggagacggagaaaaccacagcggccctctgccacagagagagggagaaaaccacagcggacctctgccacagggagagggagaaaaccacagtggtcctctgccacagggagagggagaaaaccacagcggccctctcccaccggggtacaggcaagtcccctctccccatgggagagggttag

SEQ ID NO: 42772 - DNA, 663 bp, Glycine max
  Peptide Sequence Number=SeqID_134457
atgcgtgccctcacttcacaggagctcagcatcgcctccatagaagggatacatgcccccacaagttcagagggctcatccatcaattatagaggactacacgtcctcgccttcatagggctacatgccctaaccttcagaggtctacgcgtcctcaccttcagaggactacacctcgccttcagcaggactgcatgtcctcgccttcgaggatacacgccctcacctttagaggactacacgtcctcaccttcagaaggccacacgccctcgccttcaggactacaggtccttggcttcagaggactacaggtcctcaccttcagagcactactcgtcctcgcttttagaggactacacgtcctcaccttcagaggactacacatcctcgcctttagagggccacacgccttcgccttcagaggactgcaagtcctccccttcagagggccacacgccctcgcctttgtagggcttcaagccgtcacctttagaggacaacacgttttcgcattcattaggctgcacgccctctccttcggaggactacacgtcctccccataagaggaccacgtgtcctcaccttcagaggactacacgtcctcggcttcagaggactacacgtcctcaccttcagaggactgcacgccctcgccctctga

SEQ ID NO: 42773 - DNA, 266 bp, Glycine max
  Peptide Sequence Number=SeqID_134458
gcgagctcacgggtgcgctttccaaaggagggaagatgcgcggagtcgccaccaacgtttatttgtggaaacgtcggaaaagccgaaggaaaccggtcaaaatgaaaattctaagttcgggagttgtatttacgtttgaggaaggtattagcacctctcatgtcgacaaaagcggggcttttgctcctacgtaccctctatcaaagaggaaatcagacctacgtagttctttcttaagagtgaatcaagcgattcttattacttga

SEQ ID NO: 42774 - DNA, 201 bp, Glycine max
  Peptide Sequence Number=SeqID_134459
atggcaaccagcgggcaggatctgcttcgatgtacaagccgcacctatctgagtcacccgtctcaggatcatttcctaagggatcaacataactcccctttgtgcttactcgagaacctgagggaccaaccagaggctcgggaggcagtgcaagtccctgagattgcatctgggactaaatctgggactgcatctggctga

SEQ ID NO: 42775 - DNA, 318 bp, Glycine max
  Peptide Sequence Number=SeqID_134460
atggacaacggaagccctcgagaaattcaaatgggtcataactttgcacttggatgtccgattcaggagcatcacatatcgagacgctcgaaattggacaacggaagctcttcgagaaattcaaatggtcataacttttcacacggaggtccgattcaggcacaacacatatggagacgcccgaaattgaacaacggaagatatcgagaaatccaaatggtcataagttatcacacggaggtccgattcaagcgcatcatatatcgagacgctcgaaattgcataacggaagctctcgagaaattgaaattgtcataa

SEQ ID NO: 42776 - DNA, 234 bp, Glycine max
  Peptide Sequence Number=SeqID_134461
atggaatcttctaaagattcagaaaatgaagaaataaacctctgctttatggctaaaagttatgaaagtgatgaagaggaacccttgaagaaaaagtggtacatagatagcggatgctcaaaacatatgacgggagacgaatcaaaattcacacatatctctcccaagaaaagcggacatgtaacttatggtgaggggggacgggaggtagaattcttggagttggaaaaatag

SEQ ID NO: 42777 - DNA, 123 bp, Glycine max
  Peptide Sequence Number=SeqID_134462
atggcacatcaatccccctgtgctcgtaccaccggtgcccggaagacctcttatcctatacatgagtatattagatgggtcaatggggtgtacaaaatggataccatcaagtatatctactaa

SEQ ID NO: 42778 - DNA, 956 bp, Glycine max
  Peptide Sequence Number=SeqID_134463
aatagattgggaccagcttttggccgggataggaggtagaacaatcaattggttcccccgatggaaggaaggaaaggaaggagtccttttctcatgtggaggatacccaaacattccgctgataggaacgaggggttgtattaactacaatcccgcgctcgctataagacaactagggtactccatgaggggagcaccgacggaagaaggcatgtctcctttccttgtgagggatttcggcgcacaaaattccaagactatacaaagaatccataaggcatgggaaaccccgttaaagaaagatcaagaacttaggggcattcgtaatggcatcattggtgggtaccatgaatggttgaaagttcatatacgaggtttagattggctcaccaaggagaagttcaagttggctgctacacacattcggaaggagtgtgtcgggttacgggaagagaatgcaattactgcaagagcccttgaacaagagaccaagagggctcgcaaggaagagtatggccggaataaatttcgcggagctctatggggtagcaatagtgaactcaagctgcgaagggaagagagggaccagtcgcgagcacatagcatggttctgaaagaggagttagttgcttgttcaaggtccaaaagaagcttgtctcagcgtttatgcgagacggagaccaacatgctagctatcatcgccaagtaccaagaagagttaggtctagccacggcccatgagcatagaatcgcggacgagtatgctcaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcagacacctactccgcccccgaagagattcatgggcttctcggctatt

SEQ ID NO: 42779 - DNA, 288 bp, Glycine max
  Peptide Sequence Number=SeqID_134464
atggaaaaacgccagcaacgcggcctttttacggtttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacccggagccatgcgtagtgattaa

SEQ ID NO: 42780 - DNA, 553 bp, Glycine max
  Peptide Sequence Number=SeqID_134465
atgcagttcatgttgtccccatatgggagaagggtgtcaaatttggacgatttggtaccgtgccttgataagatgactcttttagctgaggaagaggatagaatttttgaggcatgtgaagaagctcctccttcggttccacaatttgaaagtcaacaatttgatatgttgggtaggagtgtggagacccaaggtttagggcgacgtatggaaagtgtggatgcagaaacacatgttattcctacgatgccagagcgccaacatggaatgtattacacacctgatcagttcacccaagagtcatctcaaatgtcgcccctatatccgtacccaaatcaaagcggaacttcattagatgcatatttcatgggaacgcaacctctgctacaaccaggatatgttatggctgacttatttgggtctccttctcctgcgggaaccccttcatttgcacatggttgtcagatatcaacgcttaacgccccaataggcccttcatggaccgtgtcgggaaacattcctaacattactgatttattaggggtagatctag

SEQ ID NO: 42781 - DNA, 66 bp, Glycine max
  Peptide Sequence Number=SeqID_134466
atgactacaaagaagagtaggaaagaaaaagctatggatgaaggtgtggaagtaccatatcctatg

SEQ ID NO: 42782 - DNA, 375 bp, Glycine max
  Peptide Sequence Number=SeqID_134467
atggattctgtaggaataagatcggctaacccttatttggcgactcctggagcaacggttcatggccattatggggaaatactttctgaaggagatatattagttacatttatctatgaaaaatcgagatcgggtgatataacacaaggtcttccaaaagtagaacaggtattagaagttcgttcgattgattcaatatcgatgaacctagaaaagagagttgatacttggaatgggcgtataacaaaaattcttggcattccttggggattcttgattggtgctgagctaacgatagcgcaaagtcgtatttctttgcaagttttcaagaaactgctagagttttatcaaaagccgctctccgggggcgcatag

SEQ ID NO: 42783 - DNA, 783 bp, Glycine max
  Peptide Sequence Number=SeqID_134468
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctggtggaggtccgaaccgactgatgttgaagaaatcagcggatgaagttgtggttaggggtgaaaatgccccctcgaacccagagctagctggttctcccccgaaatgcgttgaggcgcagcagttgactagacatctaggggtaaagcactgtttcggtgcgggccgcgagagcggtaccaaatcgaggcaaactctgaatactagatatgacctcaaaataacaagggtcaaggtcggccagtga

SEQ ID NO: 42784 - DNA, 705 bp, Glycine max
  Peptide Sequence Number=SeqID_134469
atggaagggttagtggacctagcagtgattgacgctttcctcgcctttcatcatggcaaggaaagcccggtcgtcaccattttggccatgcatgacacgttcgatcagagatgtgaaaagagcggcgcaagaattgtttgttgtacactggctctctatgtgtggctggtttcgcacctttttctccaagaaggtaggctcgtctatccgctacaaggaaggaagaatcaggattctatcttcatgcgaaggatgtccaaatgttcccttgatggaacaaaggattgtattaattataatcccgtcctcgtcataagacagcttggctacccaatgagaggagtgccatcagacgaaagcatcacacctttcatcacacggggtttcagtgaccccaatgcgagggacagagagcttaggggaagcagtaatgggagcatcggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaagtccatagccatcaaactgaagccttggaacgaagaggtgaaaggaatcatcacgggtcaaaggcatgatcttgaaggacgagctaacggcttgccttag

SEQ ID NO: 42785 - DNA, 429 bp, Glycine max
  Peptide Sequence Number=SeqID_134470
atgaccggacgtcttcttgccgggtcattggcttttgaaagccgcatccttcactatttaattgtgcgtattttgcttccacggtcttccaaccttgcccagcttgtcactctctttttccgccattttcaaattcctcttgattctgaaccttacgttccaatcaagagatcctttttaattggtgctgctgtgattgcttcttttggttaccgcaaagagcatgatggctcttgggtcaaaaagggtgctccacccgctgatgatgaaggcaaccaaccagttgaagataattcctctcttcttcgaaagcttttggaaaagttcgatggtcttcaaacttttgttggtgacaagtttgataatatagaattgcaagtcgaaatgcggtttgatgccatggaatcaaggatcaccaaagttgaataa

SEQ ID NO: 42786 - DNA, 332 bp, Glycine max
  Peptide Sequence Number=SeqID_134471
atggcacgcagagacaaattatggtcattatgcgccctttgtcatttagaagtagcgagtcgagtgataaacgcgcagagacaaattatggtcattgtgcgccctttgtcattcaggagcaacaagtcgagtgataaacgcgcaaagacaaattatggtcattctgcgccctttgtcattcagaagcagcgagtcgagagcagccagtcgagtgataaacgcgcagagacaaagtatggtcattctgcaccctttgttattcaggagcagtgtgtcgagtggtgggcggagacaaattatggtcattccgcacaccttttcgtcatcccgag

SEQ ID NO: 42787 - DNA, 132 bp, Glycine max
  Peptide Sequence Number=SeqID_134472
atgtcattgcctagcgctgttcatgtgtcctccaccttcgagtttggagctatgtttcatgattgcctaagtgcgctgttcatgtgtcctccattatcaagcgcggagcctctgcaaaaaaagaaggagtag

SEQ ID NO: 42788 - DNA, 322 bp, Glycine max
  Peptide Sequence Number=SeqID_134473
atgggtgaccaagaggaagtacaggaacagatgaaagccgacatgtcggctttgaaagagaaaatggcttgcatgatggatgccatgctaggactgagacaactaatggagaataacgcggccaccgccgccgctgttagttcggctgccgatgcagacccaactctcccagctaccgcgcaccaccctatcccaaacgtggtaggacgagaaagaagtacactggggcacatcagcaacccccatccggggtacaaccgagtagcttacccctatggattaccacctaattacacaccagcagccatacgtgacgacgcgg

SEQ ID NO: 42789 - DNA, 237 bp, Glycine max
  Peptide Sequence Number=SeqID_134474
atggtctcccgtgttggagacgaaagggatgaatttttgtttcacctcggggagtcgcatgacatggaaacctgtcccgcggtggaagaattgcttcaatggctcatggattgcgggcagcttgaagtgtccataggagggaggaaagaaccacaaatttgcatgcagtcggaagagaagaaggttcccctgacccccaaggccctagtgatatgttttactaggaaagggacctga

SEQ ID NO: 42790 - DNA, 634 bp, Glycine max
  Peptide Sequence Number=SeqID_134475
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccccttcaagggtcagcacctcccaacaatctctccccctcccctcatataggcaacatgccaacacgccttcagactatctagcgcatctaactaagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 42791 - DNA, 795 bp, Glycine max
  Peptide Sequence Number=SeqID_134476
atgaaaaaatcatatgtattattacatctggccgttatactggctggatttacaggaatattcggaaaactcatctcgcttaacgaaggtcttctggtctggtaccggctgttattctccactctcattttatttgtgattctcaaatcgctgagaatcccttatacgatttcaacccggggaaaattccatatagccaaagttggaatactgattaccttgcactggttatttttttacgcaagtatcaaatacgctaatatctccataggtgtagtgtgttattgtctgaccagtttttttactgccgtattcaaacctcttatcgataaggaacggtttaagatttccgagctgttgttaagtttattaacggtttttgggatcagtctgatttttcattttgatacatcgtatcaattaggaattggtttgggtgttatttcatccgctattggcgctttgtataccattttcaacaagcgcctggttcaacattatgacaccaaagtcattaattactaccagatgcttagtggaactgtttgcctgggagctgtcctaccggtttatctttattttttcccagtagaaagtgtgattcccggaatgaaagatatcgaggttttaaaaaagatccctgcatttacagtgaacttaaccttcaatctggagcctgtttatgcaattatcatggcctttttattctttgatgaaagcaaacagtggcccttgcgggatatgtattgcttcttccgtgatcaattggttcagtttatttgtcgaaagctgtaa

SEQ ID NO: 42792 - DNA, 105 bp, Glycine max
  Peptide Sequence Number=SeqID_134477
atggcatgcatattgatgtatggaaggaaagtgagaagtggtgaaaatgtttacatgcatagcgtgcacgaagcaagcggcgaaggagaaggaagaagagggtga

SEQ ID NO: 42793 - DNA, 243 bp, Glycine max
  Peptide Sequence Number=SeqID_134478
atgatggagataagaaaaataaccacggtaaatttcctcaaaaaagaggaggagcattttctaatcatggtaaaaggagcggaaagcaatggagtcataatgcttcaagctcctattgcaaattatgcaagaaaaataatcatgatacaaatgattgtcggtacaaatgcaaaaagtgcaaaaggcacctacactacgaaaaagattgtttttaccgacaaaaagaagaagcaaattttctag

SEQ ID NO: 42794 - DNA, 147 bp, Glycine max
  Peptide Sequence Number=SeqID_134479
atggtcaaataccgcgccaaatccaatatagagatgaatcgaggtactcggggacgggcacgaatgggcgctaggcccgtgatcaacagatcgttgtcccgcgtccagctccggacgatcgagaagccctcctgggaggcagcctag

SEQ ID NO: 42795 - DNA, 148 bp, Glycine max
  Peptide Sequence Number=SeqID_134480
gtgggttggggagaggaggtcaatctatggtcatgttgggttcccgactcgcttgacaacaatgaagcctcatctagagtttttctcttttggtgatgcattgttgttgatagtccttatcgccacaatgtattacctaagtggatga

SEQ ID NO: 42796 - DNA, 756 bp, Glycine max
  Peptide Sequence Number=SeqID_134481
atggttaatgttcccctcaaaaaaaaaaaaaagtgcaggttagctcgcctgggcagtcaccgctttaggagcgctgtacaccagcagcgcttcgaggccatcaagggatggtcatttctccgggagcggcgcgtccagctcagggacgatgagtataccgatttccaggaagaaataggtcgccggaggtgggcatcactggttacccccatggccaagttcgatccagaaatagtcctcgaattttatgccaatgcttggccaacagaggagggcgtgcatgacatgaggtcctgggtgaggggtcagtggatcccgtttgatgcagatgctatcggccagctcctgggatatccgttagtgctggaagagggccaggagtgcgagtatggccagaggaggaaccggtctgatgggttcgatgaggaggccatcgctcagttgctatgtataccggggcaagattttgcccggactgctgccgggagacgggtgcggatcatgcgcaccaacatgaccaccctgactcagatatggatgactttgctgctcagcaacatcctgcccaccgatcataattccgacctccccctgccgaagtgtcagctggtgtcgcaacctacccttcggcgggagggcgacgcgagactcacgggatgcgtgttccacgaaaggaatacgcgcggagttgccaccaacgtttatttgaggaaaacgtcggaaaaaccggaaacgacgcgatctacgaacttttaa

SEQ ID NO: 42797 - DNA, 723 bp, Glycine max
  Peptide Sequence Number=SeqID_134482
atgcgggacatgcggtcatgtttaaggggcctttggattccttttgatgcagacgccctcagccagttcctaggtgacccgctagtgttagaggagggccaggagtgcgagtttagtcagagaaggaaccgggacgatgaatttgacgaggaggccattgcccagctgttatgcataccgggtatgccacctatcaggcaccctctaaacccaaataagtctaacagggccctgggttttccagcattgatcacgggtctctaccagtcattcggggttcccgtcacacctagtaaggtgattcgaccatcgatcacccgagccttcattgagaagtattgcatgcctagacaagcgcaaggtgatgcaccgcaggccacagatgcaccgccaccacctcatcaggctgatccagctgggtcatttggcatggagcggtatttacagcacttggttcaccagcaggcagccaaccacagggggcaggtgcaaatacatgagtgtctctaccagctcagcatcagtcagcagagccagggtttcgttccttttgcgtgccctactccggatcagttcagggctgaggttgcatggcccggagattggcctaaggcccaggcaggagaggctcccgtagaggctcccggcggtgcagaggaggcccgcatggatgaggagatgacagatttactcggtttcttgggagggagtggagccacgtga

SEQ ID NO: 42798 - DNA, 472 bp, Glycine max
  Peptide Sequence Number=SeqID_134483
atgggggatcccatcagcagactctccttccctgaactacgtaggtctgagttcctcattggaggatacgtaggagcaagagcctcgcttttgtcgaccacaccgccttttgtcgccatgactcaagagctggtagcccgcggagacaccttacggttatccgcacctcgtcattcagtgaccccaagtgtgattgacgagcagagaccaatatggtcatctgcgccctttccggagatgtcatcattttccgatggagacttttcaagtctcacaagttatccagaactacgtaggtctgagttcctcattggaggatacgtaggagcaattttcggtcatgtgacgtgcacccttgtatcatccagaggcggcgggcccgatgatacgcggagataccttacggttattcgcacccttttgtcatccagaggcggcgggcccgatgatcaagcaggaataccagagtttg

SEQ ID NO: 42799 - DNA, 252 bp, Glycine max
  Peptide Sequence Number=SeqID_134484
atgatgctgatgttcgaaaaatgttcaacattgaacctatcactaccatttgtggaggtatttgtcataatttgtgacaataataacccaccaagccaccaatatgactcaacctccaatcttgaggacttatcagatgaataccagacttgttggatcaaaaatcatgatagtgatactgactcctcttccgagcccgaaggaagtaacttgtctccatcccatgaaacaatattcaaacaggattggtaa

SEQ ID NO: 42800 - DNA, 309 bp, Glycine max
  Peptide Sequence Number=SeqID_134485
atggctctagaggaggtgaagtctacagaccagatcccagagccatccccagcacccatacctaatgatgccataccatctgcaccagcatctgatttttatatttcagttcttttaaatttcagcacttttagttgtttgctgccattagaagagaatgagcatgttattggaagtatgactgaaaatgttagtcagtttgtcagattgattgtgaaggaatgcattaaccgcatcccggagagcatcatccacaggaagcgtggttcaaagaaaattttccctaaatttaggggagtatttatcaag

SEQ ID NO: 42801 - DNA, 312 bp, Glycine max
  Peptide Sequence Number=SeqID_134486
atggaagaggagggatgtgctgcttctgcaaatcagaattaccagtggaagattcacctgcacagaaattggaaggttgtggaggggcctcaactgttggttctttctggggctgttgctgttgttggattggtggaggaatgtcataattgttctgctgtggttgattttgctgctgaggttgaggaggtctattgtaaatatttgcagtataagcttcgggctgctcaattgctccaggttgctgcatggaagggcaaaggtctgtatggtggtcagcagaggagcacaaaccgcagacccttgcgacag

SEQ ID NO: 42802 - DNA, 144 bp, Glycine max
  Peptide Sequence Number=SeqID_134487
atgaagtcgttgagaggaaaggagatcccgttggtgaaggtgcaatggggaaccgatgagggtgattctacatgggagttggaggataggatgagggagttgtacccaaaagtaggaatagcgggggcaagatatgcgggttag

SEQ ID NO: 42803 - DNA, 1164 bp, Glycine max
  Peptide Sequence Number=SeqID_134488
atggctccgaagaagctttccacaaagaggtctaggagagacgccacggcggaagggtccaatgctgcccccgagtttgatagccacaatttccggagcgtcgggctccagcagcgcttcgaggccatcaaaggatggtcgttccacagagagaggcgcgtccagctcagggaggatgagtatacaagtttttggggggagatagctcgcaggcattggacgtcacaggtgactcccatggctaagtttgaccttgaggtagtcctggagttttatgctaatgcttggcccacagaggagggagtgcgagacatgcgttcatgggtaaggggtcagtggattccctttgacgcagatgccttcagccagttcctaggtgacccgctagtgttggaggaaggccaacagtgcgagttcaaccagaggaggaacagggccgacgggttcgacgaggaggccattgcccacctgttatgtacaccggggcaggattttgcccggaccgctgcagggaggcgggtgcggatcatgcgcaccagcatgaccactttgacccagacgtggatgacattgctgctcagcaatgtcttgcctagcgatcataactccgatctccctctgccaaagtgccagttggtgtatgccatcctgacacggatgaccgtccacgtggcccaggtgattgctgacgccatctatttgtttgcaggtatgccacccaccaggcaccctctagacccggataagtctaacagggccctgggatttccggcattgatcacgggcctctgccagtcgttcggggtttccgtcacccccagtaaggtgatccgatcgccgatcagccgggcctttatcgagaagtattgcacgcctaggcaggcgcagggtgatgcacctcaggccgcagccaactaccgggggcaggtgcagatacatgagtgtcactaccggttcagtctcagtcagcaggagcagggtttcgctccttttgcatgccatactccagagcagtttggggctgaggtcgcatggcccagagattggcacgaggctcaggcaggggaggagcccgcaggattccccggtgaggcagaggaggcccgtatggatgaagaaatgacggacttgcttggtttcttgggagaaagcggagccatgtga

SEQ ID NO: 42804 - DNA, 207 bp, Glycine max
  Peptide Sequence Number=SeqID_134489
atggaaatacaagaaaagggaagaagccttgagtttcaagaacctatggatttgaggtcaaatccttttcaaggggtagggaatgatgcaatcctaccgcccccaaaggcattggatagaagactccaagaagattgggccagagatgcaaaagaagaccctagggttctcatgagccttagggtagattttgagcccatgagctaa

SEQ ID NO: 42805 - DNA, 480 bp, Glycine max
  Peptide Sequence Number=SeqID_134490
atgactatgcagaacatgcagtttcagcaagagaccagagcctccattcagagcttaaccaatcagatgggacaattggctacccaattgaatcaacaacagtcccaaaattctgacaagctgccttctcaagctgtccaaaatcccaaaaatgtcagtgccatttcattgaggtcgggaaagcaatgtcaaggacctcaacccgtagcaccgtcctcatctgcaaatgaacctgccaaacttcactctattctagaaaaaggtgatgacaaaaatttacctaacaatttctgtgcaggtgaatcttcttccacagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtgttag

SEQ ID NO: 42806 - DNA, 798 bp, Glycine max
  Peptide Sequence Number=SeqID_134491
atgacgtctaaggcagcaaaggaaattgctgacaagattgcctcacaggatttttttgtcacccatggatgtcaagatgtattgactgctgccattgggcgactagaacaccctagtcgtgtgcgtggtgctagacccggtgtaatgatcaagaaatactttggaccggcttcaaggacctctcgcacgtcttcctccatggcttccaaagacctagagaagctgacgcaaaaaatcagggaccagctggaggaactcgcgctgcctcctgagtttgaggggtccacaactattcacaatattcctttgctccttgatcaagtcaaggttggtgttgaggaggttagagatgcagatgctcccattcctgtacccatagaaaaggttatgtgggatgctaccgtgtttggggtgtttaatgagaacttccccttgtacataaagcatgaagatttgtctaaaatagcaccggtggtcaatgtctcagcatctctattatacagttgtggattccgtaagcatatgactaagacaagtatgcgagcagggaatgccgagaattcaaaacgggatgtgtacctaggagcctacttgaatgggctagacaactacctccaaggaataattaacagtgctttgaaaggacttgacgatactccacaaagtaaatccaagtctgctgctaggtggattgttgttaaatatttcaatgatgctagactattggaaccagagagattgaaggcgcttcgcatccagtgggcaaagtattatttgaaatttaaaaatgaaacctag

SEQ ID NO: 42807 - DNA, 450 bp, Glycine max
  Peptide Sequence Number=SeqID_134492
atgagaaagcgccacgcttcccgaagggagaaagccggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccattcatcttccaagaagcaaaggaatccattgatgaagaagatcctaggcctacaagctccaatggagcttacatcaaaagggttcgatcttatgagaaaagcaagagattgactctttga

SEQ ID NO: 42808 - DNA, 276 bp, Glycine max
  Peptide Sequence Number=SeqID_134493
atgcgtaaggagaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccttgaaaaagaagagaattttaatttcttaccttttagaaggaaattga

SEQ ID NO: 42809 - DNA, 498 bp, Glycine max
  Peptide Sequence Number=SeqID_134494
atgcttcagagcattcatcaaggacaaatcattttacttcagagtttacaggtggtggcacctccaggatccattccttccattgcgcagtttctggagagggtagcctggcctggggcccaaccttttcttcatagggaagatgaaggtcccacagcccaggaaccccgacaggtacaagatgcttcctctaggaccaccattccagagccatttacttttctacaggatgcaggtgaagagcaagttagaccaaagactaccaccactcttgagagatctcttgagggcacttcagatccccctgctctagtggtagacctctcctcaccacaacttgcaactgacccctctactcctgtagttgatacaccagaggaccagactacactagtcctgactctgaacacttctcctcctgctactccagtacttcatctaacagatgaagaggatgttcatactcgggatacacaggacctgtctcagggattttaa

SEQ ID NO: 42810 - DNA, 732 bp, Glycine max
  Peptide Sequence Number=SeqID_134495
atggagccccggcgtgacgcgcgtaatccaccccgtcgcgccggggtcctggccaaggagatggcaatgtacagatgggtaagcggcttcatcagctatcgcacgttctatatctggcgggcgcgctatcgctactacacacggaacctggatctgtggacgctgatgagcggtctgtgcatcgtcggtctactgctggtcctgtggtacatgtggcagatgctgggcgtgccgccgccgcgcatacatccggatacagcggcgctgcgcatcgagggcgtcacccacgaggcgatccatcgcatcgtgctggtgcgccacgctggcagcacgcggggggccgagttcaccacgccggaggacgtgcgggcgagtacgctgcgcacgatgcgggtgcggcaggtgatggacagcgaggtggtgtggcgtctgaaggccgacatgctggcggacattgctgactacatcaacgtcacaggcgggtgcttcccctacgactgccggcagattcgggatcggttggatcctgtgcgcaaggccgctgtggagaatgcgcagatcaatgcctcactggcgacgatcctggacgtgccgctggaccagatgccgctcttgaagggcggcgagcgtgagcgggtgaagagtgggtggtcggatacgttcaacgacgtctactttcaggccggcttgctgcgggaacctgcaggccatgcatgcgcagatgatgcggga

SEQ ID NO: 42811 - DNA, 397 bp, Glycine max
  Peptide Sequence Number=SeqID_134496
atggctccgaaaaagctttccgcaaagagatctaggagggacgccgtggctgaagggaccagtgccacccccgagtttgatagccaccgtttcaggagcaccgagcaccaacagtgcttcgaggccatcaaaggatggtcgttccatagagagagacgcgtccagctcagggacgatgagtacacagattttcaggaggagatagctcgccaacatgccctcagccagttcctgggtgacccgctagtgttggaggaaggccaggagtgcaagtttagtcagaggaggaacagggccgatgggttcgacgaggaggccattgcccagttgttatgcaccctggggcaggatttcgcccggactgttgcagggagacgggtgcggatcatgcgcacca

SEQ ID NO: 42812 - DNA, 366 bp, Glycine max
  Peptide Sequence Number=SeqID_134497
atgactaggggcaatccatgtgatttacaaccctttgatcctgaaatagatagaacatttcatagattagttaggcatagtgtgcatcctggtcattctgtgcattttgagcattttgagcattctgttgagggtaattttgaatattctgattttgagcattccactactacttttcatactgagaacatggcccaacctctacctcgtgagaggactcttagggagacggctgcacctgatttcacttatgaaaacttgtgcattcaatatcctgataagggtgttccatatgttctcaagactggactagtgaagatcctcataagcatcttaaggagttccatattgtttgttccaccatga

SEQ ID NO: 42813 - DNA, 267 bp, Glycine max
  Peptide Sequence Number=SeqID_134498
atggtccccagtggagtcaccaactgtcgcaacatgcccttttgcgggcgtgcgaggcgaggctcacgggtgcgctttccaaaggaggaaagatgcgcggagtcgccaccaacatttatttgtgggaaacgtcagaaaaaccgaaggaaaccggtcaaaacgaaaattctaagttcgggagttgtatttacgtttgaggaaggtcgacaaaagtggggcttttgctcctacgtaccctccatcgaagaggaaatcagacctacgtag

SEQ ID NO: 42814 - DNA, 483 bp, Glycine max
  Peptide Sequence Number=SeqID_134499
atgccgatctccccctgcggaagtatcagttggtctgtgtcgtcccgacatagggatcgcacccacaagacccagtggacccggaggagtccgacagggccctggggtttccaactctggttacgagcctctatcagtcctacagggtgcccatctccccagcaaggtcatgtccatcatgcgataggggatcgcgcccacaggacacccagtggacccaaagaagtccaacagggtcctggagtttccagctctgagttacgggcctctgtcagtcctatacggagtgctctcgtcacccccagcaaggtcatcgggcctcctactaaccgagctttcatcaagaagtattgcgcccccaggcaggcagagggcgagacaccacaacagcctggtgatggacatcaacaggcaacaaatgcaccgccgccacttccagtgcccctcagctcatccacaaaaaggttagagtattgcctatga

SEQ ID NO: 42815 - DNA, 240 bp, Glycine max
  Peptide Sequence Number=SeqID_134500
atgatgattggaggtggaattacctggatgttgtggaagcttgggaggattgatagggacccgacgttgagaggaatgaggataagggctacgtgggagtacgtgagctcagttggaggtgggcaacaggggatgatatgtcgcgagggtcaggagaccttggggacgtctggtgcggtgctattgcccaaaaccaagcttgaccaatcccgacccaacccgggcatagtcagtcagtga

SEQ ID NO: 42816 - DNA, 471 bp, Glycine max
  Peptide Sequence Number=SeqID_134501
atgatgacacatcacttaggaaacggggcaaaggcaacagtacaacaactgcagaaggttcttggcatgacattgctagtagtagacggatgggaccacgggaagaggatggaccaacatccttctttttcactaatttttagtccaactacaaggctaaggacatgtggaactagaaagaaaagggtggtggagaagttggagagaaaagatatcagagggaatcagagtactaggggtaatgaatcgtcgtatgctaggttcatcaacaaacgatcaatgttattcattgacagaaaaggtagaagacaatcagctatcccaatgcatggtgtttctttcaacccaaaggaggaggacaaacaaaggttgaatagtatgtggggagaatggtcaacagagatgattcatatatcacccaacagaagcttaatcttgaaggcatttttgttggaaaagtggcctcaataa

SEQ ID NO: 42817 - DNA, 357 bp, Glycine max
  Peptide Sequence Number=SeqID_134502
atggggcaggtctccggctttgatgaggagactatagcacagctactatgcataccagggcaagatttcacccagccgctacaaggagacgagtggatcgcgtcccctatgaggagccccttggacctggagaagtccaacagggccctagggttcccagctctgatcatcaggtcccccattaaccgggctttcatcaagaagttttgtgccccctggcaagcgcagggtgaggcaccacaacagcctagggatggccagcaactggcaacagacgcacgaccaccacctccaaagttcacctcagctcatatacaaaggctagagtgttgcctacaacctgtggtcgaccagtag

SEQ ID NO: 42818 - DNA, 231 bp, Glycine max
  Peptide Sequence Number=SeqID_134503
atgtggaactctaacatgtctcttgccactctaggaaagtacaggacacaagagagcttgtcccatcttcaagaaaaagatggagaagtcttcaagaaaaagatggcctcagcaaatcttagtttccagaaaagaaatgaagacctccatcacatggagattaccactactggaaaacccgaatgcaaatttcttattgaggcaatagaaaatatctgggaagagaaatag

SEQ ID NO: 42819 - DNA, 459 bp, Glycine max
  Peptide Sequence Number=SeqID_134504
atgtctgaccggccggaggatctggcggcggcgtggcagcaggcgctcagcgccacccgaccggtagtgctggaggtgaaaaccgatccggaagtggccccgctgccgccgcatatcacgcttaagcaggccaaagcttttatgtcgtcaatggcgaagggcgaccgcggcatggcgcaggcggggatatttgcgatttttcattatgacctccttgtgtgtaaagaatgtgctccttttatttgcggaaagccattagaagaggggaacgttggaagttgcattccagatattcagagtgcgatgaatgggttatttttagatgagtgcgggtttttaccaggtcgccataaatggcgaccctacaggttagggattgtgtttggtcgtagtaaatggcaaaaccacaggacggacgccataaatggcgaccccatcgaacggcgcagggttttgtag

SEQ ID NO: 42820 - DNA, 114 bp, Glycine max
  Peptide Sequence Number=SeqID_134505
atgactaaagcacgtcaaaagggggtacggaaaggaaaagagggagaagcttgccacccagctcgcccaggcaagctaggttgcttccttggaggaacttcctggaaggcctaa

SEQ ID NO: 42821 - DNA, 432 bp, Glycine max
  Peptide Sequence Number=SeqID_134506
atggcggcacagctaatccatgatcaagtggagatggagtgcttagagggagcttgggagaccctcgaaggcaatgcgaggtgccgatttcggggcacaatccgattcacggctacttcattggtgcatccagatgaacctgcacgtacgcttcagcgcacggtggagtggatactacccacgcctacaccatatcgtctagtggagccagtccaagtgatcgaagtaacatcgtccgaggaagaccctgaggaggatcttgaggggctacctctcgagcctgctgtggatgctcttgattttctagaggatgatgaggacccacttcctgaggtggattctcccgaggaagtcatgtcggtatctgaggcagactctacggaggatagtggccctggagagatggcgatcagcggaggctcttcatcctag

SEQ ID NO: 42822 - DNA, 348 bp, Glycine max
  Peptide Sequence Number=SeqID_134507
atggatagatttgacatctttgtcccacatcctctcataattacatctttgcttccactggaatatgggtgcgagccattgatttgtttgctcaaacaactgacgctcctgagtgttgacttccaagatagttcaatcaaagattactcgtcttgcatgttagtgggggttccctgctacaaggtcatgacgaaagacaacaattggtacctcaaagccttacactgggcaatgaggggcaccatgtatgagcctcaagtgaacataggggccgatcaaaagttctcacccatcgatgtttttaaacaaaaaaagggacaaaccctaggatttcaatggattgattaa

SEQ ID NO: 42823 - DNA, 99 bp, Glycine max
  Peptide Sequence Number=SeqID_134508
atggctgatggaaaactgatagagatgaagggtagagttaacctagggtttaaaagactgtgggaaagcttggactgtgcaaaggaggaaaatgagtga

SEQ ID NO: 42824 - DNA, 834 bp, Glycine max
  Peptide Sequence Number=SeqID_134509
atggcggaaccatcaaagaagcgaaagggctcttcgagccgaagccaacggcattccgagactcagaaaacgcagattccttcctccatttcctcttcctcattgttctcatccgaagaacaacagatacggtacccaaatcttttctcttctcgttccattattgatccaaaattcattgacatggatttcttttccaatgagagttttgaatgcattcaggcatttgagaactccaatctcattcctttcatgtctttaaaattacctgtttattctgaattagttaaagccttctattctaatcttgaaattcaagaaggcactttaatttctgaagtttatgggataaaaatggtcattgaccaatccctattctatgacttgacccaattatctagtgaaggtgtaccatttgaaggtacactgaatgatgattggaaatttgatttctctgtgcatgatgcccgccggttggtttgcaccaatcaagcggatatgaccgaaaggcttcttgccggttcattggcttttgaaggccgcatccttcattatctaattgtgcgtattttgcttccaagatcttcaaaccttgcacagagatccttcttaattggtgctgctgtgattgcatcttttggttaccgtaaagagcatgatggctcttgggtgaaaaaaggtgcacaacccattgatgaggaaggacacttaccagttggagaagattcctcgcttcttcaaaggattttggacaggtttgatggtcttcaaacctttgttggtgaaaggtttgatactctggagttacaagtggactgcgatttgatgagatga

SEQ ID NO: 42825 - DNA, 102 bp, Glycine max
  Peptide Sequence Number=SeqID_134510
atggagtttgggccaggaaaggagatgcacgtgggcctagacaaaaaaatgaacaatggaaccatgattctattgtgcaagaaggaaggagggaggggttaa

SEQ ID NO: 42826 - DNA, 388 bp, Glycine max
  Peptide Sequence Number=SeqID_134511
aggagacgaagaggtgcagacccttagggcagaactcgagcaagcccaaacagtcaaagaaaggttcaaatcagtagctccgaagatccgaaaggagaatgccgaacttctgatcttgaaagatgagttgaaggcttgctcaaggttcaaaagaaacttgtctcagcggttatgcgagacggagaccaacatgttagctatcgtcagcaaataccaagaagaggtaaatctagccacgacccatgaacataaagtggcggacgagtatgcccgagtgtacgcagaaaaggaggctagaggaagggtgatcggctcgttacatcaagaggcaacaatgtggatggaccgatttgctcttaccttgaacgggagtcaagaacttctctga

SEQ ID NO: 42827 - DNA, 151 bp, Glycine max
  Peptide Sequence Number=SeqID_134512
gatcacatcatctgatgagaatcccaaagctgcccaaatacagggacctatgacaaggggtaggaccaaacagtcaaaggataccctccaacaaatggtgacagtcatacttgacaaggcccaagtggagaaggacgaaggcccagagtga

SEQ ID NO: 42828 - DNA, 645 bp, Glycine max
  Peptide Sequence Number=SeqID_134513
atggaggccatgaaagagcaaatggccataatgatggaggccatgatgagcgtgaagaagataatggaagccaatgcggttgcaactgccgctaccaacgttgttgctaaggtgaacccgatgcccccatcgggcctcaaccaaatgaatcatccaacctcagctatggtaggcaaagatttgggaagtacgggcggcccccattatgcgcaaagtcaaaacaagcacgccttcccgccacatggctttcctcccaactatacaccacccaatgtagcgtacactcccagtgggaatgtcaataactccactcccatattcattgagagccgacaaccccaaactgatcatgcacatgtctctcaacccatgggtgagacacatgaaatgccccaccacaatctagccgacttcgagccttgcctcggatatgccactgaagggcaggcaattagtggtatacccctacaaaaccctttggagggccctcagtatcacccccagctacacctcttgcattccacaacaagtaaaaaccctcatgctatggcagaaatgggaaagttggatcatctaaagaaaatgctcagggccattaaaggaggtgaagattatgcctttgctaacctagaagagttgttccta

SEQ ID NO: 42829 - DNA, 573 bp, Glycine max
  Peptide Sequence Number=SeqID_134514
atggtgggttacacaccttcaagttttacagatttggtcttcgctagcgaaaggatcaaagtgggtttgaaagggggcaaatttaatcgtcctgcttggacgactgagaaaactggggcaaatgaagagggtgagaatgaaggagaaacccatgctgcgactgtcattcctacatggccaaacttcccaccagcccaacaatgtcgttactcagccaataacaacccttctccttacccaccacccaattatccacaaaggccatccctgaatcaaccacaaaatccacctaccacccaaccaatgctaaacaccacctttagcacgaaccaaaacaccaaccaagaaatgagttttgcagcaaaaaaagcctgtagaattcacccccattctgccataaccccagccaaggttcatcaacctccatttctccgagaatacgactcgaacgcaacgtgtgcttgtcatggagaagccccggggcgttccattgagcattgtagggccctgaagcgtaaggtgcaaggtctaattgatgcgggctggctgaaatttgaggagaatcgcgtgtaa

SEQ ID NO: 42830 - DNA, 438 bp, Glycine max
  Peptide Sequence Number=SeqID_134515
ggtacatcctttgtggcacaagtagagggtacatctacttgggtttgactgagaacaagagagggtacatctcttgtggatcagttctagtggagggtacatccactaggtttaaagagaacaagggagggtacatcccttgtagatctttgcttgtaaaaggccactcgatccaacaagtggtatcagagcaggtttcttgtacaatggcttatttagattctttgtctttcaaaagcattttcaggaacagattactcaaagatgatgatggagaccaagtcaacatgtgtctcatgacaaaatcttctgagaataataaagaagattccataaggaagaaatggtacatagatagtggctgttccaaacacatgaccgtcggtaaaataggtacgaattcttctactcctattgaaaatgtgttgcttgtagaag

SEQ ID NO: 42831 - DNA, 420 bp, Glycine max
  Peptide Sequence Number=SeqID_134516
atggcatcttcttctggaaatcctagctatcttagcatgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcagcatctactataccaggaatatcaatgaaccctattattgaaattgctcaggatacccttttttag

SEQ ID NO: 42832 - DNA, 636 bp, Glycine max
  Peptide Sequence Number=SeqID_134517
atgtttgttgacaaaagcaggaaacgggtgcatttgaaatatttgcagaatctgggagaccttagagagtgcagcagttatgcatggggagctgctgttttgggtaacctttatagagagatgtgcatcgcaacagactataatactaaatcaataggcggtttcactctcttgattcaattatgggcatgggaacgatgcccaacgttagccccctcagttattcctccacaacaacaaaacacgccacttggttacagatggttgggaggtgaattgcatcacataggcaatgacaatttaattgagtttcgtcgtaaattagatgtcatgaaacgtgacgagacacgtatcatactacttatctgttttcaagaagtggaatggcaccagccggatagagtcatgagacaatttggaatgcagcaacctattccgggaccagtaatgcaacccaacaacatacatgacttgacattaaagggaaatgaaggaaaaaattggatgcgactaatgcaacccgcgcttaatgaatggaatagtcgctatgaaaggagagtagagcaaacgccgccacaaacagggaccctcagtctgagctatgaatatatgaggtggtacaggcgtaacacgtaa

SEQ ID NO: 42833 - DNA, 96 bp, Glycine max
  Peptide Sequence Number=SeqID_134518
atggagaaatttgaatctagccccttccaggacattttagacattgggttgcttaaggaggaagcaactgcgcggcaagctcctccatgttgttga

SEQ ID NO: 42834 - DNA, 549 bp, Glycine max
  Peptide Sequence Number=SeqID_134519
tctcgcgtcgccctcccgccgaagggtaggttgcgacattgggtgttgaggagctttagttttggtggttttcaagatactagctcaactttgtttgtaaaggtcagagcaaatgggtcatggacttcaaaaggacaagcaggagggtctaatagctcctctgatggaatgggaagtgcaatggagaagcctgtgattattcctattgttctcagcatggtggtgacaatggtcagaggcactagaggttatttggcaccagaatgggttagtaatcgccctataactataaaagatgacgtttacaactttggaatgcttattttagagatcattggtggcaagagaaatcttgacatgtcctttggtgctgaggactttttctatcctggagctggagtggatgatgaaaggatgtcatctgctcaggccctttttctcgatgccatctgcccgcttagccagatgcaactcatcagggagatgaatgttcttttccaaaggatgaactcgcttagtgcggtaggcccgcttagcgagttcgtctga

SEQ ID NO: 42835 - DNA, 966 bp, Glycine max
  Peptide Sequence Number=SeqID_134520
atggctccgagaaagctttccgcaaagaggtctaggaaggatgctgcggctgaagggactagtgccattcccgagtttggcagtcatcgtttcaggagcgctgagcaccagcagtgtttcgagcccatcaagggatgggacgatgagtacacagatttccaggaggagatagctcgctggcgttggacgtcgctggtcactcccatggccaagtttgatccagatatagttctggagttttatgccaatgcttggcccacggaggagggcgtgcgggacctgcggtcatggggccaagagtgcgagtatagtcagagaaggaaccgagccgatggatttgacgaggaggccattgcccagttgctatgcataccaggtcaggattttgcccggaccgctgccgggagacgggtgcggatcatgtacaccagcatgactaccttgacccagacgtggatgacgttgctcctcagcaacatccttcccagcgatcataactccgacctccctctgccggagtgtcagctggtgtatgccatcctgacacggatgagcgtccatgtggctcagttgatcgctgataccatttatttatttgcaggtatgccacctaccaggcaccctttagacccagataagtctaatagggccataggttttccagcattgatcacgggtctctgccagtcgttcggggttcccgtcacacctagtaaggccccaaacgcaccgccgccacctcatcaggctgatctcgttgggtcatttgacatggagcggtatttacgacatttggttcgccagcaggcggccatccacaggacgcatgtcgcatggctcggagattggcctaaggctcaggtaggggaggcacccgcagaggctcccagcgatggagaggaggcccgcatggatgaggaaatgacggatttgcttgatttcttgggaggcagcggagccacgtga

SEQ ID NO: 42836 - DNA, 327 bp, Glycine max
  Peptide Sequence Number=SeqID_134521
atgggggagaagcttggcacccagctccaggcgagctcggttgcttcctccagaagcaaccgccatctggaggaattttctggaaggcccaagtgggccaggttgctatttgcacccccaagtggtcccaaacgcagaatgaccataatttgtctctgcgttttgttggacacgatcgagcctctggatggcaaaaaggtgtgtggaatgacaaagggcgcagaatttgtctctgcgcgtttatcacccaacttgcgaaatctgaatgacaaagggcgcagaatttgtctctgcgcgtttatcacccgcctcgctgctcctgaatga

SEQ ID NO: 42837 - DNA, 272 bp, Glycine max
  Peptide Sequence Number=SeqID_134522
atgactgttgcagacagtattaagacaggtcttcctaaaaccaataatgctaaagaatttatggggttagtgggagaacgctctcaaacagctaataagtctcttgctgggacattaatgagtacactgaccaccatgatgtttgatggttcgtgtactatgcatgaacatgtcatcgagatgacaaacattgaagaaagactcaagaccttgggaatggttgtgaatgagaactttcttattcagtttattctaaactcattaccatctga

SEQ ID NO: 42838 - DNA, 366 bp, Glycine max
  Peptide Sequence Number=SeqID_134523
atgggtgaagtagaggaggtgcaagagcagatgaaggccgacatggaggccatgaaagagaaaatggccaccatgatgagcgtgaagaagataatggaagccaatgcggttgcaattgccactaccagcgctgttgctaaggtgaacccgatgcccccatctagcctcaaccaaatgaatcatccaaccgcagatatggtaggcaaagatttaggaagtacgggtagcccctattatgcgcaaattcaaaacaagcacgccttcccgccatatggcttgccttccaactatacaccacccaatgtggcgtacactcccggtgaggatgtcaataactccactccgatactcattgagagccaataa

SEQ ID NO: 42839 - DNA, 468 bp, Glycine max
  Peptide Sequence Number=SeqID_134524
atgcagtccacagatgaggagggttttagaaagcctaaacctttggtgatttatttcaccagagacacagctccccaaatgccccgatacccctcagtagttagacctattccattcccatacaaaaacaaccacgcagatacatggaggtatgcgcctccaagcgaaaggaaggaagaagccgccggcatcagctcgctgtcggccaaagtaaccaatatcacggggctgagtggcatgacccgcagcggtcgcatgttcgcaccccctgacctgccgacacagcccgcaaacgctaaagggaaggcgaagatagcggaagaacaaaatgacatagtgatccccgctccgaacgaggatgttccaatgaaaggtctttctgagaaaagggatggctgtggcgagagagaagtatcgctagaggagacaggcgagttcctccgcattattcaacaaagcgagttcaag

SEQ ID NO: 42840 - DNA, 171 bp, Glycine max
  Peptide Sequence Number=SeqID_134525
atgactaaagcacgtcaaaaaggggtacggaaagggaaaagagggaggtggttgcagcccagctcgccaaggcgagctgggttgcttccaccagaaggtatcgccttctgttggaagatcctggaaggcccaagtgggcctgattgctatttgtactcccctgtttactaa

SEQ ID NO: 42841 - DNA, 273 bp, Glycine max
  Peptide Sequence Number=SeqID_134526
atgccaatcaccccctgcaaaagtatcagttggtctgtgtcgtcccgacatggggatcgcacccacaagacacccagtggacccggaagaagtccaacaggagtgtccgcccccaacaaggtcatcaggccccctactaatcaagctttcatcaagaggtactgcgcccccaggcaggctcagggcgaaacaccacagcagcctggggatggccggcaacgggcaacagacgcactgccaccacctctagagttcacctcagctcatccataa

SEQ ID NO: 42842 - DNA, 324 bp, Glycine max
  Peptide Sequence Number=SeqID_134527
atgtcattttcgatgagacaatttccatttgctaaattacatactcctcattttcagacttatgatttcttagatgatggcccaaacccatacgtggtccaccatttagtgtctcaatccactactcctaatgctcaaactcctggtctagttccatttgggcccaactcccctaatattgcaaccggcccaaccattgagccaaagaagaatattgttaattgtacgaattgtccagcgactgcttcccctcctcctagtctagcccttcttcacgtcctagcccacctctttgggctgttacacgcagccaacatgggatag

SEQ ID NO: 42843 - DNA, 215 bp, Glycine max
  Peptide Sequence Number=SeqID_134528
atggctgactctaaacctatctcccctttcagaaaagagaagttgtctgctgtgataagagctaggttaagcttcaagctgattcaggactacatgaaagaaggacataatttcaacgtgttttggcagtctcattatgccatgattgctgccttactggctaattctggtgcagattttgctgctaatcttgtcaagagaaggtcattaacagg

SEQ ID NO: 42844 - DNA, 438 bp, Glycine max
  Peptide Sequence Number=SeqID_134529
atgaaagataagaggaatgaggaagaaaaactagaaagacaaaagaaaaagaaggatagtaaggccttgtctacaaaggccaaagggaaggaaaaagaggaaaaagattcctccaagaagattgttaagaaggaaaatcattttgcaacaaaatgtgatattaaaagagcactcattcttaaacaatctttctaccttctcctatcaagggaaacatctcttagcaccgccatacctcttgagcttgaggttattcatcaagtaaaggagttgttggatgagggtttggttcgtaagagcttaaatatttgtgctttgttggtgcccaaaataggtattataaggcaccaaatccctatgataggtgggactccattaggtagggttcctgaaatatggtttttcagccctaggtgtattttagggacacctgactag

SEQ ID NO: 42845 - DNA, 408 bp, Glycine max
  Peptide Sequence Number=SeqID_134530
atggcctctggtaatcgattaccaaggggtgtaatcgattaccagagtaacagatcactggtaatcgattaccagttatgtgtaatcgattacacagtgcatattgcagaggaaccagcacgcacgcttcagcgcactgtggagtggatattacctacacctactccatatcgactagtggagccagtccaagtgatagaggtgacgtcatctgaggaagaccctgaggaggacccagaggagctacctcttgagcctgctgtggatgctcttgactttccagagggtgatgaggacccacttcctgaggtggattctcccgaggacgtcatgtcggcatctgaggcagactctacggaggagagcggtcttggagggatagcgactagcggaggttcttcattatag

SEQ ID NO: 42846 - DNA, 243 bp, Glycine max
  Peptide Sequence Number=SeqID_134531
atgaggggtaaggagcaatatgacatgcaaatttataaaagaatcaaggatacacctagagccatccattacagccaccaatccaagcattttgatcatgggtttgcaaataactcatctcataaatattgtaaagaaaacaacaaacaaagcaccaaatatcacatggaaaaggaatgtaagaaaaatgacacaaaggtgcagaaaaatcttgaagttgctgcaaaaatggaggctccgtag

SEQ ID NO: 42847 - DNA, 507 bp, Glycine max
  Peptide Sequence Number=SeqID_134532
atggagagaagtatgatagatgctgccagtggtggagcccttggagacatgacccctgctgaagccaaaaatttaattaagatgatggcttccaactcccaacagtttagcgccaagaatgatgctatagtcattagaggagtgcatgatgtagccataaactcatctacatcatctgaaactaagaagcttgaagcttatgctgcaaacatctacaatagacctccgcaacctcagcaacaaaatcaaccacaacagaacaattatgacctctccagcaacaggtacaatcccgggtggaggaatcatcccaaccttagatggtcgagtccttcacaacagcaaccacaacaacaacagccttattttcagaatgtttctggcctaagtagaccatatgttcctccaccaatccaacagcaacaacaacagcagcagcaacaacaacaacccaaaaacagcaaacagttgaggctcctccgcaaccttctcttgaagaacttgtga

SEQ ID NO: 42848 - DNA, 270 bp, Glycine max
  Peptide Sequence Number=SeqID_134533
atggtgagaaaaacaatgaagaagttgaaacagaaaaaaaaaagagatgcagtggtgactagtgaaatagtggaagagaaagtggtaagtgaagaacagaagcagaaatcaaagaaacaagccactaacaaaggtaaagctataattaacattcctttttctgaggcgttcgagcagatgccaacatatgctacattcatgaaggatttgcttacaaagaagaaaaggattgtggatgatgaaatagtggatgctcagccacaacaataa

SEQ ID NO: 42849 - DNA, 456 bp, Glycine max
  Peptide Sequence Number=SeqID_134534
atgcgtagctgggctgttcgcgggctggtcctgctgctggccgtgctggcgttgcctgcggcgctggcacaggcggtgcctggaccgttgccgctcaccccgctgcagcgcgagtacgttgccgcgcatccgagcatcgtcgtgggccagtatgacagtggctggccgccgttcgagtccctccgtgatggccagcaggtcggcctcggacccgattatctgtcgcttctcgcccgtcagctaggcatgaaggtcgaggcgaggcgctattccgactggacatccgtgctggacgcggcatgtcgtggtgagatcgacgtggtgatgaatgtcggtctcagtgccgacctcacccgctgcatggtctataccgccgcttatggcgaggcgccgctggccctggtgggacgcccggatgacctgcgtgcctccgacatccccgaggggatcctctag

SEQ ID NO: 42850 - DNA, 274 bp, Glycine max
  Peptide Sequence Number=SeqID_134535
atggagtctgcaattaagaatctggaagttcaggtgggccagcttgcaaagcagttagttgaaagaccatccagcaactttacaacaaacacggagaaaaatcctaaggaagagtgtaaagctgtgatgactaaaagtagaatggcgattcaagccgaggaaagtagagttgatcagaaggtggagggatttaaacattggctggctgatgaactggcactggaaccaattgatgatttagttgaacttgaagaaattgttgaggaagcagaag

SEQ ID NO: 42851 - DNA, 228 bp, Glycine max
  Peptide Sequence Number=SeqID_134536
atggctccgaggaagctttcctcgaagagatctaggaaggacgccgcggtcgaagggactagtgccgctcccgagttcgatagccatcgtttcaggaccgctgagcaccagcagcattacgaagccatcaagggatggtccttccatcgagagagacgcatccagctcagagacgacgagtacacagatttccaagaggagatagctcaccggcgttggacgtcgctg

SEQ ID NO: 42852 - DNA, 247 bp, Glycine max
  Peptide Sequence Number=SeqID_134537
atggccaataacaatgtacccgctcaaattcccatatgctggaaagtcattaatggtactgtcgcaacctacccttttgcgggcgagcgaggcgaggctcacgggtgcgtcttccaaaggaggaaaatgcgcggagtcgccaccaacgaaggtattagcacctctcacgtcgacaaaaccagggctcttgctcctacgtaccctccatcgaagaggaaatcagacctacgcagttctttctttaagg

SEQ ID NO: 42853 - DNA, 976 bp, Glycine max
  Peptide Sequence Number=SeqID_134538
atgtcccaacatcgtccaacccaaatgttctgtgcctgatgtcaagaaagatgttccaacatcttccgctccaaatgctgaaacactcccctcacccagtgaagagggatcaactgaggaagatgatcaagccgcagaggagactcctgcaccaagggcaccagaacctgctccaggtaacctcattaaccttgaagaagtagaatctgatgaagaacccattgccaacaggttggcaccgggcattgcagaaaggttacaaagcagaaagggaaaatctccccttaagaggtctggacgaatcaagactatggcccagaagaagagtactccaatcactcctgccacatccagaagaagcaaggttgctatcccctccaagaagaggaaagaaatttcctcatccgattctgatgagaactgggaagagctccttgtgattgcaaggagatctataggacctcagtcaaggctgctggaacgtgctgaagacgaatcagcacagttgggaatgattgctactgaaggcttcagggaattcagttgcttcaacgatccctctacattcctcattcaaatctatatctgcttggcattcgtgtttttaccagcatttcccaatagccttctgagatttacgaaatcattccaaacgctctgcttttccatggctacctcatcaaaagaaactgcagcttctggttcaccatctgtcccatcatcttcacaccaggaacaacctgaactcaacatccaacccatccaaataattcctggtcaagcctctgtccctgagaaactggttcccagaagaccacagggagtgaagattgctgaaaaccctagccctgcaacgagtcctagggaagtagacacggagatggacaagaaaatacgcagcattgtgagtagcatcttgaaagacgcctctgttcctgaagctgatgaagatgtcccaacatcgtccaacccaaat

SEQ ID NO: 42854 - DNA, 286 bp, Glycine max
  Peptide Sequence Number=SeqID_134539
attgatgaagatcaatggatgtatgacaatataatgtctgaacaagttgatatggatgatgaaaatgaacaagaatgtgttgcttatgaaaacggatttgtggcggtgattacgaggtcagacacaaacgctggtattagaggaaggacttcatttgtgttaattggttgtgaaagaagtggtcagtgtaggtctaggaagaaagattttgttagaaaagatactgagagtaggaaacgtgggtgtcccttcaagctttatgggaaactagtggttggaaggcaag

SEQ ID NO: 42855 - DNA, 46 bp, Glycine max
  Peptide Sequence Number=SeqID_134540
atggaacacgcatcccgcgagtcatgcgtcgccctcccgccgaagg

SEQ ID NO: 42856 - DNA, 456 bp, Glycine max
  Peptide Sequence Number=SeqID_134541
atgagtcaatattctggaattcaaggccatattgtctcaagtttaagtcacatgctggatgaacacaatgcccatgctaaaagttttaggatggccagggatatattggcagatgatcaagccgataatatcaaattgcaactgatagctgctcgggaaaaagatggtcgtgtatatgatatgccaaatgttcccaaaattgctgtacttattgttggtgattttcatccaggctcaaaaagagatattattgttgaaactcaaaatggagaattacaaagaatccatgaactacaccctagctatctaccactacagtaccctctactatttccttatggagaagatggatatagagctgacatacttcaccgttctacttcatccaacaaaaaaagaaagcgaaattgtctaacaatgagagagtggtttgcttatagacttcaatacatgtaa

SEQ ID NO: 42857 - DNA, 219 bp, Glycine max
  Peptide Sequence Number=SeqID_134542
atgggggcttctggtaatcgattaccaagggggtgtaatcaattaccaggcttagaaatgaaggcagcagaggaatgggtcactggtaatcgattaccagatgaacccgcgcgcacgcttcagcgtactgtggagtggatactacccacgcctacaccataccgtctaatggagccagtccaagtgatcgaggtaacgtcatccgagggaagaccctga

SEQ ID NO: 42858 - DNA, 243 bp, Glycine max
  Peptide Sequence Number=SeqID_134543
atgtcggtggtttcttcttcctctttgttcggaggtgtgtacctccatgggactgcgtggctattttggtatgggaaagggacaggcttaggtgccgaggggtgtcgggttttttgcgaagctgcgcccttggtgaaatatatcaccaaaggtttaggccttccaaaacttctctcatccacggactgcatacatatatgttgctcttctcctccctcatcaccgacttccagtcagccttga

SEQ ID NO: 42859 - DNA, 156 bp, Glycine max
  Peptide Sequence Number=SeqID_134544
atggcaacttctgacaatgttgtcagagctggcctcactcccaaacacagagatgtccagagtctttgttccatgctgacatacaaacagctccatggagatttctttctcacagataagaaggaagaaaacattcttggatggggctataaataa

SEQ ID NO: 42860 - DNA, 342 bp, Glycine max
  Peptide Sequence Number=SeqID_134545
atggtcttcgaagtccaaactcaggagcacaggtcgcttgagcaaatgaaccaatggcttgcactcaattctggatttacatgcgattctcctcaaagttcagccagcccgcatcaattagaccttgcaccttacgcttcaggcccctacaatgctcaatggaatgccccggggcttctccatgacaagcacacgttgcgttcgagtcgtattctcggagaaatggaggttgatgagccttggttacggctttctcgctacaaaattcatttcttggttggtgttttggtttacgctaaaggaatggcctttgtggataactgggcggtgggtaaggagaag

SEQ ID NO: 42861 - DNA, 474 bp, Glycine max
  Peptide Sequence Number=SeqID_134546
atggtttgcaatgaccaggctgacatgactggcagattacttgctaggtcatttactttcgattgtcgcatcaagcactacattattgttcacattttgcttcctcggtctacaaatcttgcccaagcctctaaggaggatttgattctgttgtgggcccttcaaactggtcgtcagatcgactgggcccatcttttcaatactgaatgcataaggcattacgggccaatgcacctctaccatatcctcaccttgttaccctctttcttcatcatttcaaagttcccttggatgatgaaccatttgtcaaggttaaaaggtctttttccattggtgacggtgttgttacctactttggttatcgtaaggacgtggatggtcagtgggtccacaagcaagatttgccaccgcctattcccgacgagtgtacaccatctcctccaccacaaagggacacttcctcttctctgctga

SEQ ID NO: 42862 - DNA, 270 bp, Glycine max
  Peptide Sequence Number=SeqID_134547
atgcctaataacacgcagagactaacgtcgtcttctgcaccttttgtcattcagggacagcgagtcaggcggtggacggagataccttatggtcatccgcgcctttcgttgaccggcaggaatgaattcggcagtttttttcactctcgtcgtccggaaacattcaagtccagcgacgcgaggaattcttctctgctgggcagagacgattgggtgcaatggcaaagggaagtgtcgcggtgtccaactttgtcgttttcaaaacactga

SEQ ID NO: 42863 - DNA, 231 bp, Glycine max
  Peptide Sequence Number=SeqID_134548
atggaggctgaggctgaaggggaggctagtgttcaaggtgatgatgttgaagctgaggaagatgatgatgatgatagtagcgagtatagtgaagtttcagatagtgactttgaagaaaattgggattggacagaataccatgaccctgagacatttacacagacagctgcaacaaattttgattttggtgatgaagacggacattctgatgagttagatactccatattga

SEQ ID NO: 42864 - DNA, 1131 bp, Glycine max
  Peptide Sequence Number=SeqID_134549
atggtgaattccgttttggtgcagacttatttcaaccccgatgaacactggcaaggccccgagatcgcgcatcgcatcgcttttggtggaaacaaggtatccgaagctacttgcaccccatcatcttcgttccgctttataggctccttgccttactgcatcttgataccccatggcttatgggctccacggctactgcagtctgtattctctgcagttggtgatttatacttgtacaagcttgctgcggttctctttggtgattctgttgcaaaatggacatggggcttagctgtggcagcggtggcttgtgctatccgaccaacaagtgcaatcacatggctgtatgttggcctgcttgagcttttcaaggcacatgacagattcaaattcatttttttggaggtggctcctattgggtatgtttttggaggctcactctttcaggatcctggtgcttggacttacctgcttattagatcgtttcatgtatggcacatggattctagagattattatggaactcacaagtggcactggtacttcactcagggatttccagtcatgatcttctctcacttaccattttgtatagctggtatcatttattccaaacaatggaagttttctggccttcttgcatgggttttgggtttctacagtttattaggccacaaggaattcaggtttgccttgccagttcttcccatagctctgatgttttctggttattctttggctgtgatagaagatcccggacccgaggatgccatgaaccaccttgctagggaagctcttcatgggaaagtgaaaagcattctattcctaacgccttgccatgccactccctactattcgatgctgcatcataacctgccaatgcaatttctcgattgcacaccaagtgaagagaaaggagttcctgatgagtctgaccgtttcttgatggaccctattccttttgtgtctgaatatgcaaaaaacaagtctctgcccagccacgttgttttatttgattctgaagaacaaaaattgaagaaccttttaatttcacttgattataaagaggacttaaaggaggatgagatgtatatgtcaaaaggcctagtttattccaaagatataggttaa

SEQ ID NO: 42865 - DNA, 1550 bp, Glycine max
  Peptide Sequence Number=SeqID_134550
atgggttcgcagtcgacgacgggtaacacgaacaagatagtggttcggtcctcgttcgtggaatcgtttcgcggttgcggtatctccgggatccgaattgacaaggaggagttgaagaagcaactaaccatgccacagtatctgcgctacgcaatgcgagattccattcggcttcaggaccccgccgccggcgagtcccgctacattagccgcgctgagggcgaggactccgccgctcctccctgtcccatggtcgtcttcatcaacccccgcagcggcggccgtcatggccccgccctcaaggagagactccagcaactcatgagtgaagagcaggtttttgatctgttggatgtgaagcctcatgaatttgtacggtatggattgagttgcctggagatgttggcgggtcttggcgactcttgtgccaaagaaacacgtgaaagaatcagggttatggttcttacaccgcatgtcatctataaattatgtgccaaacttggctcccgtgttgggtttcttcccgttgtgcacacttactttaaaaaatttgtggaagttgctggaggtgatggtacagttggttgggtattaggatgtctaacagaacttcgtgcacagggtcgagagccagttcctccagtagggatcataccactggggacgggcaatgacctgtctaggagttttcgttggggtgggtcatttccgtttgcatggaggtctgcaattaagagaactctacaaagggctagtaatgggacagttaaccgtttggatagttggcgagtttcactttcaatgcccgaaggtacacctgtggacctacctcactgtttgaagcattcagaagagttctctcttgatcaggttgtgggtctgggctttgaaattgagggagaactaccagagaaagttgcaagttatgaaggcgtgtactataattacttcagcataggaatggatgcccaagtggcttatggcttccatcatctacgcaatgaaaaaccttaccttgctagtggtccaatttcaaataagattatatactcgggttacagttgcacacagggctggtttttcacaccttgcgtaagtgatccaggtctaaggggactcaaaaacattttgcggatgcatatcaaaagggccaatagctcagagtgggagcagattgcaattcctacaagtgtaagggcaatagttgctttgaatcttcatagctatggaagtggaagaaatccatggggtaaaccaaaaccagaatatttggaaaagagaggctttgttgaagctgatgttgccgatgggctcttggaagtatttggtttaaaacaaggatggcacgcatcgtttgtcatggtggaactgatctctgctaagcacttagctcaggcatcagctattcgattggaagtcagaggtggacagtggaaaaacgcctatatgcaaatggatggagaaccctggaaacagccattgagcaaggacttctccacgtacgtggaaataaagagggagcctttccagtcgcttgttatcagtggaaa

SEQ ID NO: 42866 - DNA, 1554 bp, Glycine max
  Peptide Sequence Number=SeqID_134551
atggctaagtgtttctcatcccttctctcttggtttctgatttttttgtttgtgctgctacacacacaaacggggtatggttcaaatgcaacatcaaagtcggaagcgatcatcaacttgagagtaggggtacccctgaaaaatggtttcccccaatttgtgaatgtagtttgggactctcatgaaaagaagtacaacgtatctggatattgcatagacgttttctatgccgttgtaaacattttacctttcaaggtttctctagatattcaaccttttgaggttgaatcacgtgacaattctggagctggatcatacgattcacttctccaacaaatcccagcaaagtacgatgttgtggtaggggatataacaatcctggccaaccgttcaaacatggtagatttcacactgccatatacaggatctggatttaaaatgctagtaacagttcaacatgggaggcaacaaaccatgtggatttttgtgaaacccttcagctgggatctttggttgagcatagtcatcatctctaccttcataggggtctccatactcgtcatggaaagaaatgtaaatgctcctactgatcaggagggtttgccaaatcgaaaaaagcttagccctgcgacaatcttatggacaagtagtggccaagaactgctcgagatttgtgttaatgatatggcttctattggcgttcgtgctcatgcaaagttacactgcaaacttgacttctatattgactttggatcacaatttaagtttgatacgtccaagctgaggccatatagcaacagtgctgagtatcataatgctttaaaaactggaagccaacgtggtggtgttgcagctatattcgatgaagtgccttaccttaaagtcttccttcaagaatacggatccaattacatcatggccggctcgagatatagaaatgatggctttggttttgcattccctttaaactccaatctcaccactcacttttcgagagccatcttgaaggtgactgagagtgagttaatgaatgaaattgagagaaaatattttgggaagaaggatattgaagaagactcgtctgcggaaatttcttccgctgctccaagcctcaactttcatagctttgcagggctattcttgattacagggattagtactttattagcactaatggtctcagaaactgttatttggcgaagggtcattttgatggctaaagcaatcagccagagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgat

SEQ ID NO: 42867 - DNA, 1191 bp, Glycine max
  Peptide Sequence Number=SeqID_134552
atggggaaagagatccgtgatctggctgatcgaaaaaaagacactttaatactaagaaagacagaagcaggcaaggcagtgaaaagagtttacagtacaggttctaattctacacgagcgccgcagcgccagggctatagagacgctccacatccgagtcaatttcggttcgtttcgcgaaccggccttttatcctgggccgggtttccgcataagcctttcgcgatgcgtatcgaatcgtcttctcaaattttcggttcttccttttctctctgtatcgcagcaccctcgcttcccgatccatcccacacaactgcgtcgcgccttgtccacccgacaccacaatcccactcgaatacgacatgtccgacactgtgttcccgtccggcaccactccgacatcaagcgacgacgaagaaacctgtcactacttacgctttggctaagagactgggatgggtagttaaaggaggagagcttcgagcggcaaaaatcgatgtcgaagcaagtctcagattggtggtggtgctggtgattgttgatggggggaggggcgagagaggagaagaatatctccttggacttgatttcgggggcgtccatgagtttggacccgaaattggggttcgggatgagccaggcggcggagtcggagtcgtcgggggcgaagacgtcggaggcagcgccatcgtcggaggggacgacgaacccgaaagaggcggtggcggaggctttgacgatggattccgcggaatcgaagaagggctccacgggaacgcgctcgtggcgttgcgcgagtgggttggcggagtggatgtcggagtcgcacgtgacgcaaagggcggccgcgtcagccttgcacgtgacagaagcgggtgcctgctcgcacacctcacacatccacacgcgctcgtggcgcgacgcgagtttattcgcgcagtgaatcttggaatcgcacgcgatgcagagaaacgcggaatcgaggtggcagaaaagcgccgccgaagccagcttacaggagtcgcatggcttcttcggcggcacactccagccgctcctgaatcccttcaagcctcctctttcaattcccatcgaaaagcacttttgaaaaacgcggctaatggtactaatcctcttattgcgaggagtggaaggaaaaggattagggacttgaatgtgtttggggagtga

SEQ ID NO: 42868 - DNA, 2379 bp, Glycine max
  Peptide Sequence Number=SeqID_134553
atgttccgcttcccctccgtccttctctcccgccgcctccaccgccgagaactatcctcctccaccacctctcacccgccctccctccctctctcccaccccatctacctcatctggggctccaacaccggcgtcggcaaaaccctagtctccgccggtatcgccgccgccttcctcctctcctcccccaccccctcccaattccactacctcaagcccctccaaaccggcttcccctccgactccgactcccgcttcgtcttcaacaagctccgccaactctccctcatccgcaacccccacattcccctctccgcctcccaccgcgtcatcaacgtgtcccctgccgtgacggcgtcaaatccgttggccggcgaggaaggagttgggccccctccggagctgctctgcaagacgctgtacgcgtgggaggaggccgtgtcgccgcacttggcagcggagagggagggtttggtcgtgaaggactcggcggtgctggaaactcttggtgagtgtctcgaagacgtggcggaatgcggggccggtaaggagagatcggaggttctgtgtgtggtggagactgctggtggagttgccagtccaggaccttctggctcgcttcaatgtgacttgtataggccattccgtattcctgccgttcttgttggggatgggaggctaggaggcatttctggaacaatatcagcttatgagagcttgaagctgcgaggttatgatgttgtcgctgttgtttttgaggatcacggtcttctaaatgagggtccactgatgtcttatatgcgaaacaaggtccctgttctagtgctaccacctattccaaaagatccattgaatgacctaatggaatgggatatcatctggtggcctttcactcaacacaaacttgttcctgacggtggggtcactgtaattgattcacgctgtggtgagaacttttctatcttcaaggttcagaagacagaagtcatagcaccacaatttgatgcatgtgctagctggtggactcaaggacccgatgctataatgcagactgaacttgctagggagatgggatatgctgctgcaagatttgggcatgtaatgttccctgagaatgttcatgagccagccttgaattgtgctgagcttttgcttcaaggtgtgggtaaaggctgggcttctcggacatatttttcggacaatggatctacagcaattgaaattgctctcaagatggcgtttcgtaaattttctgttgatcatggacttattgtgcattgtcatgaggataccacaaatgaaagatccactgagcttatggtccttgcacttcagagatcttaccatggtgacacattgggtgctatggaagcacaggcaccgtcttcttatacaggcttcttgcagcaaccatggtacactgggagaggtctttttctggatcctccttctgtctttatgcacaacagtacatggaatgtttccatacctgaagggtatcatttggaaagtctgaaagggaaaagtatcacctttgcctcacctgatgaaatatttcacaagggcagagataagtctgagcttgctacagtttattcatcttacatatcaaaagtattatctggatttagaggaggttcttcgccatgcgaaggtatgggggagggatgttgtacgcagccttacccttgcatatgcaaagaggctgtttccagatttgaacccatgaccaacaagtcaccaaggcacaactttaccgctgcaccagggctcgccctcatcccacatggctctctggatattctaattaacttattttcaccttttctggacattgatcatctcatttggggcctgagctgttatgtagttatccaaggtgctggtggaatgcatatggttgatccactttttcagcgtgtgcttgttaatgagtgtcggagtagaaaaattccagtaatctttgatgaggtttttactggcttttggcgtttgggagtagagactgcagtggagctaatccattgtgtaccagatatagcttgctttgggaagctgttgactggcggaattataccattggctgtcaccttggcaacaaatgctgtttttgattcatttattggagactcaaagggaagtgaagagagaagaggccatgttgtcagttgtgagagcattggagtctttgtgcattgggaggtgcagacccccttgaagtactacaagttaggcactctcaaagcccttttgcatggacattcttactctgcacatgctatgggctgcgctgctgctgttaaatcaatccaatggtttaaagatccttgttccaaccctaacataacttctgaaggaagattacttagggaggtatga

SEQ ID NO: 42869 - DNA, 816 bp, Glycine max
  Peptide Sequence Number=SeqID_134554
atgttggggaggttgtgtttcgctttccaggagttgagaaaacagctcttgaagggtgtgcatgctgttgtcagagagcacttgtttgagaaccccgtaaccgcaagggtgcaaagtttacaagaagatgctgcaccatatcatagggatgtcagtgaatacaagtcaagtctttcaagtcattattctgataacaactcgaagttgaagattgcaatagtttgttttggcaacttgaaattggagagaagtaccttgtttgttgatgtactttctgtcaaggaatttcatagaaacttgtttcttcaacatttgccacctgattttgatgtgctttgtacccatcccatgtttgggccacaaagtgcaaaagatgggtggagtggttttctttttgtttttgataaggttagaataggaacagatgaagcaagaacatcacgatgtgattggtgtctcaacattttttctagtgaagggtgtcagcttgttgaaacgccatgtgctgaacatgatcgacaagcagctggatcgcaatttatcactcccactgtaggaagaattttagaaaagctggattttttggagccaacgaaaattgacacaataggctttgagtctttgttgaatttaatggataacactgttagagacagttttgatctctactttgatttgttcttgtttaataaaaactccaggcaacaactagaaagattccatctagcttttgagtcattgcagaatcagctttttgatcatgtgcttgataacttaaagcaagtattaaaacttgaagaagaatcccatgattag

SEQ ID NO: 42870 - DNA, 561 bp, Glycine max
  Peptide Sequence Number=SeqID_134555
atgtcgcacagcgataccataccccttcacccatcttcccaatccgacatcgacgagatcgagaacctcatcaatgccagcgttcaccaatcagtcccttcggcgagaccccccagtcccccacgcgcctccatccccgtctccgtctccgtctccactgccccttcccccttcatctcttccaacctccctccgccccctcccctccccaaatcctccgtctccgccgtcactccgtccccacctccgcctcgccccggcatcgccacctccgggttcggtcccgcccccaacacgctcaccgagcccgtctgggacaccgtgaagcgcgatctctcgagaatcgtgagcaatctgaagctcgttgtgttccccaacccttaccgtgaggaccccggtaaggccctccgggattgggatctgtggggcccattcttcttcattgtcttcctcggcctcaccctctcttggtctgcctctgtcaaaaaggttttgaccttgttagcggttagttcagctgaaatttctctggttgttaataatcctaggttagaaacttaa

SEQ ID NO: 42871 - DNA, 789 bp, Glycine max
  Peptide Sequence Number=SeqID_134556
atgacatccttccctcccatgacaactcttccttctcttgatcccttcattcttgtgctccctcatcctccttcctccgtctgtgaagttaagttgagtcgagaagaagaaaagaacaagaaagggagagtatggactcgtgctgaatgtgggagaaagaagaggaagaggggaaggacagaatcgacagaagttgtagatcggagactgggcaagaaggtcgcattagcttcttcatcgcgcaatggcccatccctctgctgtcgtctccgtcagaaggccaatcacccacacactgagaggttctatactcaagtccaggaaatcatactcgctaggtacaacaaaacctttgattggtccctaaaggcaaagatgatgggaaaaaaagcaatagaatctgctaggatctttgttgaagagactggaattagtgattctcttagtgccgagcaattcctggtagaaagagaggatatgctggagaagttgtttcctactagtgagcctatgccagaagttaaacaaggcaaaccttctccggatggatttcttgcagcagccaagagatttgagggtggaccggtagatccttctaacattcttgtttttgaagatgcacccgcaggagttcttgcagctaagaatgctggaatgtctgttgttatggtccctgatccaaggctggataagtcttttcttgatacagcagatcaagttttgaactcactgttggatttcaaccctagtgagtggggtttacctccttttgatgataatagagactga

SEQ ID NO: 42872 - DNA, 2094 bp, Glycine max
  Peptide Sequence Number=SeqID_134557
atgcaagactccggctccatgaagatctcccctctggatctcatgtccgccatcatcaagggcaagctcgacccctccaacgtctcctcctcctcctccaacgccgcagctgccgtcctcctcgagaaccgccagttcctcatgctcctcaccacctccgtcgccgtcctcgtcggctgcttcgtcgtcttcatctggcggagatcctcctcccccaaggccaagcctctcgaaccaccaaagcgcgttatcgagaagcttcccgaaatcgaggtcgacgacggcaccaagaaggtcaccatcttcttcggcactcaaaccggcaccgccgaaggcttcgccaaggccatagcggaagaggccaaggcgcgatacgataaggccacgttcagagtagtcgatatggatgattatgctgccgatgacgatgaatacgaggaaaggttcaaaaaggagactcacgctcttttctttttagctacatatggtgatggtgagccaactgataatgcagcgagattttataaatggtttacggaggggggtgagaaaggagaaggatggcttgagaatcttcactatggtgtgtttggccttggaaacaggcaatatgagcattttaacaaggtggcgaaggtagtggatgacatgcttgctgagcaaggggggaagcgtcttgtgccagtgggcctaggagatgatgatcaatgcattgaggatgactttactgcatggaaagaagaactctggccagcattggatgacttgcttagagatgaggacgatacaactgtgtctacaccatatactgctgctgttttagagtaccgggttgttattcatgatccattggaagcttctgtcgacgaaaagaagtggcataatgtaaatggtcatgccattgtggatgctcaacatccagttagggcaaatgtggctgtgagaaaggagcttcatactcctgcatctgatcgatcttgcactcatttggaatttgacatttcaggcacgggagttacatatgaaaccggggaccatgttggtgtttactgtgagaatttgtctgaaactgtggaagaggcgataaggttaataggtttgtcaccagatacctatttctcaatccatactgatgatgaggatggaaaaccacttggtggaagctccttgccacctacattcccaccctgtactctaagaaaagcacttgcacaatatgcggatgttttgagttcacccaaaaagtctgccttgcttgccttagctgctcatgcatctgatccatctgaagctgatcgactaagacatcttgcctcacctgctggaaaggatgaatattcagaatgggtgattacctctcagagaagtctccttgaggtcatggctgaatttccatcagccaaacctccaattggtgtcttttttgcagcagttgctcctcgcctgcagcctagattttattcaatctcctcatctccaagtgactgggaagagactagtaaaaacgaagaccaagttggagaagccttattgaacaattctgtgccattggagaaaagccaggactgcagttgggctcctatttttgttaggacgtccaactttagactccctgctgataataaagtgcctataatcatgattggtccaggcactggattagctcctttcaggggtttcttgcaggaaagattagctctgaaaggagggggagctgaacttggcccttcagttttattctttggatgcaggaaccgtcaaatggactacatctatgaagacgagttgaatcacttcgttaatactggtgcactttctgagctcattcttgccttctctcgagagggacccaccaaggagtatgtacaacataaaatgatggagaaggcttcagaaatttggagcatgatatctcaaggagcttacatttatgtgtgtggtgatgccaagggcatggccagggatgtacaccgtgccctgcacacaattttgcaagagcaggttgtctcttctgggaaggctcaagggtttttgtcttccgtgatattgttcactatgaattttccttttccaccaaaccttttgctgatttga

SEQ ID NO: 42873 - DNA, 195 bp, Glycine max
  Peptide Sequence Number=SeqID_134558
atggggaaagggaggaagggttacatggctctaaagcttgatatgttgaaagcctacgacaacgaggagtgggtgctcttggaaatggttttgagggctatgggtttacccactttgattggtagatcaaagaaggatattttccaatatgtcaagagcagggtttggaagaaggtcaagggtaggaatcagtag

SEQ ID NO: 42874 - DNA, 1083 bp, Glycine max
  Peptide Sequence Number=SeqID_134559
atggcagttgcaacttgccatgaaatcgccaatggcagttgcaacttgccttttggcctgcaaacgctgcaaccagctgcaaaagcctgcaccctggaactcgccagtttgactggcggttccatcttccagctatatcgccaatggcaagggcgatttgttcctgtgcatgtgcaagtcgctgctggtccatgtactgatgatcaaaagtgtgagcttctgtatcattcattagagatagagataacatgcagcagggtccgtacgtgtattggcgtagaggcattaagcataatttctgtgtccctccttgctgttgagaaaatatcagatatatctccattattttttactggtgtgttggaggctgtggttgctgccctgtttatgaatatttatattgttggtttgaatcaattgtctgatgttgaaatagacaagataaacaagccgtatcttccattagcatctggggaatattcctttgaaactggtgtcactattgttgcatctttttcaattctggtgcctctgttgagatggaagaggtttgcagtgcttgcagcgatgtgcattctagctgttcgggcagtaatagttcaacttgcatttttccttcacatccagactcatgtatacaagaggccacctgtcttttcaagatcattgatttttgctactgcattcatgagcttcttctctgtagttatagcactgtttaaggatatacctgacattgaaggagataaagtatttggcatccaatctttttcagtgcgtttaggtcagaagccggtattctggacttgtgttatccttcttgaaatagcttatggagtcgccctcctggtgggagctgcatctccttgtctttggagcaaaattgtcacggttcaaatcttgaaaataggctttccacttgtaggcaagggggaggctaccttcatctaccctccccggagtccactaggtggtagtcttgtgccatttagcaattgtctttttcacaattgtcttctgaattacggaaccgaggtgctccttcactgttgcaaattcagcatagagtttactggagtctag

SEQ ID NO: 42875 - DNA, 1476 bp, Glycine max
  Peptide Sequence Number=SeqID_134560
atggtggaacgcattcctattgaggaagtgtttcagcaattgaaatgtaccagagaaggattgtcctcggacgaaggagccaatcggcttcaaatatttgggccaaacaagctagaggagaaaaaggaaagtaaatttctcaagtttcttgggttcatgtggaatcctctgtcatgggtcatggaagctgcagctgttatggcaattgctcttgcaaatggggatgggaagcccccagattggcaagattttgtgggtattgtttgcttgttggtgatcaactccaccatcagtttcattgaagaaaataatgctggtaatgcagctgctgctcttatggctggtcttgctcccaagacaaaggtccttagagatggtaaatggactgaggaagaagcggctattctagttcctggagacatcataagcatcaaactaggagatatcattcctgctgatgctcgtcttcttgagggtgatcctttgaaggttgatcaatccgctttgacaggagagtcacttcctgtaaccaggggtcctggagaagaagttttctctggctcaacttgtaaacaaggtgaaattgaagctgttgtcattgcaactggtgtccacacatttttcggcaaagcagctcacctggtggatagtaccaaccaagttggacatttccagaaagtgcttacagcaattggaaacttctgtatttgttccattgcagttggtatgttggctgagatcatagtcatgtacccaattcagcaccgtaagtacagagatggaattgacaaccttttggtcctcttgattggaggaattcccattgctatgcccactgtgttgtctgtgacaatggccattggttctcataggctctctcagcagggtgctataaccaagagaatgactgccattgaagaaatggctggtatggatgtcctttgcagcgacaagacaggtacactcacacttaacaagctgagtgttgacaagaatttgattgaggtcttcgcaaagggtgtggaaaaggatcatgtgatccttcttgctgcaagggcttccaggactgaaaaccaggatgcaatagatgctgccattgttggaatgcttgccgatccaaaagaggcaagggctggggtaagagaggtgcacttcttaccatttaatcctgtcgacaagagaactgctttgacttacattgatgctgatggaaattggcaccgggcaagcaaaggtgctcccgagcagatcatgaccttgtgtaacctcagggatgatgcaaagaggaaggtccatgctattattgataagtttgcagagagagggcttcgttcacttgctgttgctagacaggaagttcctgagaaaacaaaagaaagcgctggtgctccatggcagtttgttggtttgttgtcactgttcgacccccctagacatgacagtgctgaaactattcctagagctctccatcttggt

SEQ ID NO: 42876 - DNA, 453 bp, Glycine max
  Peptide Sequence Number=SeqID_134561
atgaagataaagtcttgcaagaagctccagaatgcatcgaaaaatagttgtcttcagatggctgctttagagcaaatgaaagttgataaaaatgttatgaaactggctgaagatcaaaaattgtgttttgccatccttatggagcttcatgaccttatcattttgtcatcatctttcgaggcctcccagtgcaaaattcttaaaagtagtggtaagagttatctagcaaagatattgcatgatcttgaggttgaaaatggtggtgatgctcctcgaattcattccatggatgattattttatgactgaggttggaaaggtggaggatggcgaggcatcaaaatcttcaagttcaagcggaaacaagaagcctgtgacaaagaaggtcatgaagttttgttatgaacctgaaatggaggaggatgtagagcataacgtatacagcaaaaaataa

SEQ ID NO: 42877 - DNA, 798 bp, Glycine max
  Peptide Sequence Number=SeqID_134562
atgggaaccaaaattgaatattccataaatcttctagcaaccttagtagatagaaacaacttagcagtgggtggagtggatgtctgggagcattttcagaacaagcatcaaaggactggaatcaataaattgcaaggtcccatggataggatgcttgacagaaacaatatacaatacatcaaaaagacaatgcagaggcatgaggacatcttcaaacaccaggtaagagaactacaccgtgtatacagtgtgcaaaagatgctgatggatgatctcaaaaacgaaattagacaacagcaaatttggaaccacatgaatgacataaacgtaagccatccacattccattaaacagcaacatcaaacaacacagatttcacaccagcctgatttccatgttcaaaatttgagaggaagaggttttgatcttgaaaggcctgctgaggaagacatttttattcgagcacgtggcttcgatgaaggcgaggcagggcctagctcccacactgcattccagagatgtaaaacaagtactagtggatatgatgaagaaatggaagtggatttgacactaagtataggaggtagccaagttaagaactctcatttaccacaattagcatgctcaaactcaaccaataatgggaaaattaggaagctgaattcatctgcctccttcaaatcagatagaacaggagaatgcagtgaccccacaaccccaatgagtagctccactgtgacatttactcaggaaagaaaggggccacattggctttctcaaggtctaaagcttaaatag

SEQ ID NO: 42878 - DNA, 189 bp, Glycine max
  Peptide Sequence Number=SeqID_134563
atgtgggagcgaaggtggaacaatgaacacagacaagaaagggatgttgcgagaaagactggtgaatggctggtaatggaggaagctgacctccgcattgtgaggattagacgcgaaaaagagataaatcggggaaagttagagttaccagccaatgttgctattgcaattgccatgaatgcctactaa

SEQ ID NO: 42879 - DNA, 693 bp, Glycine max
  Peptide Sequence Number=SeqID_134564
atggcatcagatgtggcagtaaaggtaattagttttatacccaattcattattgcaattccatatgttggatcttgtctattgtctgtcatccttgctatcttcacatcaagtagaagttgcaacaccctgtgctaatgctttgaatttggtaatctcaaatttgagtgctacaagtgagaaggcagttatggaagctttgaaagaaacagagacttccatgcgtattgttggaaatagaaaagattttgctgaaggtgcaaaaaaaattgaatattttgaagagacgactttgcttttgagcacaatactgtggcgctggcctccttctaggttgcctgttggaaatgatgttatacttatgaaagtcttagcaaacatccatacaaggacagatagttctattaaacttacacttttaaagctgtacacatctttatgtattaaactttttccttattatcacccattctcaactagaaaacgtatagaggatggagaagtatttccacaaatgtttgtgcaggcgatgggaaaatcagacccccatgctgttcgaatagaggggtttaggcttgctcaatgtctattgagatcccaagagaattgtttaaaagtggttggtttgtgtggtgaagctcttgttgatgcaataatttgtgggatgaaagaaactgggctgagttctaaataa

SEQ ID NO: 42880 - DNA, 447 bp, Glycine max
  Peptide Sequence Number=SeqID_134565
atgttggatcttgtttattttctgtcatccttgctatcttcacatcaagtagaaggtgcaacaccctgtgctattgctttgaatttggtaatctcaaatttgagtgctacaagtgagaaggcagttatggaagcattgaaagaaacagagacttccatgcgtattgttggaaatagaaaagattttgctgaaggtgcaaaaaaaattgaatattttgaagagacgactttgcttttgagcacaatactgtggtgctggcctccttctaggttccctgttgcaagaaaacttatagaggatggagaagtatttccacaaatgtttgtgcttgctcaatgtctattgagatcccaagcgaattgtttaaaagtggttggtttgtgtggtgaagctcttgttgatgcaataatttgtgggatgaaagaaactgggctgagttctaaataa

SEQ ID NO: 42881 - DNA, 318 bp, Glycine max
  Peptide Sequence Number=SeqID_134566
atgggcaatagggatgcccatcatggtgaaattttagaatccaactacaagcgacatgtagtagccgactttgaaaacactatcgcgggaagcaagattgctagaaatcgtaaagcaaatgttgattcacagaagaaattgattaaaactccagcgatggtgtgcggtgctgcagttaaccaaagaacgcgttcaggaagactccacctttggaggaaatccgatgaaagtgagagggtagcagtagatccattgattgatatgtgtgattctctttcacctgaggctacaaaacgttgccatgccaacaacatgtga

SEQ ID NO: 42882 - DNA, 354 bp, Glycine max
  Peptide Sequence Number=SeqID_134567
atgaaaagagaaaaacatgcttcctatagtagtcataattctttcaagagcctaagtgaagaacttcgtgactattacgaaggaaggcataggtcacatctcagacctcactcccatagaagagaaaaggaaagcctcaagaggctaacattaacctctcatacttccatgggaaggacaatcggacacattacttctcaatgccccaccaagaaaaacatgattatgaggggccaagacatttatagtagccaagatgaagctactacttcaccttccctagtaaaagtgaagaagcaaaaggggaagaatctagtgaagaaatctacccccaagaagaaggacaacctttaa

SEQ ID NO: 42883 - DNA, 222 bp, Glycine max
  Peptide Sequence Number=SeqID_134568
atggcatctagcagaggtgggaatggaagagggataagaggctgcgactctgaatggaggctcttgtctcttgctgaaattgcatattctggatggtcatttgccttactaactcttctaaggaatgctgaggaggagcctcagttgcttgttgtctttgttgtgactgctactgttcctgctgctgtattggaggaggaacatatggcttgcttggactag

SEQ ID NO: 42884 - DNA, 252 bp, Glycine max
  Peptide Sequence Number=SeqID_134569
atgaaacaaaaaggaaaaagaaagaaacatcgcgagggtcgacatgttatagttacgaagtataaatcattcgtaaagagcaaacgtatcttctggaaacaagggactgacgctaagagtttattttccggaataaccgagataagaatggatgaattcattgaactgatgaaagaacataacttggaaagttgggtctatttgtgtaaattcccaaccatagtatcacaatgccataaacgggatgcttga

SEQ ID NO: 42885 - DNA, 267 bp, Glycine max
  Peptide Sequence Number=SeqID_134570
atgacgttgctacttagcaacattctgcccagcgaccgcagtgccgatctcctcctacggaagaatcgcacccacaaagacacccagtggacccggagaagtccaacagggccctgggatttccagctctggggtagcgcccacaagacacccagtggacccagaggagcccaacagggccctagggtttccagctctggttacgggcctctgtcagtcctacagggtgcccgtcccccccagcaagttcatgccatcgtgacatag

SEQ ID NO: 42886 - DNA, 264 bp, Glycine max
  Peptide Sequence Number=SeqID_134571
atgaaaggaaaccaacaaagggtggagtcgccaactgtcgcaacctacccttcggcgggagggcgacgcgagactcgcgggatgcgtgttccacgaaaggaatacgcgcggagtcgccaccaacgtttattcgaggaaaacgtcggaaaaaccggaaaagacgcgatctacgaacttttaagtgaaaaggttcgggagttgtatttacgcacggggaaggtattagcaccccacacgtccgtcccaagggacggcagcctttaa

SEQ ID NO: 42887 - DNA, 141 bp, Glycine max
  Peptide Sequence Number=SeqID_134572
attccattaggagtgattttagccattcttgatcccgtgctcattgctgttttgaaaagtggtcatgcggtcattgctggaaagtcaattgtgctaaagcctccaactcagcttggagctactgacataaagttccaatag

SEQ ID NO: 42888 - DNA, 472 bp, Glycine max
  Peptide Sequence Number=SeqID_134573
atggcgaatcaagaggagtgggtcccgtttatggatgtattagcattgctaatctttggggttgtcctctttccaaacgtggatggtttggtggacctagccacaattgatgctttccttgcatatcaccatagcaaagaaagcccggtggtagctgtcttggcggacctatttgacacatttgaccgaaggtgcaaaaagaattggctcgccaagttaaagattatcaacgaagagaatttcgaagctccggaagaggatgaagaagtccgagctctgaaaaccgaactaggaaaagcgagacttgccaaagaaaaattcaagttggtcgctacagacgtccggaaagagtgtgctgggttacgagaagaaaatgcagctactgcaaaggcccttgaacaagaaaccaagagggctcgcaaggaagagcatggccgtgacaaattccgtggagcgttatggggcaataaca

SEQ ID NO: 42889 - DNA, 330 bp, Glycine max
  Peptide Sequence Number=SeqID_134574
atgccagcatctctctcagctgcaagaagatcaactgcattgccaagctccaactctgcttttagctttagtcggctgagcgactctcctcctggagttaggaatcggcaagagataagagggacgtacttaacagcaaggaagtggaatcaatcccgtttgctacaggattctttcgatctggaagtgggaagacctccctacccaaccttacctaaggtcgagcagtttgaaactccgatccctaacctaaagaagctggttcatcggcttaagccagtcaatctatccaaagagcctaccctacgccaaaagaaggggatcctctag

SEQ ID NO: 42890 - DNA, 728 bp, Glycine max
  Peptide Sequence Number=SeqID_134575
atggatgagaagaaaaagaagcaattggaggaagctactaaatccaaaagcattaacattgtgattgatcctccatctcccatcagacgacacgagaagtggaagatggcccgcaccaagaaaactggccaaatgacgtctgaggcagcaaaggaaattgttggcaagattgtctcacagaattcctttgtcgcccatggacgtcaagatgtactgacggctgccattgggcgaccagaacaccctggtcgtgtgcgtgctgctagagtcgatgtcatgatcaaacaatactttgggctaactccaaagacctcccgcacttcttcgtccatggcttttgaagacttggagcaaaagatcaaggaccaactggaggagtcgatcacagaaaaaggactcgcactacctcctgagcctgaggttggtccttcagctgctcgtgtcagcacaaaggagaggaacgacccagacacgggtaactcagagaactacgggttgtacgtcgaagaaaatcatccctgcctgattgccctaggaagactttatgaggggtcaacaaacattcacaacatccttttgcgccatgatcaagtcaaggttggtgttgaggaagttagagatgcagatgctccttttcctgtacccactcaagaggttcagttagtggggcagacattaacaccttcgttgcttggccgacacatcttgtcaagcgtttatcagaatag

SEQ ID NO: 42891 - DNA, 492 bp, Glycine max
  Peptide Sequence Number=SeqID_134576
atgtttagatgctttgacgatcacggacgtttcttggttgccctacaaccagagagggtggtacgacagtttgggtgcatccaaaccatccctttgccgtcggttactggttcattgtcgtatgaggacatagacaataggtggatgcatttcggggatcttgtagcacccgtaggtgagatttgtgttgtccccggccaggtatcagcgaactacatggagtggtttttccagatatctcacccgttcgttatgccgacccaggaaggcgatgatcccagacagccagctgccccagatgtggatgcatacgtcgagccacatgtcccggaggtttcagtcgcaactgatctccccagacattcaatggttgcttgtgaaggttacgaagcgatcgcagaaaggttggagcgtgtgctcaaccttaggatggttgttgcaggaacagagttacatgatgagatcatggaagattgcctgcggatcgcttag

SEQ ID NO: 42892 - DNA, 516 bp, Glycine max
  Peptide Sequence Number=SeqID_134577
ctaacctcactggatgctctgttggcacaaaacaagttgttgtccaagcaactagagacagatgtacaatttgtggtggagctcatgaatttgaatgttgtatccctaatgaagagcaaattgcacatgaagttaattatatggggaatcagcccagaggcaatttccatacaagtggatatccaggatttcagaacaaccagcagtatcaacaacagagacagtggcaaaatcaccctagtaaccaattcaacatagaccagggtggttcatctacaaggccacaacagcatatgccaagtctctatgaccaaaccacgaagctagaagagactctagctcaattcatgaaagtgtcaatgtctaaccaaaagagcattgagtctgcaattaagaatctagaagtccagctggttgatgaactagcgctggaaccggttgatgatttaattgaacttgaagaaattgttgaggaagcagaaggtgatgaagaaggagagataccaataagagact

SEQ ID NO: 42893 - DNA, 354 bp, Glycine max
  Peptide Sequence Number=SeqID_134578
atgaagttaggtggcaggcagagatacctaagtggttatccatataaacactctttcgctatccgtcagactcagagtccgaagtcaggtggcagtcgggggtaccgtatggttatccgtacctttcatcaaccacaagcaaacgagcccgttaacgcacagagactaacatcgtcttctgcaccttttgtcatccagggacagcaagtcaggtggcaggcggagataccttatggtcgtctgcacctttcgtcaaccaagctttttactctcgtcgtccggagacattcaagcccgatgatgcacgagattcttctctgctgggcggggacgatcaagtttgatagcatgtga

SEQ ID NO: 42894 - DNA, 492 bp, Glycine max
  Peptide Sequence Number=SeqID_134579
atgaccggaaggcttcttgccgattcattggcttttgaaagtcgcatccttcattatctcattgtgcgtatcttgcttccaagatcttcaaaccttgcacaggcattgcgattaaatgctccattgccatatccacacttagtcactctcttccttcaacactttaacatccctcttgattttgaagcttatgttccaatcaagagatccttcttaattggtgccgctgtgattgcatcttttggttaccgtaaagagcatgatggctcttgggtgaaaaaaggtgcacaacccattgataaagaaggacacttaccagttggagaagattcctctcttcttcaaaggattttggacaggtttgatgctctggagttacaaatggacatgcaattcaatgagatggattcaaggatcaccaaggtcaaaggagatgtctctcacatccgcacatgctttgatctaccaccaccaccacgaccatcatcttag

SEQ ID NO: 42895 - DNA, 516 bp, Glycine max
  Peptide Sequence Number=SeqID_134580
atggctgcaagtgacattgctattcttagagttagagcccacgtaccaacaaagaaaattcttctggaacttacatcgcaagatgcgttgttggcacataacaagttgctatccaagcaattggaagcattgaccgaaacactatggtgtgccatctatggtggagctcataattatggctgctgtgtccccaatgaagaaccaactcatgaagtcaattatatggggaaccagccaagacaaaatttcaacggacagtggaggaatcaccctagaaaccagttcagcaaagtccagggtggtccatctaacaggccacaacaacaagggcccagtctctatgatcgaacaacgaagctggaagaaactctggctcaatttatgcaggctgatgagggtagacctgaagaaaaggtggaaggatataaacaacagtcggcagctaagccagcactagaaccagtttctgattttgttgaacttgaggaatttgtggaagatgaagatgaccaatag

SEQ ID NO: 42896 - DNA, 336 bp, Glycine max
  Peptide Sequence Number=SeqID_134581
atggggtggttggaataccaagaaaattttggaggcaaaagcaagaatcttggcagtttcacacctttttcgccaagaggtgaggcatgcttgcccgctagaaagtcaccgctcatgcacagagaaaggaggggcaaggaaggaagaaccagagttcttatttcatgcagaggatttccaaatgttcccttgatggggacgaggggttgcattagctacaatcccgttcttgctataagacaacttggctaccctatgagaggggcgccactagaggatgagctcacgcctgtcatttcacgaggtttcaataagacccacatggagacactttag

SEQ ID NO: 42897 - DNA, 483 bp, Glycine max
  Peptide Sequence Number=SeqID_134582
atgcaggcctttcataaaggtttacaaattgattgggcacatcttgttagatatcgcatgcataaggcattgcgattgaattccccattgccttatcctcaccttgttaccctcttccttcaacatttcaacatccctcttgattctgaaccttatgttccaatcaagagatcattccttataggcgcttcagtcatagcatcctttggttatattaaggagcatgatgactcatgggtaaagaagggtgctagaaatatgggtgaagaaggacatgagggagaagattcatctcttctttcaaagattttggaaaggtttgatggtcttcaaacctttgttggtgagaggtttgatactttagaattgcaagtggatatgcgcttcaatgaaatggagtcaaggatgacaaaggttgaagaagatgtatcttacatccggtcaagcttcgatcttccaccaccgccacctccatcatcttag

SEQ ID NO: 42898 - DNA, 217 bp, Glycine max
  Peptide Sequence Number=SeqID_134583
attacaggttgtaccatctgtggtgaggctcatgaaacaggccaatgtattcccgttgaagaaaacacacaagaaattcattatatgggaaatcaacaaagacaagggtatactcaaggtggattttcaggcttccagcagggtccttataatcaacaaggatagtggaggtcgcacttgggtaatcaattcaacaaagaccaaggtggacccttaa

SEQ ID NO: 42899 - DNA, 414 bp, Glycine max
  Peptide Sequence Number=SeqID_134584
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatgtcctctccgaaccgcaggagatagttgcccatcatacggctcaccaacttcacttgcctctatgggagactcgctccgggcagagaatgaggaggggccaaggatcttcctctcaacagtgcttctcggggctccactctccccccctgaataaggccccgttagcctgggcgaggggatag

SEQ ID NO: 42900 - DNA, 310 bp, Glycine max
  Peptide Sequence Number=SeqID_134585
ggcgcactgccaccacctcggcaggccgatccagttgggccactgggagtggagcgctatctacaacattgggttcgccagcaggctgtcaaccaccgtgggcagcctcagtcaacaggggcagggttccgccccttttgtatgccctaccctagagcagtttggggcagaggtcgcatggtctggagactggcccaatgcccaggcagggaaggagcctgcaggatcccccggtgagacagatgaatcccgtatggatgaagatatgattgacctgctcgatttcttgagagggagcggagccgcatga

SEQ ID NO: 42901 - DNA, 228 bp, Glycine max
  Peptide Sequence Number=SeqID_134586
atggcattagcgcgtgattttcgtagggaaacaacccatggggcaatttggtttagaataggtagcaaaatacctttggcaatttacactttggataggagcaaaatacttggatgtattagaaataccagaatgtgcacgtatgcaatttttgatagccaaagtgctttgagtatgcatgaaaatggccccgaggaagctggcctcaaagagatccaggaaggataa

SEQ ID NO: 42902 - DNA, 533 bp, Glycine max
  Peptide Sequence Number=SeqID_134587
atgggatcaagtcaaaagccttcgcttaaaaagaggttctatcaagtcaaaatcaagagcttagaggtcactagtttacgagaggttgggcaattaatgggtcaacttcaacatcaagccttccgcaaagcctatggtaagatttgggacctagctagggtagaagtctccatggaaccgattgcatccctttcccagtattatgaccagcccctaaggtgcttcacattcgaggacttccagctagtgctgactgtgaaagagtttgaagaaatcctgggatgcccactgggaggaaggaagccatatcttttctctagttctatccctccacgacaagagttgccaaggaaagggcaaaggccttggaaaatcaaggcgaatgggctttcttttattgacatcttggcgcttttgatctttggagttgtcctctttccgaatatggaagggttagtggacctagcagtgattgacactttccttgcctttcatcatggcaaggaaagcccggtcgtcgccattttggccat

SEQ ID NO: 42903 - DNA, 708 bp, Glycine max
  Peptide Sequence Number=SeqID_134588
atgaaaagagaaaaacatgcctcctatagtagtcataactcttgcaagagcctaagtgaagaacttcgcgactattatgaaggaaggcataggtcacatcttagacctcattcccataggagagaaaaggaaagaaatcctcaagaggctaacattaacctcccatacttccatgggaaggacaatgtagaggctaacttagattgggaaataagggtagagcaacaacttaaaaagaagtctacttcaaaaccttatggctctcactcttatgcaaagaaagaccaaggtcaaggcatcttaggggtgacaccttctaagcccaaagatgataaggggaagacaatagaaaagcaagcccctaaggctagtatgcaagagaaaactagctctataaatgaaagtgaaaaagcaaaaggggaaaaatctagtgcagaaatctatccccaagaaaaaggacaaccatcagtggttaaagagaagtgtaaggagacaaacattaaagaaacttcccctcttagacaacctccacatcttctcctttgtaaaaagacacttattagcatgccacacctcttaggcttgagaattattcctcaagtaaatgagttgttggataggggtttggttcgtaaagagctaaaatccttgtgctttgttggttcccaaaataggtattacgaggcaccaaattcctatgataggtag

SEQ ID NO: 42904 - DNA, 540 bp, Glycine max
  Peptide Sequence Number=SeqID_134589
atggtaggagatggtgacaatggtggtgtatatcatcaactagacagatctcagcgcttattactggacgcaatgactacacaaatgcaacatttgttgaaccgtaacaatgaagagctctacaggcgaatagccaaatcttccttgtttattcttaaacctctatcccctagagaagtgtgtgatgaccaaatcagaatgagagaaaagagagaacaagagaaagaaaatagtgaggcaccacagaggaataggaaaaagaagagtgatacacccgagggaaagagtgatacacataagagagagatgaaggtgcaaattgcaaagaagaatgaaagctatgccaagcaagcccacaagaaaaggaaggaagtggtacttgaacccggtgatgatcctggacatttgaggacaaatgttttccaagaagaagggaatgacgagaatcatgaaattggccaaatacaggctaaagacccaagtggagaaggacgaaggcccaagtggagaaggacaaagccctcgagtggagaaggatga

SEQ ID NO: 42905 - DNA, 459 bp, Glycine max
  Peptide Sequence Number=SeqID_134590
atggacctcaacatcgaggaaaaccttactcgacaccagaggactattgctatgggatttgcggggggtagtggtagcaaacccagtactttccccactcagatcacttgttacaaatgtggtaagtcagggcacatctccttaaattgtgctggaaaaggcgtgacctattttaattatggactaaaagggcatattcagagagattatccatatcccaagaaggagcaaaatggtgggggcctgaatgatcaaactggacatccgaaggccactggaagagtctttacccttaacggtgctgaagtttcgaaatccaaagatctaatccaagtgtttgatgattctggagtgagtaaagatatgatgtttatctctgccaaccaagttgtgacatctttaaaagaagatgctcaagtgtacatgatgtatcttgggggtgtgttattaaggttttga

SEQ ID NO: 42906 - DNA, 654 bp, Glycine max
  Peptide Sequence Number=SeqID_134591
atgccattctgtgcgacagagttcatcaacccacaaaagaaaaagcttgttacaagttgtaccatctgtggtgaggctcatgaaacaggccaatgtattcccattgaagaaaacactcaagaatttcactatatgggaaatcaacagagacaaggatatactcaaggaggattctcaggcttccagcagggtgcttataaccaacaaggacagtggagatcacaccctgacaatcaattcaacaaggaccagggtggaccttctaacaggccaatccaacaagggcctaacatctttcagaggactactaagctggaggagactttgactcagtttatgcaaataacaatgtcaaatcataaaagcattgagtcagcactgaaaaaccttgaggtccaggtgggacaactggccaagcagatagctgacaagtcatccaacagttttgtggcgaatacaaaaaagaatcccaaagaggaatgcaaagctatgatgacaaggagtaagaggtttatggaggcggaggatagggatagtgttgtatccaagaagaaagctgctgaaaagaaaggtactgatgaaaagaaagatgatgtgagaggtgaaaggaaccaggaaaaagaaaaacaaataatggtcaagaaaaagaattaa

SEQ ID NO: 42907 - DNA, 493 bp, Glycine max
  Peptide Sequence Number=SeqID_134592
ggtaaaagattggggcactctatggcaagaattgttccctgaatttgagcccaagttgcgttgtggtggtgtatatgttattcagaacgtgaaggttgttgatactcattctgactacaaagtgaatgcaattaaatatttggtttattttgtgaagacaacgtctgtcaaagaggtggacagacatgagattcctcctaatgttcatgtcattacttcatttgctgatataatttcaggcgttgcaaaacttgatactttagttgatattgtgggtgttattgctgaagtgattgaacgcaaaacagttaatccagcatacagagtgactgtcaagttgagagacaatagtcatgttgagatcatcatgactgtgtgggaggaatatgttcttcagctgaatgatgctattgagaaaaaccattttgggcaaaagccattggttgttatgctaactcttgctaagatcaaagaacccaagggtcagtattaa

SEQ ID NO: 42908 - DNA, 567 bp, Glycine max
  Peptide Sequence Number=SeqID_134593
atgcatgatctttacacagtacttagttcctcagatcttccacacgggaatctcaagtccaacaatgttctccttggacaagacaatgaaccaatgcttgtagattacgggttcagccacatggcaccagaggcagcacaacaaggccaggtttcacgcagttgtgatgtttactgtcttggtgttgtgataattgcgatactgacagggaggttcccttctcagtatctcagtaatggaaagggtggggctgatgtggtgcaatgggtggaaactgcaatctctgagggaagggaattagaagtgcttgatcctgagattgcaggctctaggaattggcttggtgagatggagcaactcctccatattggtgctgcttgcactgaaagcaaccctcagtggcggttagacatggcggaagccgttagaaggataatggagattaaattcgagggtggacatgaatcaagaagccttgcaaattctcatcatggtgaacagtcacagaggagacatggaacaaatagcttcgaaagttgggatgatatcgaatatggcagctcctag

SEQ ID NO: 42909 - DNA, 183 bp, Glycine max
  Peptide Sequence Number=SeqID_134594
atggctgtggtcctggaagcagggaaaaatttatctaagaatactctcttaaggtcatcccagctcgtgatggaccttggagcaagacatgtaatgtctttcaagcttgggtcttcacctgcagcatactttggaaggaaggagcaggctgccatgttgttgattgatgaggtggacatctga

SEQ ID NO: 42910 - DNA, 541 bp, Glycine max
  Peptide Sequence Number=SeqID_134595
atgtttgtattattaggtttgcgtgttgatggggcaccattaattggtcaaactaattttgattgggctgaattatgtgaagaattgttgggagtcagaccacaggaaggtgaacttcaaggcagtgtggttaaattaagttggctagctaaccatttttcacaaataaataactatgatggtaatgtagaacaactacaaagatttacccgtgcatggatccttagattcataggacgagtcctatttgttgacaaaagcagcaacaaagtttccctaagagagatgtgcagcgccatcgattacaaaattaaatcaatcagaggtctgtgcatcttaatccaaatgtggacatgggaacgatgcacgactttggctccaaagaggactcctcccgtaatagaaaataaaccacttagacactggtggctgcgacgtggaaatcaacatattggtaataatgatctgatagtttttcgtcgcaaattggatatcatgaaacgacacctactatatgttgatttgaccaacgctgttatcg

SEQ ID NO: 42911 - DNA, 213 bp, Glycine max
  Peptide Sequence Number=SeqID_134596
atgaaggaaggcataggtcacatcttagacctcactcccataggagagaaaatgaaagaaagccttaacattaacctctcatacttccatgggaaggacaatgtagaggcttacttagattgggaaataagggtagagcaaaaacttaaaagaaagtctactttaaaatcttatggctctcattcttatccaaataatgaccaaggtctatga

SEQ ID NO: 42912 - DNA, 579 bp, Glycine max
  Peptide Sequence Number=SeqID_134597
gtccagagggttgcttctgatagcctagtcttcgaacgcttaagaccggtcattaacttggcctatatcaggaagaactgttggaacccagctgatctgacagttactattagaggggctaggagagcaagggcaaggccagctgaagctccttccacatctgcagctcctcctctaacacgtaccttagcagctccttctacccatcttctgcagactttcaacgtcttgaagccatgcttcaaagcatacatcaggggaagattgctttattatgaaagggaggatgagtcatctgagacttccactctagagtccctgatcagaaggaagagggtagttgaaacacaagaagccgcaaccacttctaagaaatctcttgaggccagttctgagccttcaaaaccagtggcaaatacgacttcaattcagcaggcagcagacccctccactcctgaggatcaaactacaccaatcctgtctccgaacacctctccttcagctacccctgtgcttcgcttaacagatgaggaggatgttcagacaccggatactcaggacagatcacaagatttttaa

SEQ ID NO: 42913 - DNA, 621 bp, Glycine max
  Peptide Sequence Number=SeqID_134598
atgtctcctttccttatgagggatttcggcgcacaaaattccaaagctatacaaagaatccataaggcgtgggaaaccccattaaggaaagatcaagaacttaggggcattcgtaatggcgccattggtggttaccatgaatggctgaaattaaaagtcgtcagcgaagagagttttgaagcaccggaagaggacgaagaagtccaagctctcaaaagcgagttaggaaaggcgaaacttgccaaggagaagttcaagttggccgctacacacatccggaaggagtgtgccggattacgggaagagaatgcaaccaccgcacgagcccttgaacaagagaccaagagggctcgcaaggaagagtatggccggaacaaatttcgcggagctctttggggtagcaacaatgaactcaagctgcgaagggaagagagggaccagtcgcgagcgcatagcatggttttgaaagaggagttagttgcctgttcaaggtccaaaagaagcttatctcagcgtttatgcgagacggagaccaacatgctagctatcgtcgccaagtaccaagaagagttaggtctagccgcggcccacgagcataggatcacggacgagtatgcccaa

SEQ ID NO: 42914 - DNA, 265 bp, Glycine max
  Peptide Sequence Number=SeqID_134599
atggctggagtaggtggtggtggtgacgagtaccatcagttggacggcgctcaacgtctgttagtggatgcgatgaatgcacagatgcaacgtttgctagaccgtaccacagaggaggtctatggacgactagaagctttggagaaccaagccaatcagaatgctagacgaaatatagatgggaatagaggtaacaatggcggtaatgacggaccgaggcagaaccaggttgagggagtaaagctcaatgttcctcccttcaaag

SEQ ID NO: 42915 - DNA, 420 bp, Glycine max
  Peptide Sequence Number=SeqID_134600
atgttagatgtgtggaacttgccagatggagaatttatacttgttgaagtagatcattggggcaatcctatgggttgggaagggaaaactctactgaatgcaattgggagcttggtaatgagacaccaatgtgctcctatcaattttcttagctggaaagacatgcctaaggactatattactgacatggaattcaggcaatttaaatatgaactgaaatcaaaaggatatgatgagagcaaaactaaggaggaaatgattgctcacatcccagatccaagggttgatccttctcaatatcgtgatttaaaaataaacaacatcaaccaaaggagccgctcaaaatatgaggacttgcattgcatgggaaccaataatcttccaagacgaattcatgagatggtttgtgggatcctctag

SEQ ID NO: 42916 - DNA, 357 bp, Glycine max
  Peptide Sequence Number=SeqID_134601
atgcatagatctcccacaggcactttagttcctttggacttagaaattgaagctacactaagaaggaacaaggctgagaagagaaggaaactattgcaagacagaacagttgcatccattcttgaggaagagaaccatttttctgattcatcatcatctgattcaccattatcaagggaatccactaatcaattgtctgaaattgctaccatggtagatgagcatgaccagaggactacccttgaagactattcaagattacctaatgaagatccctatgcacacttggcaacatttattgagatttgcaacactgttaagattgtcggtgtaccagatgaagctatcagactctaa

SEQ ID NO: 42917 - DNA, 643 bp, Glycine max
  Peptide Sequence Number=SeqID_134602
cccatttgcatcaattgcaacacatcatcatgatcatcatcaaaacatcaaagccaattgcatctacattgtcgtggtaatcccgtcttcagcatttcccaacagctctcagaaattcacgaaaccattccaaaagctctgcttctccatggctaccgcaccaaaagaaacctcagctcctggttcaccctctgtaccatcatccgccaaagcaccatcaaaccaggaacaacctgaattccatatccaacccatacaaatgattcctggtcaagctcctgtccctgagaaactggttcccaaacgacaacagggagtgaagacttctgaaaaccctagccttgcaacaagtcctagggaagtagacacggagatggacaagaaaatccgcagtattgtgagtagcattttgaaaaatgcttctgtccctgaagctgatgaagatgtcccaacatcttccaccccaaatgtttctgtgcctgatgctgagaaagatgttccaacatcttccactccaaatgctgaagccctcccttcacccagtgaagaggaatcaacagaagaagaagatcaagccacagaagagacccctgcaccaagggcaccagaacctgctccaggtgacctcattgacctagaagaa

SEQ ID NO: 42918 - DNA, 240 bp, Glycine max
  Peptide Sequence Number=SeqID_134603
atgtcaggcatcatcagagaacataggggcatacctcatggcgacttggtcgggtatagatctcgtatagatcatatggagagccatcagttttcttgggtcccatatagaggatttgaagaccacttaccaagacatgcaaatagagacatggacatttggtcagcttatactgtaattatttgttttcccattgtggaacaacatacaatttggactacatcaagatatccttgttga

SEQ ID NO: 42919 - DNA, 219 bp, Glycine max
  Peptide Sequence Number=SeqID_134604
atgaggacgtgtagccctctaaaggcgagggcgtgcagccctctacaggcgaggatgtgcagtcctctgatggcgaggacatatggtcctctaaagattgactgtccttttgaaaaaggtgataattcatgcaatcctatcctatcttttgcaaatctctccgggaactccctcagagtgtatgttctgtttgatttagtcatgaccattttggagtga

SEQ ID NO: 42920 - DNA, 591 bp, Glycine max
  Peptide Sequence Number=SeqID_134605
atggcatctaagaagaggaaagctccatctacacctatccagaccagatttgataggtccagattcacatccctagaggcttgggagagatacactaacattgtggtgcttagaaagctactaccagagaggaatgtggtagtctattacacagagtttgatgagttcaaggaggaactcgagagacgccattgggatgagaagctgactggtttctctgatagtagcatagacatcgatattgtgaaggagttttatgccaacctctatgaccccgagtataaatcacctaagcaggtgagggtgagaggtcacttagtgaagtttgatgaggatactttaaacacatttctgaagacccctatagtgttggaggagggggagaacttgtgtacatatttcagatttgcactcctaaggcctgatcctcaggagttggctgctaagctctgtatcccaaggaggggatttgagcttaatgctgatggacaacctttgaagattctgaggaagaacctgaccactctagctcagacatggaaagtccttcggattcattttgtgtgttcattgttgtatgacatgagatga

SEQ ID NO: 42921 - DNA, 48 bp, Glycine max
  Peptide Sequence Number=SeqID_134606
atggaagaagtggaaaaggagatcttggagaccttcaggaaagtagag

SEQ ID NO: 42922 - DNA, 246 bp, Glycine max
  Peptide Sequence Number=SeqID_134607
atggggaaacaaaagaattctcaagcggttagtcctttgaaatcttttgtttatgggaaagggaagaatcaaaagaattctcagactgtcattttgaattctttgaaaagggagaagggagacacaaaagaattcaagcggttagtccttcattcttttggaaaagggagaagagagacacaaaaagaattcaggcgactcttccagtctggtcaagaaaaccattggaagaggtataacctttag

SEQ ID NO: 42923 - DNA, 751 bp, Glycine max
  Peptide Sequence Number=SeqID_134608
atgggattttccacgaaccaatctggagtgagttacaatattggattgggctacaacagcggccgctatacggacaaacccgacaagatcgccacgcttaacgttcagattccgctaagcaaagggcaatcaaacaactggatgaactatacctcgagcaagagcagcaaaggcaaactcaatcagcaattaggactaagcggcaccgcactggaaaataaccagctcagttataacgtctctgcagctcaaagcggtacccgtgacggctattctggcaacagttcggcttattatcgcagtagatatggtgaaataggcgccggatacagctttgataaagatgtgcagcgaataaactacagtttgcgaggcggcgccgtggttcatcgcaacggcattacattatcccaatcgctgggtgacacaatcgctttagtcgaggtgccaaatgcaggcaacgttgaaatcatcaacagtaccggtgtcaccacagattggcgaggctatgccgtggtgccttatatcaacagttatcataagaatagaattaacttaaatccgcagtcctttgatgattcagtagaaatagagaacaacagccaaaccgttatcccgacgaaaggcgccattgttgtcgccaactttgcatctcacataggaaaccgaattattttcaaagtacatcatcgtgggacggagattcctttcggcgcagttgccacattgcgcagcgacccagggaaatcag

SEQ ID NO: 42924 - DNA, 360 bp, Glycine max
  Peptide Sequence Number=SeqID_134609
atgatcatgaggggtcaagacatttatagtagtcaagaggagactacctcttgcccttcctctagtggaagtgaagatgaagcactccttcttaaacaatctttctaccttctcctaccaagggaaaaatctcttagcaccgctatacctcttgagcttgaggttattcctcaagtaaaagagttgttggatgagggtttggttcacaagagcttaaatccttgtgctttgttggtgcctaaaatagggcttcccatagaccctaagagaataaaggtcattcttgagtggcctactccaccaagtataagggaaatttggggcttcaatatcttagcaaacttttacaaaaggtgttga

SEQ ID NO: 42925 - DNA, 450 bp, Glycine max
  Peptide Sequence Number=SeqID_134610
atgaccataatttgtctctgcgtgccatcggacatgattgtgtctggatggcaaaaggtgagcggaatgaccataatttgtctctgcatgtcatcgggcccgccgcctctggatgacaaaagacgcagaatgaccataatttgtctctacgtgccatcagacacgattgtgattggatggcaaaaggtgagcagaatgaccataatttgtctctgtgtgccatcggacacgattgtgtctggatggcaaaaggtgagcgaaatgaccataatttgtctccgcatgtcatcgggcccgccacctctggatgacaaaagatgcagaatgaccataatttgtctctgcgtgtcatcggacacgattgtgtctgaatggcaaaagggtcaatatgacagagattgtgtggtggccaacaaaagcgaggctcttgctcctacgtatcctcaatga

SEQ ID NO: 42926 - DNA, 666 bp, Glycine max
  Peptide Sequence Number=SeqID_134611
gggatcctaggatgcccgataggaggaaggaagccatacctcttttctgggtactacccttctatggaataccgaggaagtgcttagaagagaaggtgaaaaccctggcaagccaaggagagtgggtatcattcatggacgttttagcactgggttgcattatttataaccctgtgttggccataagacagtttggatatcctatgagaggtgcgtcatcggaggaaaccatcatgcctttcatcacacgagggtttaacaaagcgaatatgaagatacttcagaagatccgtaaggcatggaataaagtgggaaaaaaagataaagagcttagaagaagaagcaatagtgtcataggcgactatcataaatggcttaaatctagaacgcaagggatagcttggcacaaaaagctaaagggtttgaatggagaagaggcaggagtgcccgaggagagtgaagaggtgcaagacttgaaggctgagctcggaaagacaaaagtagagaaggagaagctgaaggtggtagtcactagagttaggaaagaatgtgataagctgaaggatgtcaacatgtccacgactgaagcgctagagcagaaaatgaagaaagccagaaaggaagagtggagtagaaacaagtttcgaggggctttgttaggcagca

SEQ ID NO: 42927 - DNA, 285 bp, Glycine max
  Peptide Sequence Number=SeqID_134612
atggttacttccatgcttcaacttgactcgatgaaccttttcgtaaaagcacgagcttggttcaaccccataacccagggaatggaaattttgatcgccaatacttcaacaatatttcatagggatgaaagactcgagaatacgcatgctacgcatggaaaatgtaattatgagattgagatgcccgaagagacatcctttcttaaccacgcattagaggaaaatacaaggatcatgtatgagcaaacatgtagaacaaaaagtatgttgaacgcatatgcatga

SEQ ID NO: 42928 - DNA, 1187 bp, Glycine max
  Peptide Sequence Number=SeqID_134613
atggggacaaatcaaaacggcaaaaggttttatcaagtcaaggttaaaggtctagatgtcactagcctcaaggaattaggacgattgatgggacctctccaaaggcaagccttccgcaaagtgtacgggaagattctagatttggccgcagcggagatatttacggaagccgtcgtatccctcgcccaatactatgaccagccgttgagttgtttcacgtttggggacttccaaatggtaccaactattgaagagtttgaggaaatattaggatgccctcttggggggagaaaaccgtatcttttctccgactttcttccttccttgagcaagattgcagctggggttggtgattcagcaaaagagttggatcgcacgaagcaaactcggaatggcgtagtgggcctgcctcggaaatacttggaaggtaaggcaagggatatggcgagccaagagaagtggggcccgtttgcagatattttagctttgctgatttttggggttgtcctcttcccgaacgtcgacggtttggtcgacttagccgccattgatgctttcctcgcatattaccatagcaaggaaagtccagtggtggctatcttggcagattgtttgacacctttgaccggagacacgagacacccgtgtccgcttcaaagctatcgctcatgcgccgaaaaaggaagagtcgattgggaccaacatttggctgggttaggaggcagcgcgatcaattggtttcctcgttggaaggaaggtaaggaaggagttcttttctcgtgtggggactaccctaatgtcccactgatagggactaggggttgtattaattataatcccgcactcgccataagacaactagggtatcccatgagggtagcgccaaccgaagaaagtttctcgcctttccttgtgagggatctaggcgcgcaaggtctcaaggttatacaaagaatccacaaggcgtggaggagtccgttgaagagagacaaggagcttaggggcatccgaaatggcgtcatcggaggttatcatggatggctaagaattcatgcgcaagggttagattggctctccaaattgaaatttttcgatgaggagaacttcgaagctccggaggaagatgaagaagtccgagctctaaaattagagctagggaaggcaagactcgccaaggagaagttcaa

SEQ ID NO: 42929 - DNA, 300 bp, Glycine max
  Peptide Sequence Number=SeqID_134614
atggaaaaggcaaaacctgttgggattctggagtctcgccttgacgagagagtgagagatataatcttcggtgaccataatgcatctgaaacattaaggaagttagtagatgggcctaaaagaaatgttacaacttggcaaagatacggtatcaacaagtatttgttttacacaaaatcacaagacgacaagagtacaatgcaaaatagtggtgcacatggctacaccacccaactcacctcctcctccttccgagtcagcaacaccttcttcactgtctacgtcgaagaagacaagtaa

SEQ ID NO: 42930 - DNA, 807 bp, Glycine max
  Peptide Sequence Number=SeqID_134615
atgacagacgaacaagcatcaatttacaaccagattgttgaagttgttaataaagatgaaggagcctctagcggtatagcttctctgttattgcctggaggtagaactgcacattcaaaattcaaaatttcagttccagtttttgaagactcaacttgcaatatccatcaaggaactcaattagctgaactattaaatcagacaagtctgatcatttgggatgaagcacccatggctcacaaattctgttttgaggcacttgatcacagtcttagagatatcatcaaacacaactcaaaggacaataaaatctttggaggtaaagtcatggtctttggtggagatttccggcagatcctgccaatcattccaagaggcagccactctaatattgttaacgcaacaattaattcctcttatctatgggatcattgtcagatcttgagactgacaaaaaacatgcgcttacaaaacaacacgcaagcaacaaatcaagaagaaactgtggcttttgcacaatggattatagatattggtgatgatattattggagatgaaaatgatggctatgctactattgaaattccacaggaactattaatcacagaatataatgatcctattcatagtataattagctctacattcccagatctatctcatcatcacaatgatcgtgaatacttccaaaccagagcaatattagcttctacaaatgaaacaatacaacaagttaatgattatatgcttacaatgataccaagtgatcatatactaaattatcttattctgtttttcatcttttag

SEQ ID NO: 42931 - DNA, 189 bp, Glycine max
  Peptide Sequence Number=SeqID_134616
atgaacttgctaagcgagcatgttgcactaagcgagttcatcaatactcattgtagaatcgctaagcccaggagcttagcgcaaatccttgcggcacatgttcagcttagcgggcactttttcgctaagccaattctgcagaatctaaaaattttgcaacttccgctaagcggctccacatgttgctaa

SEQ ID NO: 42932 - DNA, 661 bp, Glycine max
  Peptide Sequence Number=SeqID_134617
atggctccacctaaagaaattgcgaccatcatttaccacaatggtcatattgtagacgatccagttcaaggatcgatgtacacttgtacgaccccaatatttttttacgtcagtcgttctattacgtttacacaattcattcgaaaaattaacaatcgtctccctactcgagcaactgaacaagttgctcaattgttatttcgtgtccctatttcatttcatctcggtcagacacgttttatttcagctcaactattcgacaatgatgatcttagaggcgcaatggaaacaattctccagaattcacaattgaattatgtcaaattctatgctattactgagcttattcgtcaaccacaaccatcgtgtccacaactctcatgtccacaactacaactaccgcctccacagcagttactgtacaacaacatagacctcaataatccagtatcttcatacaacaaccttgaatcacaagacccttttgacatttatgcttcatacacacaaatattatccgagaacgattcttttcttcatggccaacaaacctcctttgaccaacaaaaccatttaaagaaaccacttatgttggctggttacgcatgcacggagaagatgcactggcgacatcttggggatattcgtgcgaataagccaa

SEQ ID NO: 42933 - DNA, 258 bp, Glycine max
  Peptide Sequence Number=SeqID_134618
atgtcgggcaaacccaacatgaatggtgtagcagaacgaagaaaccaaacacttaaggatatggtgagaagtatgattagtcattcctttttgccagatgatcaagtccttgtacctattactgttcaagacataatttcagtaatagaagacaatgttcaaactattaacattgttccaaaacaagacaacaatgaggttctccctcaaatacctttagagcagcctcaacaacctcaagaaggattcaaagggtaa

SEQ ID NO: 42934 - DNA, 438 bp, Glycine max
  Peptide Sequence Number=SeqID_134619
atggcgagtttggtctcagtgaaggactcgccactaccagtggcgatatgtccatgcaagacacaaatcgccagtacgaatggcgatatacacaacgcgaggaaaccgccagtcaaactggttgcaggagctttttcagagaaaggggagttgcaactgccattggcgagttgcctgcaagttgcaactcccattggcgatttagacagaaaaaatagccatcacgaatggcgattttgtgcttataaatactcttctttcacttgtgtgctcactcacgttttcagctgttcttcaaatcagaaattcttccctctttcagttgtagctgtgtgtgctcacaatcaggcgagccctggtgcagcggtaaagttgtgccttggtgacttgttggtcatgggttcgaatccggaaacagccctctttgcatatgcaagg

SEQ ID NO: 42935 - DNA, 255 bp, Glycine max
  Peptide Sequence Number=SeqID_134620
ggtacatcctttgtggtacaagtaaagggtacatctacctgggttgttgtgactgagaacaagagaaggtacatctcttgtggatcagttcaagtggagggtacatccacttggttgttcaaagagaacaagggatggtacattccttatggatctttgcttgtaaaggattttacaaggttgaaaagaaatctcaagggctgtaggttgcttagggactggatgttggcacgggttgttgccgaaccagtataa

SEQ ID NO: 42936 - DNA, 831 bp, Glycine max
  Peptide Sequence Number=SeqID_134621
atgatttacatatcatgggccagaacacgaggtttaggtcgtgccataggtagagttgtaggcagagatagagctgctgacgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggtcagatggtgatgatgctgcagagggattccctggtggtccacgtgacccgtcagtgctcacatcatttgccgagcatgttgcacatgccgtgtggagtggacaggaacgtcctgatttgaagttagtgtcacatgggaggaagctgacactgattgggaggccagtgcctgagattgaaggcctggtggctgccacaggattaagtccactgatagattgttcagttattactggcgatcctggacttatatccgcatttgtggagaggtggcacagagagctgacgatcacattggatgatgtgtcgtccatcctacatttgcccatcactggcgccttgcacaatttccacgctctttctacggaggaggccagattcttgcttacggagttgctggaagtgtctgccgaggaggccagagccgagacagcactcacacgtggagcatatgccgagaaggtcttccggaagttactcagacccattccggaagaaggtcttccggaagtgttttttggaagcacttcttccggaatgggcctcagttgtgcctaa

SEQ ID NO: 42937 - DNA, 93 bp, Glycine max
  Peptide Sequence Number=SeqID_134622
tgtcctatgagcaggttgttgcatggaaagtcctcaatggtgatgattataatcactgcctagccttcatgttcatgaatttggtgaatcctt

SEQ ID NO: 42938 - DNA, 183 bp, Glycine max
  Peptide Sequence Number=SeqID_134623
atggtttccggggcttccgtggcttccgaatgcttccgtaaaatttccgaaaaccttggcaatttgagtctaggcccttctggaacattttggaagttgggttgcttaaggaggaagcaactgggcggcaagctcctccacatttttgaaaaatggtttctggggcttccgtggcttccgtaa

SEQ ID NO: 42939 - DNA, 258 bp, Glycine max
  Peptide Sequence Number=SeqID_134624
atgacaatgatgagcaaagatgagagggtaagatcatctaattattctcatggagaagatgacaagtatgaagaggatgggggaggatggaggaatgagaggtatagggagagaagaagtcatagaagatatggaggtaggcaaagagaggaagggattgatggagtaaaggtgaagatccctacttttaaagggactcgtgatccgaaagtgtatcttgagtgggagatcaaggttgagcaagtctttgcttgctag

SEQ ID NO: 42940 - DNA, 2871 bp, Glycine max
  Peptide Sequence Number=SeqID_134625
ccgggaccgggcgttggcggccactgcattgcggtcgacccgtggtttatcgtggcgcaaaacccgcagcaggcacggctgatccgaaccgcgcgtgaggtcaacgatgccaagccgggctgggtgctggatcaggttaaacaggcgctggccgagtgcctgacggccagcggcaagcgtgccacggacgtgactatcgcctgcttcggtctggcattcaaacctaatatcgatgacctgcgtgaaagcccggcgatgtcggtggcgcagcgtattgcgggctggcacagcggccgcacctgggtggtcgagccgcatgtggcggatattccgccgcagctcgccgaacgcgctacgctggtgtcgctggctgatgccctgcaacacgccgacatcctggtgatgctggtcgatcatgcgcagttccgcgccgtcacccctgaagagtttttagtcaccggcggcgccggttttattggctccgcgctggtgcgcttcctgattgccaataccgaccaccgggtggtggtggtggataagctgagctatgccggcaatctggcgtcgctggcaccggtcgagcaggatgcacgctttgcttttgagcaggtcgatatctgcgaccgcgccgcgctggatcgcgtgctggcgcagtatcagccggactgcatcatgcatctggcggcagagagtcacgtggaccgctcgattgacgggccaatcgcctttgtcgaaaccaacattgtcggcacctaccagctgctggaggcgacgcgccattactggaacggcatgacggatgagcgcaagaagggcttcatcctgcaccatatctccactgacgaggtgtttggcgatctgcacggcacggaagatttctttaccgaaaccacgccgtacgccccgagcagcccttattcggcgaccaaagccagcagcgaccatctggtgcgtgcgtggctgcgcacctatgggctgcctgtggtggtcaccaactgttccaacaactacgggccttaccatttcccggaaaaactgattcccctcaccattatcaatgcgctggccggtaagccgctgccggtgtacggcaacggcagccagattcgtgactggctgtatgtggaagatcacgcccgcgcgctgtacaccgtggtcagcagcggcaaagtgggtgagacctacaacattggcggccacaacgagcggcgcaatattgaggtggtggagacgctgtgtgatttgctggatgagctggcaccgcaacagcgcgctgccgggctgagcagctaccgggaactgatcacctttgttcacgatcgtcccggccacgacctgcgctatgccattgatgccagtaaaatcgcccgtgaactgggctggacgccgcaggaaacattcgacagcggcatccgcaaaaccgtgcagtggaggagcaacgatgaaaggtatcatcttagccggtggctcgggcacacgcctgcacccgataacccgggcgatatccaagcagctgctgccggtgtacgacaaaccgatgatctactatccgctgtcgtgaatttggcctgcagctgcagtatgccgagcagccgagctccggatggcctggcgcaggcctttatcatcggtgaatccttcattggcgacgacagctgttgtctggtgctcggcgacaatctctacttcggccagggcttcagtccgaaactgaaaaaggtggccgcgcgcagccacggtgccacggtctttgcctatcaggtcatggatccggaacgttttggcgtggtggagtttgatgacgacttcaacgcgctgtcgattgaagagaagccgcagcagccgaaatcgcgctgggcagtcaccggcctctacttttacgataaccgcgtggtggagtttgcgaagcaggtgcagccctcggcgcgcggcgagctggaaattaccgccatcaaccagatgtatctggagcagggcgaactggcggtggagctgctggggcgcggctttgcctggctggacaccggcacccacgacagcctgattgaggccagcgtgttcgtgcaaacggtggagaaacgccagggctttaaaattgcctgcctcgaagagattgcctggcgcaacggctggctgagcgatgagcagctgctggcagcggcacaggcgttgaccaaaaccggctacggccatattgatccccttgcgtgggagagcgacttcttccgctgcgccacggcgcggctgacgctggacggcgatgtgccgctggccgaggcgctgcagcagccttacacgctgtggcaggttaaggttccagcgcaggacagcgcggcgatagatgcgctgagccagcacggttttcagctggtggaaggcgaagcggatctggcgatcaatatcaaacgcaccgaacggcagaccggcgtgcgtatcgcgcgcgaagcgcagatcccgcagctgcgcgcggcagcggcccaggcgtttagccagagccgttttcgtgctccctggtttgacgctgaagacagcggccgcttctacgctcagtggattgagaacgcggtgcgcggcacttttgatcaccagtgtctgatcgcctgcgacgagcagggcgcgctgcaggggttcgtctccatgcgcgaagtcgccggtgacgcgcgtatcggtctgctggcggtgctgccggcggcgcagggcaacggcgtcggtcagcgtttgctgctggcggcagccgactggggccgggtgcgccagctcgaacgtctgcgggtcgcaacccagctcagcaatcttacggcgatgcgcctctatttacgcagcggtgcccggctggaaagcaccgcctactggttttacaggaaagcctga

SEQ ID NO: 42941 - DNA, 802 bp, Glycine max
  Peptide Sequence Number=SeqID_134626
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttttttcaagcctctaagactggtgatgctgtgttaaatccggtctccgtactaaattttatgatgagacaggtatcaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42942 - DNA, 318 bp, Glycine max
  Peptide Sequence Number=SeqID_134627
atggccaagtttgacccagatgtagtcctagagttttatgccaatgcttggcccacggaggagggcgtgcgggacatgcggtcatgggtaaagggccagtggattccttttgatgcagacaccctcagccagtttctaggagacccactagtgttagaggagggccaggagtgcgagtatagtcagggaaggaaccaggccgatggatttgatgaggaggccattgcccaactgttatgcatatcggtaacatcttgcccagcgatcataactccgacctccctctgccgaagtgtcagctggtgtatgccatcctga

SEQ ID NO: 42943 - DNA, 420 bp, Glycine max
  Peptide Sequence Number=SeqID_134628
atggataatgaagagggcgtgcaggaacagatgaaggccgatctatcggccttaatagatcaaatggcttccatctcggaggtcatgttaaaactccagaaaactatagaggataaagccacggcaaccgcctccagtacagttagggaagcggagccggtgctgcagcccgtcttaaatccgggccgagacagaaacacagcagtgtttggtcgaaggtatagtccgcaagcttacccctatggcttgcctccggacttcactcctcgtgtcaccccggaagatttaagccaagcccctactttcgaggggcaactcccaccttatgacgactatcccaagcaagacgatgaggaaggagatacccatctcggccccctgctccacctcaaagatccgtccccccatgaactaccctaa

SEQ ID NO: 42944 - DNA, 255 bp, Glycine max
  Peptide Sequence Number=SeqID_134629
cctccctctttgaatgtgctcgcacatttggtcgccctccaatatcaggggttggcccaggaactgataaaaggaaactacgagccccttaaccggggagcgcaagtcccggcgaggatgtgcaatcctctgatggcgaggacatatagtcctctaaaggtgataggtactagtacccaagggtccacctttatgagaaagcaagagatcgactcatcgagagggccggtcatccaacaagattggaaacgagat

SEQ ID NO: 42945 - DNA, 414 bp, Glycine max
  Peptide Sequence Number=SeqID_134630
atggggacaaggggttgcatcagttacaatcccgatcttgctataaggcaacttggctgccctatgagaggggcaccactagaggaagagcttgcgcctgtcatttcacgaggtttcaataagaccaacgtggatacacttcaaaaggtctgcaaggcatgggaggtggtgcaaaagaaggacaaagaactcaggggcagtaacaatggggcccattggtggctaccaaccgctaaaagggaggaagttgaggcaccagaggaagacgaagaggtgcagaccattagggcagaactcgagcaagcccaaacagtcaaagaaaggttcaaatcagtagctctgaagatccgaaaggagaatgccgaactcaacagcgagcttaagctccgaagagaggaaagggaccaatcatga

SEQ ID NO: 42946 - DNA, 391 bp, Glycine max
  Peptide Sequence Number=SeqID_134631
atgcgtatgtcaaacagtgcgatgagcgtggttatccttgccgcaggcaaagggacccgcatgtattccgatcttcctaaggtgctgcattactctggccgggaagccaatgatttaggcgctgccgcggtacacctggtgtacggccacggcggcgatctgctgcgtcaaacgctgcatgaagataacctcaactgggtgctgcaagcagagcagctcggtaccggccatgcgatgcagcaggcggcgccgttcttcaatgatgatgaagatatcttgatgctctatggcgatgtgccgctgatttcggttgaaacgctacagcgcctgcgcgccgcaaaaccgcagggcggtatcggcctgttgacggtgaagctggatgatccaaccg

SEQ ID NO: 42947 - DNA, 429 bp, Glycine max
  Peptide Sequence Number=SeqID_134632
atgcaggaatttcaagatgtctttcccaaggagagtcgtcatggactgccaccttcaagaagcatagtacatcaagttgatctccttctagaagcttcattgcctaacgagccgacttactactggaagccccatgagactcagcataaggatgcacaggtcaaagttgagtatgtgaaaagattgtatgaccatgtgaaggtgcaaattgcaaagaagaatgaaagttatactaagcaagccgacaaacaaaggaaggaactggtacttgaccctggtgatgatcctggacattttagggcatatgttttccaagaaagagggaatgatgagaatcctgaaattggccaaatacaggctaaaggcccaagtggagaaggacgaaggctcaagtggagaaggacaaagcccccgagtggagaaggatga

SEQ ID NO: 42948 - DNA, 84 bp, Glycine max
  Peptide Sequence Number=SeqID_134633
cgattctgtggaaattcttcatcattcttcgtcgttcttcaccgttcttcatccgttcttcgttcgttcttcgttcttcaacgg

SEQ ID NO: 42949 - DNA, 546 bp, Glycine max
  Peptide Sequence Number=SeqID_134634
atggcggatagcaacttcaagcctgctcttaacagttcgcttttcttggcaggtttgcccaggccttcgaggcgttttttcaacgtggcaatctgcgcatactcttctttaggcatggtgaagctgtcacgctccattttcactttgctggttttagctttatctttttctgttgccgtagctgttttattgaccaccttgatggctggtgtaggagccactttttttgccgcgacaggtggtttcgcagctacttttgcgactggcggttttgcggctacgggcttcgctgacgctggtttttgtgccgcaggtttggctgcaacgggtttggttggcgtgcttgttttgaccgcgttagttgctggcttgttggctgttaaaggtttggctaccgaggctgtttttcatgacaaaattcaacaccttcaatcagggagtatgagatgcgcagggtattggtggcaaataccaaaggaggctgcggcaaaaccactctggccacgaatcttgctggctatctggcacaactgggtcacaaaatag

SEQ ID NO: 42950 - DNA, 356 bp, Glycine max
  Peptide Sequence Number=SeqID_134635
atggcaacgcaattaatccatgaccgagtggtgatggagtgcctagagggagtttgggagaccctcgaaggaaatgcgaggtgtcgattccgtggcatgattcgactcacggctacttcattggtacatccaggggaacccgcacgcacgcttcagcgcacattggagtggatattacctacacctactccatatcgactagtggagcccgtccaagtgatagaggtgtcatcatctgaagaagaccctgaggaggacccagaggtgttacctcctgagcctactgtggatgccattgactttccagagggtgatgaggacccacttcctgatgtggattctccagaggacgtcat

SEQ ID NO: 42951 - DNA, 363 bp, Glycine max
  Peptide Sequence Number=SeqID_134636
atggctgggttgtgtgactcgaaggtaagagaatctgaggtgactcctcagaccttgcacaaggtagtaatcagggctggaaatccaagccgtttgggccagagtggtaagatctttcctcaagagcttccacggcagaccttcggcattaagtacaaatcccctcccagggatacacagccgggctgcaagctcttgaggatcaggcctcagtctagcaaacctggagtaagagggcaagctctccccttgctccacgaccactggagtctccaaaaaggtgttgagggaatcaacatcaaattttatcaggtgccctcgaaccctaacttgctagggatacttgtccttagggacatatag

SEQ ID NO: 42952 - DNA, 129 bp, Glycine max
  Peptide Sequence Number=SeqID_134637
atgagacaaccacagagaagactcaacccggtgattcttgatgtagtgaagaagaaggtagtccccaagaaaaccggcctcaccgtcataaaaaatgagaaggaggagctaattcctactcgggtgtag

SEQ ID NO: 42953 - DNA, 438 bp, Glycine max
  Peptide Sequence Number=SeqID_134638
atgggggagacacatgaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaagttggatcatttagaggaaaggctcagggccattgaaggaggtgaagattatgcctttgctaacctaaaagagttgttcctagtacccaatatcatcacccctcccaagttcaaggtgctggactttgacaagtacaaggtgctggactttgacaagtacaaggggactacttgtcccaagaaccatctaaagatgtattgtcagaagatgggggaatacgcattaaagatgaggaactgctga

SEQ ID NO: 42954 - DNA, 511 bp, Glycine max
  Peptide Sequence Number=SeqID_134639
agggctacacgccctcgccatcagaggactgcatgtcctcaccttcagagggctacacgccctcgccattagaggactgcatgtcctcaccttcgtagggctacacaccctcacctttagaggaccacacgtcctcaccttcagagggctacacgccctcgccatcagaggactgcatgtcctcaccttcagagggctacacgccctcgccatcagaggactgcatgtcctcaccttcgtagggctacacgccctcacctttagaggactacacgtcctcgccaacagagggctgcacgccctcaccttgagaggactacacgtcctcgccaagagagggttgtacgccctcaccttgagaggactacacaccctcacctccagaggactacacatactcgccttgagaggactacatgtcctcaccatcagagggctgcacgccctcacctccagaggactacacgtccttcgccttgagagggctacccgccctcgccttgggtactag

SEQ ID NO: 42955 - DNA, 327 bp, Glycine max
  Peptide Sequence Number=SeqID_134640
atggtccatgacatctttgtcaaggtgaaactggaagtaacaaggatatcaacaatcctaaacgtgtttggcagtagacgaagcaatgatgtgaggctcacgggtgcgtcttccaaaggaggaaaatgcgcggagtcgccaccaacgtttatttgtggaaaacatcaaaaaaaccgaaggaaaccggtcatgaagaatattccagattcgggagttgtatttacgtttgaggaaggtattagcacctctcacgtcgacaaaagtggggctcttgctcctacgtaccctccatcgaagaggaaatcagacctacgtagttctttctaa

SEQ ID NO: 42956 - DNA, 416 bp, Glycine max
  Peptide Sequence Number=SeqID_134641
agggctacacgccatctagagggctacacgccttcacctttagaggaccacacatcctcgccaacagagggctacacgccctcaccttgagaggactacacgccctcgccatcagaggactgcatgtcctcaccttcgtagggctacacgccctcacctttagaggactacacgtcctcgccaacaaagggctgcacgccctcaccttgagaggactacacttcctcgccaacagagggctgcacgccctcaccttgagaggactacacgtccttgccaacagagggctgcgcccctcacttttcagaggactacacatcctcgcctacagagaatttaggctccacgccctctgccttaaatgcttacacgacctcgccaagagcttgcaccctcccttgaagggactacagtag

SEQ ID NO: 42957 - DNA, 240 bp, Glycine max
  Peptide Sequence Number=SeqID_134642
atgacggctcgtggcggtcactggtggtcagtggaggtggagaagaagcttgggggtgttgggggatggttcaggggaagagaaggaggaagaaaatggctcttttacgctgctgggcgtatttgtagcctgcaacacttgcccaagcgaaatgtggaaaatggtcttaggaacctccagacaaaattggaagacaatgcaacggttaacaaatccgggatgatgattttactaaaatag

SEQ ID NO: 42958 - DNA, 174 bp, Glycine max
  Peptide Sequence Number=SeqID_134643
atggctttcttggaatgcttgcttgagcatctagcagaggtatgttcaacttctctcttgctcgcatgcaagggagtctccagagatgactcactggaattttccattgtcttcccaagtgtagaaatcagaagcttgacaggttcagatgcaggtgcttctctggagcactaa

SEQ ID NO: 42959 - DNA, 651 bp, Glycine max
  Peptide Sequence Number=SeqID_134644
atgaccaccctgacccagatatggatgacgttgctcctcagcaacatcctgcccaccgatcataattccgaccttcccatgccaaagtgtcagctggtgtacgccatcctgacacggaagagcatccatgtggctcagttgatcgctgatgccatctatatttttgcagtccaacagggccctgggattccccgcactgatcacaggactctgccagtcgttcggggtccccgttgcacctaccaaggtgattcggctgcccaggccgcaggcgcgccccaggctcagggtaatgctccacaggccgcaggcgcgcccccaccacctcatcaggctggccaggctggggcatttggcatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggtgaggcacccccagaagctcccggcgacggagaagaggcccacgaggatgaggagatggccgatttgcttgacttcttgggagggagtggagatacgtga

SEQ ID NO: 42960 - DNA, 282 bp, Glycine max
  Peptide Sequence Number=SeqID_134645
atggttaaggaggagtgtaaggaggtaagtgtctcctccaagaggttagctaagaaggaaagtcattttgaaataaagacaaatattaaagaaacttcccctcttagacaacctccacatcttctcctttgtaaaaagacacttgttagcactgtcacacctcttgggcttgaggttattccccaagtaaaagagttgttggatgagggtttggttcataagagcttaaatccttctgctttgttggtgcccaaaataggaataatcaacacaaaaatatag

SEQ ID NO: 42961 - DNA, 633 bp, Glycine max
  Peptide Sequence Number=SeqID_134646
atggaaaaggcgcgtgcggaagagcagcgtctggcccgtctttcggaggcggaacgcgaaaagcagcgcgccgcggccgaggctggaatgcccgataaaaaccgtattgcgcccgcatatcccttcgcgagtttgaagggaaagctggagtttccggtggcgggcgaagtgctgcggcgcttcggcgatgcggatggtacgggccatttttccaagggagttgtcgtcgcgagcggcccggaggccatcgtgacggcgcctgcggacggtttcggggtatttgccggcgattttcgcagctacggtcgcatggtcatcctcaataccggcgatgggtatcacgtggtcatgacgggcatggataatgtaagaacccggcagggcatgttcgtgttctccggagagccgatcgcctccatgggggcaaaaagagtagcgagtgcagcagcattggcgctggaaaccgacaggccaacgctctacattgagttcaggaaagatggtgtaccggtttcgcttctccttatcggtgggcttatgggcgccacggcgatgagcgtgatttattcggcgagcatgccggcacaggcggccgggccttcgacctataaggagctgtgtgggatcctctag

SEQ ID NO: 42962 - DNA, 492 bp, Glycine max
  Peptide Sequence Number=SeqID_134647
atgcgggaagcatccagattagtgtaccaaatgaccgcggctccagccaagctatcttggaaaaagtgcattaacaacttttcatccctagaatgcacccccatcttgcaacaatacatcttgagatgggttcttaggacaagtcgtccctttgtacttgtcaaaaatcagggtaccttgaattttgggggggataacgatgtcccgctaccaagccaaagatcctcccatgtccacgaaccggatctgtcgcaacctacccttcggcgggagggcgacgcggtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 42963 - DNA, 96 bp, Glycine max
  Peptide Sequence Number=SeqID_134648
atggcacatcaaaaccccccatacttagtgtcataccctaatttcgtccggggacctttgcttgatgacatgcgacctttctttggtccttgtaag

SEQ ID NO: 42964 - DNA, 252 bp, Glycine max
  Peptide Sequence Number=SeqID_134649
ggattgctttgtgcaattctccattctcaatcatttttcggagccccgggaattgcgttttcgttcatgcgtcctccacctgagttaggagtcatgagtagtgattgcttagtgcaattctccattctcactcattttcggagccccatgaattgcgttttcgttcaggtgtcctccacccacgagtttggagccatgcgtagtgattgcttagtgcaattctccattctcaatcttttcggagccccatga

SEQ ID NO: 42965 - DNA, 437 bp, Glycine max
  Peptide Sequence Number=SeqID_134650
atgtcgcgggggtcaggagaccttggggacgtcaggtggggtgctattgcccaaaaccaagcttggctaatcccgacccaacccgggcatagtcagtcaatcatgatgacagtgcagttgatccatgatcgcgttgtgatggagtgcctagagggtgtttgggagaccctcgaaggcaatgagaggtgccgatttcgtggcacaattcgactcactgctacttcgctagtacatctggagcagcccacgtgcacacttcagcagcctgtggagtggatactacctacacccactccatatcgactagttgagccggttcaagtgatagaggtgtcatcctctgaagaggatcttgaagacgacccagagagttacctcctgaacctgctatggacgcccctgatctaccagaggatgatgaggacccactccctgat

SEQ ID NO: 42966 - DNA, 1139 bp, Glycine max
  Peptide Sequence Number=SeqID_134651
atgggacctctccaaaggcaagccttccgcaaagtgtacaggaagattctagatttggccgcaacggaagtatttacggaagctatcgtatccctcgcccaatactatgaccagccattgaggtgtttcacgtttgcggacttccaaatggtaccaactattgaagagtttgagaaaatattaggatgccctcttgggaggagaaaaccgtatcttttctccggctttcttccttccttgagcaagattgcagctgtggttggtgattcagcaaaagagttggatcgcacgaagcaaactcagaacggcgtagtgggcctgcctcggaaatacttggaaggtaaggcaagggatatggcgagccaagagaagtggggcccgtttgcagatattttagctttgctgatttttggggttgtccttttcccgaacgtcgacggtttggtagacttagccgccaatgatgctttcctcgcatatcaccatagcaaggaaagtccagtggtggctatcttggcagattttgtgcggattgtctgttgtttacccgctctctgtgtgtggttgatttcacacctattccaacaagacacgagacacccgtgttcgcttcaaagctatcgctcatgcgccgaaaaaggaagagtcgattgggaccaacatttggctgggatagggggcagcgcgatcaattggtttcctcgttggaaggaaggcaaggaaggagttcttttctcgtgtggggactaccctaatgttccactgatagggactaggggttgtattaattataaccccgcactcgccataagacaactagggtatcccatgaggggaacgccaactgaagaaagtctctcgcctttccttgtgagggatctaggcgcgcaaggtctcaaggttatacaaagaatccacaaggcgtggaggagtccgttgaggaaagacaaggagcttagaggcatccgaaatggcgtcatcggaggttatcatggatggctaagaattcatatgcgagggttagattggctctccaaattgaaagttatcgatgaggagaacttcgaagctccggaggaagatgaagaagtccgagctctaaaattagagctagggaaggcgagactcgccaaggagaa

SEQ ID NO: 42967 - DNA, 696 bp, Glycine max
  Peptide Sequence Number=SeqID_134652
atggagagaagtatgatagatgctgccagtggtggagcccttggagacatgactcctgctgaagccagaaatttaattgagaagatggcctccaactcccagcagtttagcgccagaaatgatgccatagtcattagaggagtgcatgaggtagctacaaacccatctgcatcatctgaaactaagaagcttgaaggcaaattggatgcattggttaacttgcaacctggagcaattgagcagcctgaagcttatgctgcaaatatttacaatagacctcctcaacctcagcagcaaaatcaaccacagcaaaacaattatgacctctccagcaacagatacaaccctggatggaggaatcaccctaacctcagatggtccagccctcagcaacaacaacagcagcctgctccttccttccaaaatgctgctggcccaagcagaccatacattcctccaccaatccaacaacaacaacaaccccagaaacagccaacagttgaggcccctccacaaccttccctcgaagaacttgtgaggcaaatgactatgcagaacatgcagtttcagcaagagaccagagcctccattcagagcttaaccaatcagatgggacaattggctacccaattgaatcaacaacagtcccagaattctgacaagttgccttctcaagctgtccaaaatcccaaaaat

SEQ ID NO: 42968 - DNA, 321 bp, Glycine max
  Peptide Sequence Number=SeqID_134653
atgttcatattagaggactacacgtcctcaccttcagagggctacacgccctcgccttgggtactagttaccctcaccgtcagaggactacacgtcctcgcctttagaggactacacgtcctcgccaacggagggctgcacaccctcaccttgaaaggactacacgtcctcgccaacagagggctgcacgccctcacctttagaggactacacgtcctcgccaacagagggctgcacgccctcaccttgagaggactacacgtcctcgccatcagagggctgcacgccctcacctacagaggactacacatcctcgcctga

SEQ ID NO: 42969 - DNA, 204 bp, Glycine max
  Peptide Sequence Number=SeqID_134654
atgacttccaaggttattttgatgatgccaaagaatcaacagttaagcaaattccaaagattaaagaatctagtttcaagaatcaagattcaagaatcaagaatcaagaataatcaagatcaagattcaagattcaagattcaagaatcaagagaagactcaatcaagataagtactaaaaaagttttccaaaacattgagtag

SEQ ID NO: 42970 - DNA, 210 bp, Glycine max
  Peptide Sequence Number=SeqID_134655
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgccggacctgaaaagaaattcccgtggtaa

SEQ ID NO: 42971 - DNA, 459 bp, Glycine max
  Peptide Sequence Number=SeqID_134656
atggcacgcaggagacaaattatggtcattctgcgcccttttcgtcaatccagaggcggcgggcccgatgacatgcagagacaaattatgcatcttccgcacccttttgccattcagacacaattgtgtcatactgatagcacgcaaagacaaattagtggtcattctgcgcaaccttttgtcatcgcagaggcggcgggcccgatgacatgcagagacaaattatggtcttccgcacacccttttgcttcagacacagttgtgccgatggcacccgatctcgcaaagacgaaattatgtcttatctttactttccttttcatctccagaggcggcgggcccgataacaagacaagtaaagagggacaactgtcataccctaatttcgtccggggacctttgcttgatgacatgcaacttttgtttggtccttgtgaggtgcttggcacccatcattag

SEQ ID NO: 42972 - DNA, 138 bp, Glycine max
  Peptide Sequence Number=SeqID_134657
atgggtgccaagtacctcgaagtggtcaaaggagggtcgcatcccaacaacggatggtccccagacgaaattaggctagagtgtcttaactaccacatgtatgataaggagctttatgccgtagttagagccctctaa

SEQ ID NO: 42973 - DNA, 282 bp, Glycine max
  Peptide Sequence Number=SeqID_134658
atggtgaaagttggaacctcttacgtgccgatcaacgtctcattttcgccaaaagttggcccagggcttcccgctgtttccgccggacatcagcgctggcaagttagtccgctcgaccaattccacacccgagccggaagcataaagtgtaaagccgctacgggcgtcccttcgccattcagagctgagctaactgttgggaatgggcgatcggtgcgggcctcacttgcgctattacgccagctggcgaaagggggatgtgctgcaaggcgattaagttga

SEQ ID NO: 42974 - DNA, 419 bp, Glycine max
  Peptide Sequence Number=SeqID_134659
tgcgtcgggtgatgctgccaaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatattcacctccactccttatgctcccatgaacccgg

SEQ ID NO: 42975 - DNA, 354 bp, Glycine max
  Peptide Sequence Number=SeqID_134660
atgagggaaagggaaatgataacaacgatagacacattgcctgtgttctactatgagaagatggtgggatacatgccttcgagttttgtagatctagtatttgcaggcgagaggattgaggtacgcctaagaaggggcaaatttgattatgttgcttcaatgatttctggcaataggaggcctagggctggtggagaacagaaaaaggagggagacgcccatgccaagattgtagtacccacatggccaagctccccgcagacccctcacaaccccatgggagttccacaatgtagaaacatgcctagtatccgagaagctgttgcagggattgatggagaggtgttcatgtag

SEQ ID NO: 42976 - DNA, 824 bp, Glycine max
  Peptide Sequence Number=SeqID_134661
atggtgaaagttggaacctcttacgtgccgatcaacgtctcattttcgccaaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccactggtggaaaagccccccgtaagcaacttgctaccaaggctgcccgtaaatctgcacccgctactggtggtgtcaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 42977 - DNA, 348 bp, Glycine max
  Peptide Sequence Number=SeqID_134662
atggcttccagcacgtccagcggcgtgaccagcccctgcaccaccccaaactcgttggtgacgataacaaagctgccacgcgcgcggcgaagcaccccgagcaggttgatcgggtcaagcgtttccggtacgacaatcgccggcgatgccgctgcaacggcttcgacattgacgccctcttccagggccaccagcatctctttcgcccgcacgacgccgatgatctcatccagctcaccacgacacaccgggaacaggctgtgcgggggaagagagcagctgctggcgaatttcatccacactcaggttagcatcgacccagctgatctctccgcgcgggagtcatga

SEQ ID NO: 42978 - DNA, 570 bp, Glycine max
  Peptide Sequence Number=SeqID_134663
tttgtctgggggccatacacagcaactgtgatggcagcgttgcctccaatttgtgtgattggaagtgtagcctggcgtaaaacaaagatgtttgtcgacccaaacaatacaaacgcagctacattgggtgaagttgtggagactttacactatatggtgtcaccacaagggaggaacacatggacagttgatgatctcgtgccttacgtggaaaagttagcgattatatccgaagagcaagagagaatcactgagccagtgtcacatggtccagcatcagatcgtgaattcccagcacaagagtttcacattcttcggtcaagtgttgaaactcagagcataggcagacgaagggagcctgttgaagcggaagaatattcccaacaaatgatggagcgtggtcatggaatgtattacacgccagcaacattttcccaatatccttcacagatgtatcagtatccttttgaaggtcatcacactgatacttctgcgagcgaacattcttttggtggtgttgcggaaacacaacctcatttttcatggcccactatcactccttcgcagtaa

SEQ ID NO: 42979 - DNA, 444 bp, Glycine max
  Peptide Sequence Number=SeqID_134664
atggcatccttcagccagcttcagtcagagatgcaatctcaggcacctcctgagcctctggttggtcctggtccctccggtcctcgggtgagtgtggacgaggttaaagatgcagatgctccagttcctgtacccactgctgaggtttccttagtggggccggcacttcacaccttccttgcttggctgacacatctgatcaagtctttatcacaccaggtagctgtgtctccaccaaaaccacctccgaagcccgatccagaggttgatgatccgctttatctgatgacattgaccatcccagagcttttcttgaggccttataagcttttcttgaccagatttccccctgtacataaagcacgaagacctctccgaaattgcacacggtggtcaatgtctcaacatatcagtgttacagttgtggattctgcatctcactga

SEQ ID NO: 42980 - DNA, 300 bp, Glycine max
  Peptide Sequence Number=SeqID_134665
atgtcagtcttcgctgctatcaggctttttgtcttacagacagcaaaaaagaatgtttatacggataaccactcgggtatctcccgtcagcgtgactcaaatggtgcagaagacgacgttagtctctgcgtgctatcaggcttttcgtcttacagacagcaaaaaagaatgtttatacggataaccactagggtattttccccccgtcagcgtgactcaaatgtcagtatgacagatcttgtgagcgcggaagatgacttaaatctccgcgtgtcaacgggcttgtcgggccgcgattga

SEQ ID NO: 42981 - DNA, 162 bp, Glycine max
  Peptide Sequence Number=SeqID_134666
atgcctgcagggtcgactctagaggatcccacgtgtgatgcaatcctccctaggaagggaccagtcactagagccatgagcaagaggctccaagaggattgggctagagctgctaaagaaggccctagggttctcatgaacctcaggggctccatattgtag

SEQ ID NO: 42982 - DNA, 406 bp, Glycine max
  Peptide Sequence Number=SeqID_134667
atgttggtgcgcatgatctgcactcgtctctttgcagcggcacaggtgaaatcttgccccggtatgcatagtagctgtgtgatagcctccctctctggttgtgctcgcacagttggtcctcctccaatatcagggggtggcccaagaaccgtgtggatatggagcccactgaaagtgaggacgcgtagtcctctcaaggcgaggacgtgtagtcctctcaacggtgagggtaactattacccaaggcaagggcgagtagccctctcaaggcgaggacgtgtagttctctcaagtcctctgatggcgagggcgtgtaaccctctgaaggtgaggacatgcagtcctctgaaagtgaggatgtgtagccctctgatggtgaggacgtgtagtcctctcaagggtgagg

SEQ ID NO: 42983 - DNA, 585 bp, Glycine max
  Peptide Sequence Number=SeqID_134668
tcgtgtccgatggcacgcagagacaaattatggtcattccgcacccttttgtcatccagagtcgccaggtcccgatgacatccagagcaaaattatggtcattccgcacccctttgccattcagacacagtcgtgtccgatggcacgcagagacaaattatggtcattctgcacccttttgtcatccagaggcggcgggcccgatgacatgcggagacaaaatttggcggcggacccgatgacatgcggagacaaaattatggtcattccgcacccctttgccattcagacacagtcgtgtccgatggcacgcagagacaaattatggtcattctgcaccattttgtcatctagaggcggcgggcccgatgacatgcggagacaaaatttggtcattccgcacccctttgccattcagacacagtcgtgtccgatggcacgcagagacaaattatggtcattctgcacccttttgtcatccagaggcggcgggcccgatgacatgcggagacaaaatttggtcattccgcacccctttgccattcagacacagtcgtgtccgatggaacgcagagacaaattatg

SEQ ID NO: 42984 - DNA, 594 bp, Glycine max
  Peptide Sequence Number=SeqID_134669
gaactggacgaggcccgcatcgccgaggtcatcgccgccttcgccgccagtgcggtgcgcgccgagcgcctgggcttcgagctgatcgagctgcatgccgcgcacggctatctgctgcacccagttcctgtcgccgctgagcaaccgccgcaccgatggctatggtggctcgctgccgaacccgcctgcgccctgctggtggaagtgttcgacgcggtcgctgtgggtgtacgcatttgcgccagcgactgggtcgactggcggctgggacctggtgcagagcgaagcgctggcccaggtgctggacgcgcgcggctgcaatttcctgcatgtctccagcggcggcctggacgagcgccagaagatcaccgtcggtcccggctaccaggtgccgtttgcggcgcagcgatcaaggccaaggtgacgcatgccggtcatcgcggtgggcatgatcaccgagcccgagcaggccgaatcgatcctgcgccatcgccacgccgatgccgtggccctggcgcgcggcatcctctacgacccgcgctggccgtggcacgccaccgccgcactgcgcgacagcgtggaaccggcgccgca

SEQ ID NO: 42985 - DNA, 451 bp, Glycine max
  Peptide Sequence Number=SeqID_134670
aggatccccggtgatgttggggaatggttacgagcccggaatgggtttaggcaagaacaacggcggtagaaccagaggaaaccgtgggaagtttgggaactttataagcgcgggtctaggacacgaaggtcaagtcgttgcgatatgcgaggatgactctccgagtgggtcggatttggtacgatcatgccctcctggtttccgattaggaaattggcgagtggaggagcgcccagacatttacgcgacaagcataatagacgaggatgtgggacttcccccggagttggagaagatagtcgcccatgaggaccaagagatggggcctcatcaagaagagacaaaactagtgaacttaggaactagcagtgggaaaaaggaagtaaagataggcacgggcatgaccacacccatctgtgaagaattaacagccctgctgaaagactactaa

SEQ ID NO: 42986 - DNA, 486 bp, Glycine max
  Peptide Sequence Number=SeqID_134671
atggtgaaagttggaacctcttacgtgccgatcaacgtctcattttcgccaaaagttgggcccagggctttcccggtattttattcggcgcaaagtgcgtcgggtgatgctgccaaacttactgatttagtgtatgatggtgtttttgaggtgctccagtggcttctgtttctatcagctgtccctcctgttcagctactgacgggggtggtgcgtaacggcaaaagcaccgccgggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 42987 - DNA, 210 bp, Glycine max
  Peptide Sequence Number=SeqID_134672
atggggattcatagaaccaccaagcaatccccttttgaggaggaaccaacagatttgaggtcaaatccccttcaagggggaggggatgatacaatcctccctaggaagggatcagtcaccagagccatgagcaaaagactccaagaggattgggctagagctgctaaagaaggtcctagggttctcatgaaccttaggatagatttctga

SEQ ID NO: 42988 - DNA, 729 bp, Glycine max
  Peptide Sequence Number=SeqID_134673
atgattatgaggcgccaagacatttatagtagccaagaagaggctactacttcaccttcctctagtgaaagtgaagaagcagaaggggaaaaatctagtgaagaaatctacccccaagaagaaggacaaccatcagtggttaaagagaagtgtaaggaggtaagtgtctcctccaagagtttagctaagaaggaaactcattttacaataaagacaaacattaaagaaactttccctcttagacaacctccacattttctcttttgtaaaaagacacttgctagcattgcaacacctcttgggcttgagtttattcctcaagtaaagaagttgttggatgagggtttggttcgcaagagcttaaatctttgtgcttttttggtgcccaaaataggtattattaggcaccaagtccctaaaataggtggtatgatgaatgttttgagtggtgcaaccctcttttgtaaaatcactcgtacacctaacatcttcatggtgtgtgtacatagggacccattaggtagtgatcaacgggttcccatgaaccctaagagaataaaggtcattcctgagtggctcactccaccaagtataagaaaaatttggggcttccatgacttaacaaacttttacaaaaggtttgttccatatttttctatacttgtagcaccactcattgagttggtgttgagggaaggagcccagagtatgaagaacctcgagatttga

SEQ ID NO: 42989 - DNA, 162 bp, Glycine max
  Peptide Sequence Number=SeqID_134674
atgggatcatcattcactgttttgatcaaggatgcaaaaatacccaaaggggagggcaaaatcaatggagtcctttgcttcttgaagatcaatggcagtggaatggagaagaagaaagatgattggagactccacttcaaggagaggatgagtcaagaataa

SEQ ID NO: 42990 - DNA, 267 bp, Glycine max
  Peptide Sequence Number=SeqID_134675
atggcttacactcacattccggattcaacaagcgattctcctcaaatttcagccagcccgtatcaattagaccttgcgccttacgcttcagagccctacaatgctcaatggaacgccccggggcttctccgtgacaagcacacgttgcgttcgagtcgtattctcagagaaatggaggttgatgaaccttggatagggttatggctaccattgaattatcaagtagatatgggagcaagtcagcataggacactggaattagggtga

SEQ ID NO: 42991 - DNA, 417 bp, Glycine max
  Peptide Sequence Number=SeqID_134676
atgttgagtcagcatcccaatatgttaaactacactgactctgtgataaagagagaatctcctctatccctgcattacaaattgtttgagggaacacatgtcccagacattgtctcgacatcagggaaagctgcttcaggtgctgtgtccaaggatgccttgattgctgaactcaaggacacatgcaaggtgctggaagcaaccatcaaagccaccacagaaaagaagatggagctagaacggctgatcacaaggctctcagaaagtggcattgatgatgaagaagcagctgaggaagaggaagaggcagctgaggaagacaaagcagcagctgaagaagaagaagaagctgctgaggaagaggaagatgcagcagaagagacagaatcagatgatgattctgaagccaccccatga

SEQ ID NO: 42992 - DNA, 474 bp, Glycine max
  Peptide Sequence Number=SeqID_134677
atgaccatgattacgccaagctcgaaattaaccctcactaaagggaacaaaagctggtaccgggccccccctcgaggtcgacgaaaacaaatacaatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 42993 - DNA, 1116 bp, Glycine max
  Peptide Sequence Number=SeqID_134678
atggcttcgagaaagctttccgcaaagaggtctaggagggacgccacggctgaagggaccagtgccactcccgagtttgacagccatcgtttcaggagcgctgagcaccagcagcgtttcgaggccatcaaaggatggtcgttccacagagagagacgcgtccagctcagggacgatgagtacacagattttcaggaagagatagctcgccggcgttggacgtcgcaggtcactcccatggctaagtttgacccagatatagtcctagagttttacgctaatgcttggcccacggaggagggcgtacgggacatgcgacaccctcagccagttcctgggagacccgctagtgttagaggagggccaggagactttgcccggactgctgccgggaggcgggtgcggatcatgcgcaccagcatgaccaccttgacccagatgttgatgatgttgctgctcagcaatgtcctgcccagcgatcataactccgacctccctctgccaaagtgtcagctggtgtatgccatcctgacacggatgagcgtccatgtggctcagttgatcactgacgccatttatttgtttacaggtatgccacctaccaggcaccctctagacccagataagtttaacagggccctggggtttccggcgttgatcacaggtctctgccagtcattcggggttcccatcacacctagtaaggtgattcgaccgccaatcacacgggccttcatcgagaagtattgcacgcctagacaggcgcagagtgatgcacttcaggctgcagacgcaccgccaccacctcatcaggctgatccagctgggtcatttggcacggagcggtatttacagcacttggttcgccagcaggcggctaaccatagggggcaggtgcagatacatgagtgtctctaccagctcagtctcagtcagcagagccagggttttgctccttttgcatgccctactctagaccagttcagggctgaggttgcatggcccagagattggcctgaggcgcctgcagaggctcccggcgatgcagaggaggcccgcatggatgaggagatgacaaatttacttggtttcttgggagggagcggagccacatga

SEQ ID NO: 42994 - DNA, 372 bp, Glycine max
  Peptide Sequence Number=SeqID_134679
atgtcttttgtcaagactatcacagtcttctttacattttcaagactatcaaagtctgttgtcatgcaaagacaatcatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagc

SEQ ID NO: 42995 - DNA, 246 bp, Glycine max
  Peptide Sequence Number=SeqID_134680
atggggggcatgaaaggaataaatccacttgtcaatgaattttggatcaaacctctcaatggaatgagaaggaaaagatttgtgtactgtatcaaacgctgttcaaattcttttgagaaaattgaggaagaggaaatggaggaaggaatctgtgttctcccagtctggaatgtcctgtggcttcaccaaacatttcgacctttctttgagcccattagagcaggggtcatgtccttgaaatattaa

SEQ ID NO: 42996 - DNA, 444 bp, Glycine max
  Peptide Sequence Number=SeqID_134681
atgatgcccgaatgtttgaatagggtggtcggaataccgaggaagcacttggaggagaaagcgaaggctttggcggatcaaggtgaatgggctttgttcattgatgtcttggcgctattggtatttggagccgtcgtctttccaactgtggatgggctagtggatctagcgacgattgacaccttccatacttatcaccatagcaaggaaagtttggtcatggctgttttggccaatgcctacgacacatttaaccggagatgcgagaagagcggcgcaaggattgtctgttgcacacccactctttatgtatggatggtctctcacctctttcatcatgaaagtagacctgtctatcccctacaaggtcaccacatttgccccgagaaagggaagccgcccttgggagcacctcttggccaatatggtagaggcatccgttaa

SEQ ID NO: 42997 - DNA, 462 bp, Glycine max
  Peptide Sequence Number=SeqID_134682
atgcatagatctcccacaggcaagctagttcctctggacttggagattgaagccaccttaagaaggaacagagccgggaggagaaggaagttgttgcaagataggacagtagcttctattctagaagaagaagctcaatcttttgactctacatcatctgattcactatcatcaagggaatcagctatatacttactagaagcctctgtcatggctgatgaacaccagcaaaagggagaagccaagaagtggctccattcattcaaaggtaacagtctggagacgtgggagcaagttgttgagaaagaaagagaaaagaggaaagaaaaagcttcagataagggtatggaagtgccatatcctgtggtacagtccaagaaagataaggaccgccatctggcgagattcctagacattttcaggaaactggaaataactatgccctttggagaagctttgtag

SEQ ID NO: 42998 - DNA, 315 bp, Glycine max
  Peptide Sequence Number=SeqID_134683
atgaagtcaggtgacatgcgaggttaccttatggttactcgcatcatccgtcaaccaggggcaaacgagcccgttgatgcgcggagactaacattgtcttctacaccttttgttgtcctgacccgtgaaggacagcgagtcaggtggcaagcggagataccttatggtcatctgcacctttcgtcaaccgaggggaacgaattcgacggtgtcaagatgatgttggttttactctcatcgtccggaaacattcaagcccaacgacgcgcgagattcttctctgttgggcagggacgatcgagtgcaatggcgtag

SEQ ID NO: 42999 - DNA, 637 bp, Glycine max
  Peptide Sequence Number=SeqID_134684
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccgggccgcggcaaagccgtttttccataggctccgcccccctgacagcatcacgaaatctgacgctcaatcagtggtggcgaaacccgacaggactatcaagataccaggc

SEQ ID NO: 43000 - DNA, 851 bp, Glycine max
  Peptide Sequence Number=SeqID_134685
ggcctcgtagataaaccttctgggggtcgtcacgtctttcaaaggcttggacctgcgtggcctacccgactcgacggcattaaccgttccccctccatgattggcaagcgggccaggcactgttcggttgagtggcccaggattttcccatggtatgcgcaggttgcgtcagggttatatcactttgggaaaggaggctgggatggcaagaggtcttcgtacgtcattgggatcggggtgaattttggcctcgggggaaagttccttatcgcgttggaaccggggccaaagtgggcattgccagccgggcgagtcggggttggagccgtagcttggggggtctccctctggataggcgtaggcgccctagcttgtacgggtgctaagttggaagagtccccggcgcgagctgagaagctaggttgctccgatccttctagcgttggtacttgtggaggagaggtaatcgaacttccctctcttcaagcccactttgattctttccccgacgaataccgagtctgcgaagctggagggcatgtccctccaacgctgagtgtactctttaaaggactcgttttcctttttaaccatattctgcagctgagtccgatcgggagccatatcggagttgtactgatattgcctaaggaaggaaataatcagatccttccaagtgcggatgtgggaagcttccagattagtgtaccagacgaccgcggctcccgccaagctatcttggaagaagtgcatcaacaactttccatccctagaatgcgcccccatcttgcgacaatacattttgagatggttcttaggacaagtcgtccctttgttcctgtcaaaatcag

SEQ ID NO: 43001 - DNA, 294 bp, Glycine max
  Peptide Sequence Number=SeqID_134686
atggggtggatccaagtgctccgatcatccatttgcatactcatgaatttcatcataactaagaaaacaccaaggcacccctataacactcgatccagaaaaaaggataatgaagagggcgtgcaggaacagatgaaggccgatctatcagccttaaaagatcaaatggcttccatctcggaggtcatgttaaaactccagaaaaccatagaggacaaagccacgacaaccgcctccagtacgattagggaagcagagccggttgatgtgccatcattttcttctattttctaa

SEQ ID NO: 43002 - DNA, 222 bp, Glycine max
  Peptide Sequence Number=SeqID_134687
atgggctcgaaatctaccctaaggctcatgagaaccctagggccttcccttggatctctagcccaatctacttggagtcttctacccaatgcccttgcggggagggttggttccatgctagaactctacctcactaaagcaacccaggggtctcgcctagtgagctatcttcccaagtatcacccctatgttttgacttcgaatgacatgtcggagtggtga

SEQ ID NO: 43003 - DNA, 760 bp, Glycine max
  Peptide Sequence Number=SeqID_134688
atgggaataaatcaaactggaaaaaggttttatcaagtcaagattaagggcctagatatcaccagcattaaggggctggggtggttgatgggacctctccaaatgcaagccttccgcaaggcatacggaaagattttagatttgaccatagtagagatatccatggaagccattgtatcactcacccaatactatgacccgcctttgagatgcttcacgtttggagacttccaattagtaccgattgttgaagaatttgaggagattctaggatgtcctcttgggggaaggaaaccgtatcttttctccgggtttcttccctccttgagcaagattgtagttgtggagtgggtcccgtttatggacgtattagcattgctaatctttgaggttgttctctttccaaacatggatggtttggtggacctagccgcaattgatgctttccttgcatatcaccatagcaaagagagcccggtggtagctatcttggcggacttatttgacacatttgaccaaagagtagattgggaccaacacttggctgggataggaggcagaacaatcaactggtttcctcgatggaaggaaggaaaggagggagttctcttctcatgtggggactacccaaacaccccattgataggaatgaggggttgcattaactataatcccgcacttgatataagacagttagggtacctcatgaggggagcaccgacggaagaaagcctctctcctttccttgtgagagatttcg

SEQ ID NO: 43004 - DNA, 243 bp, Glycine max
  Peptide Sequence Number=SeqID_134689
atgtcagtgaaaaaccttgtcgggtgcctaggagtacatgacaagacaaaccacacaataggagaccagtcagggtcacagtgttttgcgagaatgctccaaccatatgggattcaacataggcttaaaggagcactcaaaccgtgtgacccccataggcatacacttgaagatcacatacactcgatcctcaatcacaatggtatccaaacccaaaaacatgttatcacgcatcagtcataa

SEQ ID NO: 43005 - DNA, 315 bp, Glycine max
  Peptide Sequence Number=SeqID_134690
atgtttatacggataaccacttgggtatttccgcccgtcaacgtgactcaaatgcttttcgtcttaaagacagcaaaaaagaatgtttatacggataaccactcgggtatttccgcccgtcagcgtgactcaaatttgagtatgacagatcttgtgagcgcggaagatgatacagcaaaaaagaatgtttatacggataaccactcgggtatttccgcccgtcaacgtgactcaaatgtgagtatgacagatcttgtgagcgcggaagatgacgtaaatctcccgcgtgtcaactggcttgtcggccgcgattga

SEQ ID NO: 43006 - DNA, 375 bp, Glycine max
  Peptide Sequence Number=SeqID_134691
agatcgcacccacaagaccacccagtggacccgaaaaagtccaacaggaccctggggtttccagctctagttacgggcctctatcagtcctacaggggatcgcgcctcacagtaccacctcagaggactacactcctcccaaataagtccaacagggtccctcccttggaagtgtcaagctctattacaagggtctctgtcagttctaccggagtacctgtcacctccagtcaagggcatcaggccctcctactaaccctcgacctttcatcaagaagtactgcacgccctcccaggcaggctcgtcagggcaaactccacatcagcatcttagaggatggctctgccaatagacacaccgcttgcaccccttag

SEQ ID NO: 43007 - DNA, 138 bp, Glycine max
  Peptide Sequence Number=SeqID_134692
atggctgcccgcaaggttaaactttctggaaagcctggaccattatgtccaatgaagtataaaagactagaaaaagaaattcattttgatcaatggactcccatttggtgtggtgataacataggtctgagatatgag

SEQ ID NO: 43008 - DNA, 216 bp, Glycine max
  Peptide Sequence Number=SeqID_134693
atggggctccgaaaaaggggtagagattggagaattgcactaagcaatcactacgcatggctccaaactcgtgggtggagcatgaacgaaaatgtaattcatggggctccgaaacagggtagaaaatggagaattgcactaagcaatcactacgcaaggctccaaaagatgggtggaggatggatgaacgaaaacgcaattgatggggctccataa

SEQ ID NO: 43009 - DNA, 162 bp, Glycine max
  Peptide Sequence Number=SeqID_134694
atgtatgttgttgtggtacttaaggatgaacgcaagcggggatggggtcacgaccgaccgatcgttgcccttctctgtgcgaaacaagcagggaatgtcgctgcaaggcagccccgtatcctttgtattttgcagctttcttttactatttgtttgttttaa

SEQ ID NO: 43010 - DNA, 339 bp, Glycine max
  Peptide Sequence Number=SeqID_134695
acacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaataggtggtatgatgaatgttttgagtggtgcaaccctcttttgtaaaatcactcgtgcacctaacatcttcatggtactcaaatgggacaccttaggtttgtcatactttttggtaggaataatcaacatgaaaatacagaaaaaggtgttaaggaaaaaagcccagagtttcaagaaccccgggatttga

SEQ ID NO: 43011 - DNA, 398 bp, Glycine max
  Peptide Sequence Number=SeqID_134696
atgttggtgcagctcggtgaggagttgggactactcacttcgctcaatgaagccatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 43012 - DNA, 1230 bp, Glycine max
  Peptide Sequence Number=SeqID_134697
atgggcggtcaggctgctgcgacgcagcgtcgtgggatcgacgtattcggcggcgaaaccgctgcgataggcgttgatcttgttgtaattggtgaaggcatcgtattccggcgcgatcggcgtgcggtgttgcaacagaaaatcagccagcagacggcagtaaccgaccagcagcacggcatgcgcgaggcgcagcggcgtatcgcagatgcggatttccaccgtgcccagctccggtttgggccgcgcatcccagtaaatatccttgatgctttcaatcacgccggcggcgttcagccgttcgtagtaggcgttgaattcgcgccagctgtagatgtgttccaggcatccgtagttggggaaggaattctgcgcgctgaaacgggagctggcaaagcgcgtatcgacgccctgcgcatggcacaggtacatcgcttcgtccccgtcgttgacgccgaggtggatgtgttggccgaacacgcaggccagcttggaaagatagccaaagcggctggccagctgcctgtagcgcgcgttgtcgctgatgacctgcttgcgccagtcgttgctcagatggcggccgccgccgcagacgtcacagcccaggcgctgcgcgctgcgccggacggtatgggtcagggcgcgcagctcggcgtgcagctcatcgagatcgcggtgcaccgagctgttcagctccaccatcgatttggtgagctcatgtttgacgcgccggcggtcgccgaccgcgctgaccacccggtcggcccgatccgtaagatcgtagtgcttgtcatcgaccagctgcagctctatttcggtgccgatggagagcctttccgaacgtttgaatgtgagcggcatggtgcctccttcctgcaagaacagcataaagataagttaacgggagtgcgacatgacgtcattgacgccgctgaagctttgtcgggcgcattggcgctgccgcaacccaaaatctcaaggcatttggcgatgctgcgtgaaagcgggctgttgctcgatcggcgcgatggcaagtggatatattatcgcctgtcgccgcatatgccggcttgggcggcggggattattgagcaggcttatcagtgtcgggcagaacagatgatggagttggggcaacgcgcagcgaaaggctgcccgagcgatctttattctgacgttggccttggttatctggcaaccgagagggctgggcattggctggagcgcggc

SEQ ID NO: 43013 - DNA, 479 bp, Glycine max
  Peptide Sequence Number=SeqID_134698
atggcgcctaccaggcatcctttggatccagataagtccaacagggccctgggatttccctcgctgatcacaggactctgccagtcattcagagtccccgttgcacctaccaaggctcagggtgatgctccacaggccgcaggcgcgccaccaccacctcatcaggctggccaggctggggcatttgacatggagcagtatttatggcatttggttcgccagcaggcggccaaccaccgagcacatgtacagacccatgattgtctgtaccagatgagcctcagcatgcagagccagggcttcgcttctttttcatgccccactccagaccagttcagggcagaggtcgcatggcccggagattggcccgaggcccaagcaggagaggcacccccagaagctcccggcggtggagaagaggcccacgaggacgaggagatggtcgatttgcttgacttcttgggaaggagtggagatac

SEQ ID NO: 43014 - DNA, 150 bp, Glycine max
  Peptide Sequence Number=SeqID_134699
atgttctgtttgttccagcatatcacaagatgtttctaccctacagcagttggaggattgagatgctatgagaatccaaagaataagattactgcagtacctgctgaggaagaggaaatctggggtgcattcttcaaggaaacgagatga

SEQ ID NO: 43015 - DNA, 774 bp, Glycine max
  Peptide Sequence Number=SeqID_134700
atgcgggtgattgaggcgctggcgcatttggatagcgcacagcagcagatcgttgccgaggggttgacggcctattcgtgggcgcttgagcgctgtcgtcagcagccggtcacgagcagaccaaacgacatcacgatagtaaccggctatcagccgggaatgattggccgcattgcgcaaatgcacggtgagtattacgcccgtcattacggcttcgggcatttttttgaaggtaaagtcgccagcggtctggctgaattttctggcaggctgaacaatcaacgtaaccagatttggctggcggtcaaaaatggcgtcatcgtcggctctgtcgccattgatggcgaagacctcgggaataatgaagcgcatctacgttggtttattctcggcgatggctgtcggggcaacggcgtggggcgccgcttgctgactgaagctatcaacttttgtgataatcagcgcttcgatgcggcatttaactcagatgggtatttatctcctcaatctcctgacgccacagcgcctgtagctgcggcttctgatgcttcggcttacgctgcagatcgtccgccaatagctgttccagcatcaccagacgttccagcaaatcctcttgcaggtcgtcgacgggcggcgcctgcggcggcgtttgcgtcgccgggctttgaaggcgctcgttgccgcgcagacgggcgtacacctcgtcgacgtcgtgccactcgcttaacccgttttcatcaattaaccagaagcggttacagctctggctga

SEQ ID NO: 43016 - DNA, 1146 bp, Glycine max
  Peptide Sequence Number=SeqID_134701
atgtttgcctttacatctcccggtatcaaatttgacaaatcctataatgctggaaaaggacctccaactttccgtatacatggacaaacacatcatcttattggaagcctcctccctatgcctaataacccacctaagtttgcacaactatgtatttatgatacagacaatgagatcatcaacagactgtcacaaaatccgttagtattcatacttatgtcacacatgatgcatgatatgcttgatgaacatattatcattgcaatcaaagacatgcttgatcacaatcactatgctcaaaggtttcaaatggcaagggacaaattgcattttgctgcagttccagacctgaagatgaaactcattagtcaaagacaaacagacggaaggttgtataacttaccaactaccactaaagttgctgccttgattgttggtgatgaacactcagttgataaaagagatattataatagaaaaacaatccggacttctaaagagaatacatgaacttcatcctgcatatttgcctttgcaatatccacttttatacccaaaaggagaagatggttacagactaaatatacctcacaaagatcatgccaatatacatgctgcaaagaggaaacaagtcacattgtgcgaatatttttgttaccgcctacagtcaagaactaatgaagcacagactatacttcattccagaagattatttcaacaatggattgttgatggatattgtatgattgagtctcaaaaactaaactatgtcaaacagcatcaacaacaactcaaggttgacaaatacatcaatttaactggctctaatgatcatcctgaaaaacttggtagggatagaggaaagagaattatactgccaagtagttttgttggtagtcaaagatatatggagcaactgtattttgatggcatgacaatttgtggacatcttggatttccagacttattcttaataatgacatgtaatccaacatggccagaaatacaacgcaaggtcacacaatccaatctgacccccaataattgccctgatattatcacacgagttttcaaaataaaactcaatcaattactgaatgacttaaaacatggcaatatctttggcaacattatcggatgtaagtaa

SEQ ID NO: 43017 - DNA, 519 bp, Glycine max
  Peptide Sequence Number=SeqID_134702
atgttgggagcgattatgtcgacgacgaccatccgtattccagatgagcttaaagcccgcgtcaccgccgtcgccgagcaggctggcgtgacgactcacagctttattttgcaggcaatagcggagaaaacgcagcaagaagagttgcgccgcgactttgagaatgaagcggaaaaacgctatgccaagataattgcgacgggagagacggtctcttggaaagagatgcgcggttatttggaaaattacgcagcggaggtcagggatgatatcgaacgtattctcgctcatttggctcactatggcgctgcggattcagggcggcgcattcaggaaatcatccaggcgattgcggtattggaacataatccattgatcggacgagcccttggcgcagggctgcgtgaattgattattgggcagcaagctcgcggttatttggcgctctacaaatatatccctgatatcgatacggcgtttgttctggcgatccgtagtcagaaagaacaagggtattga

SEQ ID NO: 43018 - DNA, 459 bp, Glycine max
  Peptide Sequence Number=SeqID_134703
atggttaaggaggagtgtaaggagttaagtgtctcctccaagaggttagctaagaaggaaagtcattttacaataaagacaaacattaaagaaacttcccctcttagacaacctccacattttctcctttgtaaaaagacacctgttagcattgtcacacctattgcgcttgaggttattcctcaagtaaaagagttgttggatgagggtttggtttgtaagagcttaaatccttgtgctttgttggtgcccaaaagaggtattatgaggcaccaaatccctaaaataggtggtatgatgaatgtgttgagtggtgcaaccctcttttgtaaaatcactcatgcacccaacatcttcatgatttgtgtacatagggactcattaggggttcccatcaaccctaagagaataaaggtctttcttgagtggtccactccaccaagtataaggaaaatttga

SEQ ID NO: 43019 - DNA, 153 bp, Glycine max
  Peptide Sequence Number=SeqID_134704
atgaaggaaactcttaaggtggttggccccttgcttcttgactcaaattcttcaagggatggcatcaatcctcctttccaattccctatatggaaactcacaaacaaggaaacaaagagacaagcaattaccaaagaccaaaaaatgaaatga

SEQ ID NO: 43020 - DNA, 207 bp, Glycine max
  Peptide Sequence Number=SeqID_134705
aaaccttccccctcccccattttaaccctcttcgtgcaggggttgctcgcccagcatcctatgggtcggcgttcgcttactcgaactccctcagggatactaggttgccttgcagcggcactttccgtttgtccagcgctgggcaagggacgacgatctatcggtcgtgaccctagcctctacttgcgtccgtccctaagtacctga

SEQ ID NO: 43021 - DNA, 249 bp, Glycine max
  Peptide Sequence Number=SeqID_134706
atggtgaaaaagaggctaagttttgaaatgccaaaagtagcagttgggctaagcgcatatccaccactaagcgcagcttcaacgcgtttagcgcaaaggagaatttggcagagcatcagcattaaagtcggtacacaccttttgagacttgggacagaatttttagaggcacttgtgcacaacattccacattggttattttgggaaaagagccccagaagcagcaaagaagaacaacttgtgcattaa

SEQ ID NO: 43022 - DNA, 270 bp, Glycine max
  Peptide Sequence Number=SeqID_134707
atgcaaagaagatctactgcaggtgatttgatccccattgatttggagattaacgccacttgtagaaggcgtaatcaagagagaattagaacatttatgcaggatttagaagcagcaacaattccagaggaagaacctcaatcttctaaggcatcttctagttttcctattgcaagacattctcattttgatcctatcgaagaccacatcatggctgaagagccaagaagagtcaccctgaaagattattcaagttctaatgtgccataa

SEQ ID NO: 43023 - DNA, 168 bp, Glycine max
  Peptide Sequence Number=SeqID_134708
atgggtgaagcagagaaggtgcaagggaagatgaaggccaaaagtggaggccataaaagagcaaatggccacaatgataaaggccatgatgagcatgaagaagataatggaagccaatgcggcaaagatttgggaagtacggatggccccatgatgtgcaaattctaa

SEQ ID NO: 43024 - DNA, 450 bp, Glycine max
  Peptide Sequence Number=SeqID_134709
atgaagcacttcactgacaccctcatcagtgccaacatagggaaaggtaagtgtatcccctctccaatttccaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43025 - DNA, 727 bp, Glycine max
  Peptide Sequence Number=SeqID_134710
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgatggtagttcaaatgcagatatcactacccaacaagtgtttggatggcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43026 - DNA, 316 bp, Glycine max
  Peptide Sequence Number=SeqID_134711
tgatcaggtcattaaacgatgcattccagatcatgagactgactcaatcctgcggttctgtcattcttccgcaccgggagtagccaaagtcatctgggtgttcaagagacagctcgcaaaatgcttgactgtggcttttattggcccccatcttaagatgcgtgaggaagaatttgtagcacttgatttagagcagattgccttagagagctatggaatgcaattgatatgtatcaaaatgggtggtagccaagactccacagaactaagagctttaaggtcaatggacaccgacttaaccttccgtcagatctaa

SEQ ID NO: 43027 - DNA, 695 bp, Glycine max
  Peptide Sequence Number=SeqID_134712
atggaggccatgaaagagcaaatggccacaatgatggaggccatgatgatcatgaagaagataatggaagccagtgcagttgcagttgccgctaccagcactgttgctaaggtaaacctgatgcccccatctggcctcgaccaaatgaatcatccaacctcagctatggtaggcaaagatttgggaagtacgagcagcccccattatgtgcaaagtcaaaacaagcatgccttcccactatatggcttgccccccaactatacaccacccaatgtagcgtacactcccagtgagaatgtcaataactccactcctatactcattgagagccggcaaccccaaaatgatcatgcacatgtctctcaacccatgggtgagacacatgaaatgccccaccacaatctagccgacttcgagccttgcctcagatatgccactgaagggcaggcaattgatggtatacccctacaaaaccctttggagggccctcagtatcatccccagctacacttcctgcattccacaacaagtaaaaaccctcatgctatggcagaaatgggaaagttggatcatctagaggaaaggctcagggccattaaaggaggtgaagattatgcctttgctaacctagaagagttgttcctagtacccaatatcatcacccctcccaagttcaaggtgctggactttgacaa

SEQ ID NO: 43028 - DNA, 462 bp, Glycine max
  Peptide Sequence Number=SeqID_134713
atggttgtttctagcggcatagcttctttgttattgcctggaggaagaacaacacattcaaaattaaaaattcatgttccgatatttgaagactcgacttgcaatattcatcaaggaacacaattggctggattattgaatgaaacaagtcttatcatatgggatgaagccccatggctcacaaattcttttttgaagcacttgatcaaagtctatgagatgttattaaggcaaaatcaagttctgataaaatctttggtgattctgccagtcattcctaggggtagccggtctgacattgttaatgcaactataaattcatcatatctatggaataattgccatgttttgacactatcgaaaaacatacgtttagaagccaatatagatgcaaaaaacagagaagaaacttcagcttttgcacagtggatccttgatgttggtgatgggattgttgggtag

SEQ ID NO: 43029 - DNA, 204 bp, Glycine max
  Peptide Sequence Number=SeqID_134714
atgtcagcgctaagtgatctgtcatccgctaagtgcatacctgatatgaatagcagtggaatggacaaggaagagagagaggagacaccacttcaaggagaagatagtctagaagaagctcaccaccataggaggccatggataagagcttggaggaagaaggagatgaatgaagggagaggaagagaagagcacgaaatttag

SEQ ID NO: 43030 - DNA, 82 bp, Glycine max
  Peptide Sequence Number=SeqID_134715
gccacaaggtccaacaaactccgcgcattttcctttcttggaagacgcacccgcgagtcccgcgtcgccctcccgtcgaagg

SEQ ID NO: 43031 - DNA, 425 bp, Glycine max
  Peptide Sequence Number=SeqID_134716
atgccttatgtggaagccgcagaagaatcgttagaaaccgctttccagtcttttgaggtggtcagcatttcctccgtggactccctctttgggcaaccttgtctgtccgatgcggcggtaatgatggcccgagttatgttggggaacggctataagcccactcaggcggacatgaaaagaagcatcgcgggaaggaagaacagtggtcagagctcgcgttggagacaagaaagtgaaggaagcccgccctgccacataagtagaagctttataagtgcgggtctgggagacgaaggtcaagtgttcgcgatatgtggagatgatgttccaagtacttcggatttggtccgaccatgccctcctgatttccagctgggaaattggcgagtggaggaacgccccggcatttacgcaacaagcataat

SEQ ID NO: 43032 - DNA, 111 bp, Glycine max
  Peptide Sequence Number=SeqID_134717
agactgacatcgtcttctgcaccttttgttcccccggggacaacgggtcatttgtatgcggagatgttatggtcacccgcgactctcgtctaccgagaggaacgaaattag

SEQ ID NO: 43033 - DNA, 135 bp, Glycine max
  Peptide Sequence Number=SeqID_134718
atgggtgcaactgatatcatcattgataaacaggaatttaaaactcttgtgactagtcatcctgctgggtctcctgatcctgagtgccctcctcatctgtcaaatgtagcacaagagtggctggaggagtggtaa

SEQ ID NO: 43034 - DNA, 177 bp, Glycine max
  Peptide Sequence Number=SeqID_134719
atgttcttcatattcaacattgctttgaaaggacttgatgatactccacagcctaaatccaaggctggtgctaggtggattgttgttaagtgtaatagaaaaaaaggaagcactgagtacggctattacgtcatccactggatgtccacgaataatcttaggaactttcaggaataa

SEQ ID NO: 43035 - DNA, 99 bp, Glycine max
  Peptide Sequence Number=SeqID_134720
atgaaaacaaaaggaattaatgaagcattgggcttgaatccagaattgggcttgggcttgaatccagaattgagcttggacttgaagagggcagactaa

SEQ ID NO: 43036 - DNA, 419 bp, Glycine max
  Peptide Sequence Number=SeqID_134721
gctgaaatgcttaaatgagaaatgctcttgggaacggaagcttcgtgcatactccagacatcgtctccaagatcccaacggtcagatcgtggacaagtgtcttgtgaagctgcaaacaaaatttaaagacaatccaacggttaacgaaggctgcacagtgtttttaccgaggcagcttcatgtagcttcctcaacaagcttcattaagaggcttcctcaaaaagcttcctctgatcaaggagttcccatgaaccctaagagaataaaggtcattcctgagtggcccactccaccaacaccactcattgagtttgtgagaaatcatgttccttcatgggaagatgcccaggaaatgggtgttgagagaaggagcctagagtatgaagaacctcaggatttgaggtcaaatcctttccaag

SEQ ID NO: 43037 - DNA, 465 bp, Glycine max
  Peptide Sequence Number=SeqID_134722
atgatacgcggagataccttatggttattcgcacccttttgtcatccagaggcggcgggcccgatgacaagcagagaccaagtttggtcattctgcacccatgatacgcggagataccttatggttattcgcacccattcttttgctatctgtaagacagaacgcttgatagcatgcagggggctgacacagtcttctgcaccttttgttcctccggggacaacaaagtcatttacatgtggaaatttcatggtcgcccgcgactcttgtcagccgagaggagcgaaattagtgtcatacgctgattttcggggacctttgcttgatgacatgcgaccattctttggtccttgtgaggtgcttggcatccatcatcaggcagtttgtgaaatcctaggaacgacgagtcacggtcacccgcgactctcgtcaaccgagaggagcgaaattagtgtcatacactga

SEQ ID NO: 43038 - DNA, 225 bp, Glycine max
  Peptide Sequence Number=SeqID_134723
atgcctttccaaagacaacttgataaggagacattcctatgcaccctttgtatcgcggccaacaagcccgttgacacacggagatttacgtcatcttccgcgcagacaatttctgccatactgacactggagtcacgtgacaggcgaagatacccgagtggttatccgtttaaaatttcttttgctatctatgagactcaaagcatgatagcacgcagagactaa

SEQ ID NO: 43039 - DNA, 228 bp, Glycine max
  Peptide Sequence Number=SeqID_134724
atggacccttgggtactagtaccctcacccttaaaggactacacgtcctcgccatcagagggctgcatgccctcaccttcagaggactatacgtcctcgccttcagaggactacacgtcctcatcatcagaggacttcatgtcctcatcttcagaggactacacgtcctcgcctttagaggactacaagtcctcgccttcagaggactgcacgtcctcgccttcgtag

SEQ ID NO: 43040 - DNA, 801 bp, Glycine max
  misc_feature (685)..(685): n is a, c, g, or t
  Peptide Sequence Number=SeqID_134725
atgatctccacgtggccggccagcgccgcctcatgcaatgcactgcggcgctggcgatcgcgggcgtcggcgcgcgccttgtgcttgagcagcagctgcaccccggccggatcgtcatcttctgtggcagcggcggccagcagcaccggcgtgccctcggtcggttcgctgcgcgcaccgcgttcgagcaggaagcgggccaggcgccagttgccgacctggcaggccaccgccagcggcgaccagccctcgttgttcaacgcatcgacttcggcggcggcatcgcgcatcagcgcggccacgcccgggtcggaactgcgcgcggcatggtgcagcggggtgttgccatcgctgtcgacggcacgcgagtcggcgccgttggcgagcagggtcatcaccgcttcggggcggccgtgccagctgtcgcgggtgacggcaagcagcggggtcatgcccccggtgcggcgcattcacatcgacgccgcgggcgatcagttcgcgcagcaggcgcaggtccggcagcaccgccgccagcaccgccaggctgcgctgttcgcgccagttcgggtccggcagcgcatacggatcggcaccggcctgcagcagctgcaggccccggtcgatgcggccatggcgggcggcttcatacagtgccggggtcagttcctgcggtgccatcgcctcnagcggcgcggtttcggccgcggtggcgaacatcggttcgtgctcgttgctggcggtggccaacgggctcgcgcgccccgaccccagcggtgccggcgcgacccgctgcagcagcag

SEQ ID NO: 43041 - DNA, 309 bp, Glycine max
  Peptide Sequence Number=SeqID_134726
atgggcttcgttcatcgatgtcttggtgctttaggtatcgtcctctttccaaatgaggatgggctagtggacctagcggcgattgacgccttccttgcttatcaccatagcaaggaaagtccaaagatgcgagaagagcggcgtaaggattatctgttgcacacccgctctttatgtatggctggtcttacacctcttttcgtcatgaaagtagacccgtttgtcccctgcaaggtcaccgcatatgtgtcgacaaagggaaggccaattgggagcaactcttggaagtatggtaggggcatccattaa

SEQ ID NO: 43042 - DNA, 288 bp, Glycine max
  Peptide Sequence Number=SeqID_134727
atggtgaaagttggaacctcttacgtgccgatcaacgtctcattttcgccaaaagttggcccagggcttcccggtatcaacagggacaccaagatttatttgttctgcgaagtgatcttccgtcacagctgtccctcctgttcagctactgacggggtggctgcgcaactgttgggaagggcgatcggtgcgggcctcttcgctattactccagctggcgaaagggggatgtgctgcaagacgattaagttgggtaacgccagggttttcccagtcacgacgttgtaa

SEQ ID NO: 43043 - DNA, 261 bp, Glycine max
  Peptide Sequence Number=SeqID_134728
atgacattttttcctcttagaaatcaaccaccacccgattcttctgtgcatcgcatgttatgtgtcagtcacgtgtttggaaatcattttgttcaggtttatttgaaagaccgatgtcctttaccgcctctagcattgttgtggtcaaccaattgttattctcaggcaaagcagtggccaacttcatatattagtagaatgcagcagtacacaagcttgatgtcattcaaaagagactatgtcgacctaaatgaagactga

SEQ ID NO: 43044 - DNA, 531 bp, Glycine max
  Peptide Sequence Number=SeqID_134729
atgaagccaaggggttacatagaatctgatcatgtacaagatgatgtgccttaccaagttgaggaaatgtcacatgtcaacgaagtcatggaagttgaaagtatttttggattgcaagatttaagaggtggtgatgaagaagtaaaccctgctaatttgttgaaaaatgaagaagaatcaactaattcgaatggagaatcaaacaatattgaacaagacaatgaaggggaattagaagatgatgactttgaaatatgtcatcaggtggcgctgacccttctcgacccccgtcacatgactcaagtaggaaagggacaattaggcctcccgatgttgcacctacaccatctccacctccggctgaagctagaccatcttcatctcatgttaatgaacgtggaccatctccagtacctgcatccacaccatctccatcctccgttgatgcacatggactgtccccagtacctatatccacaccttccccatcccctcttgtgggcaacatgcctacagatgaagatgctataa

SEQ ID NO: 43045 - DNA, 75 bp, Glycine max
  Peptide Sequence Number=SeqID_134730
atggcgaggacgagtagtcctctgaaggcgagggcgtctagccctctaaaggtgaggacgtgcagtcctctgaag

SEQ ID NO: 43046 - DNA, 1089 bp, Glycine max
  Peptide Sequence Number=SeqID_134731
gcctgcccggttgatgccatcgttggcgcgacccgcgccatgcatacggtgatgagcgacctgtgcaccggctgtaatctctgcgttgccccctgcccgactcagtgtattgacctgcgtccagtcgctcagaccaccgaaacctggaaatgggacctgcaggccatcccgttattttccgctttccgaaaagacaagatctgggacttcaacggcggtattcatccgccggaaatgaaaactcagtccaacggcacgccgctgcgtcaggttcctctgccgcagcgttttgtcattccgctgaagcagcatatcggtgctgaaggcgaactgtgcgtccaaccgggcgacaaagttttgcgcggtcagcagttaacccgcggctttggcaggatgctgccggttcatgccccgacttccggaacggtgacggctattgccccccattccaccgcccacccttccgcgctggcggaactcagcgttattatcgacgccgatggcgaagactgctggatcgagcgcgacggctggagcgactaccacaacaagtcgcgtgaagagctgatcgagcgtattcaccagtttggcgtcgccggactcggcggcgccggcttccccacgggaacaaaactgcgcggcggcggcgataaaatcgataccctgattatcaatgctgcagaatgcgaaccctatatcaccgcagacgatcgcctgatgcaggattgcgcggcgcaggttgttgaagggatccgcatccttgcgcatattctgcaacccaaacaggtgctgattggtatcgaagataacaaaccgcaggccatttcgatgctgcgcgcggtgttatccgacgcccacggcatagcgctgcgggtgattccaaccaaatatccctccggcggtgcgaaacaacttacgcaaattctcaccggtaagcaggtgccgcatggcggccgctcctccgatattggcgtcctgatgcagaacgttggcaccgcttatgctgttaaacgcgcggtgatcgacggcgagccgttaaccgagcgcgtcgtcacgttaactggcgaagcgattagccggccgggcaac

SEQ ID NO: 43047 - DNA, 258 bp, Glycine max
  Peptide Sequence Number=SeqID_134732
atggaggagggccaactgtgtgagcaacaaccagagagggaggctatcacacagagagtttatgcaaagtaccggataagggatgcacccacaagccctttcgatggcgacctcttgtttctcataacaggtggacccttgggtactatacctagctcttcttcagagggtctacatcctcccacagaggtactacaccctcaccttgcacagggcgcacgccctcgccttcagaggactacacgtcttcaactttag

SEQ ID NO: 43048 - DNA, 198 bp, Glycine max
  Peptide Sequence Number=SeqID_134733
atggccctaggcctatggtgcattctgaagcaatggggcatgccacattcatgcctaaacatgcgcccaccaagtgctcgacaaaggatcaagctgaaagttttgatgatgccaaaggattacatgaatcatatgcttctcaaagatttactcaagacaaagcaattaatcaagatggatgatcaagacagtctatag

SEQ ID NO: 43049 - DNA, 156 bp, Glycine max
  Peptide Sequence Number=SeqID_134734
atggcctttgtggataactgggtggtgggtaaggaggagacccacatcggtcctttcactggcaaagaccaaatcctcaaagctttgaagaacaccggtcacgtgtctactatcattgtgataatctctttctctgtttttgggggtgctacttga

SEQ ID NO: 43050 - DNA, 165 bp, Glycine max
  Peptide Sequence Number=SeqID_134735
atgactggtcaccttatgatgttacttagtgagagtgaccgagtgtacccattgtgtggtgtgctttgtcatgtactcctaagcgccccagtgttgtttttcactgacatggtgaggcttcatatgatgagtcacatgctagagatggagagacttagtctgtga

SEQ ID NO: 43051 - DNA, 336 bp, Glycine max
  Peptide Sequence Number=SeqID_134736
atgatagttaaccaacaagtgaagattaccctcacccatcttggcactaaatttgtgttgcatcctcaaacaccttcacaggaggccaaagaccaactaactatgaaagataagagggatgaggaagaaaaattagaaaaacaaaagaaaaagaaggatagtaaggccttgtcttcaaagaccagggggaaggaaaaagaggaaaaggattcctccaagaagattgttaagaaggaaaatcattttgcaacaaaaaggatattaaaagagcactcattcttaaacaatctttctaccttctcctatcaagggaaacatcccttagcactgccataa

SEQ ID NO: 43052 - DNA, 519 bp, Glycine max
  Peptide Sequence Number=SeqID_134737
atgcggtcatgggtaaggggccaatggattccttttgatgtagacgccctcagccagttcctgggatacccgctagtgttagagaagggccaggagtgcgagtatagtcagagaaggaaccaggccgatggatttgacgaggaggccattgcccagctgctatgcataccaggtatgccgcctaccaggcaccctctagacccagataagactaacagggccctgggatttccagcgttgatcacgggcctctgccagtcatttggggttcccatcgcacctagtaagatacatgagtgtttctaccagctctgcctcagtcagcagggccagggtttcgttccttttgcgtgccctactcctgatcagttttgtgctgaggtcgcatggcccggagattggcccgaggcccaggcaggggaggcgcctgcagaggctcctggcgatgcagaggaggcccgcatggatgaggagatgacggattttctcggtttcttgggagggagcggagccacatga

SEQ ID NO: 43053 - DNA, 441 bp, Glycine max
  Peptide Sequence Number=SeqID_134738
atgcagaaaattaataagcgtcacattcagcttggagattcaagatgtccattctgcggaattgaggaggaaagtgcaggtcatttattcttcctttgcagcaagatccttccaatatggtgggaatctttatcatgggtgaacttatcgggagttttcccaaaccaaccaaggcagcactttcttcaacacatttatggagtgacagaagggatgagatctagtagatggaaatggtggtggatggcactgacatggaccatttggaagcacaggaatactattatcttctcaaatggctcactcaatgccaacagaattttagatgacgcaattttcctactatggacgtggcttacaaatttggagaaggggtttaatatgcactacaactactggtctactaacatcagagcagggttcctaaatagaataggatag

SEQ ID NO: 43054 - DNA, 616 bp, Glycine max
  Peptide Sequence Number=SeqID_134739
tggagagctatgggcaaggattctggattctaagtatggcggctggaggggccttgatgcagcaacaagcgacaataatgtttctttatggtggggagatctaaaattagctcttcatcatccccaacatgagactgctttacagggagggatagcatggaaggcggacaatgggtgggagtggaactttaaatggagaagacacctgtttgatagtgagcttggcatggttgattgcttcctaaatgatgttgctggcagctgtattcaacctcatagaagggatgagtggttttggaaaccagaaccaagcagacaatattcaatcagaagtgcctatgacgtgctgaaaggagaaaaagttgagggggatggagtgcgggctactaaaggaaagattgcaaacaaagtcaaacttgaggaggagacagtcatggagctttcccgcagaaaccttggcagcacttctcccagcatgcgatatgtttgcctaactgaatttgtgataacagatggaggtgttggtagttgcctctcacatggtcgatggataggtgggactacagtgtcagttgcaaggatcagggttgcagtggaaggagatggtaggaagtag

SEQ ID NO: 43055 - DNA, 88 bp, Glycine max
  Peptide Sequence Number=SeqID_134740
atgctgagttttggtgtgcccatgcacactaaacagaaaattggtgtgcccatgcactctaaacagaaaaccgtcttctcagtatcag

SEQ ID NO: 43056 - DNA, 1551 bp, Glycine max
  Peptide Sequence Number=SeqID_134741
atggacgacgacgacgaagaatacccaattcccgtctcaaagaaaccctccacgcaaaacgatgagatcatggaactgttatggcaaaacggccaggtcgtgatgcaaaaccaaaaccaacgaccgttcagaaaacaaccgccgacgacggacggcgacggccccattccggcgagggagattcgatcctccgaagcggaaaactacaatagccaacacttgttcatgcaagaagacgaaatggcgtcgtggctgcactatccaatccatgaagatcctcctcccttcgatcaccacgatttctgcgccgacatcctctacccgccgccaaacgccaccgcgagccagaatcaaagcagcgcctccgtgcagtcctccgttcgcacgacggagctccagcatccggctcctcggcctccgattccgccgccgaggcggcaggagcatacgctgagcaggatacacaatttcacgcacttcgcaaagcacggcaatgcgtcgtcgagttcgaaggcggccgcgccggcgcagccgacggtagccacggcggagcacgtggaaaccggccgcgcgagcgtcagcgccgccgccggtaaaacccccgcgtcggatggcgggagggagacggcgacgtgcgacgtgaccgtgacgtcatcgcctggcggttcgagcgggagcgctgaaccggttcagagagaaccagtggtgaaccggaagaggaagggaagggaacaagaggaatcggagtatcagagcgagattcaagaccttctaaccaaggagcatggtggattggacttgatggactggagtgattcatgtgcacatgatgttgattttgaatctccggaagctaaaaagcaagttcgtggttctacatctacgaaaagatctcatgctgcagaagtccataatctctcagagaggaggcgtcgagatagaattaatgagaagatgaaagctttgcaagaacttatacctcggtgcaacaagtctgacaaagcttcaatgctggatgaagcaattgagtacttgaagtcactgcaattacaagtgcagatgatgtccatgggatgtggcatggtacctatgatatttcctggaatccagcagtatatgccaccaatgggaatggggattgggatgggtatgggtatgggcatggaaatgggaatgggaatgaacagatcagtaatgccatttcccaatatgttagctagttcgactttgccagcagcaactgcaactgctcatttgggaccaaggtttcctatgcctcctttccatatgccccatgttgctacacctgattcatccagaatgcaaggagcaaatcacccagataataatatgcttaactcacttggtacactagatccagatcaatcatgtatcccaaacttcactgatccttatcaacagtacctcagtctccaacaggcacagttacaattaatgcagacaatgaaccaaccaaatgtcagcaagcctagtactagtagaggtcaagagaatccagaaaagcatcagtcaggtaaagtgtcattgtag

SEQ ID NO: 43057 - DNA, 585 bp, Glycine max
  Peptide Sequence Number=SeqID_134742
atggttctcgccattgctgttggcggttcctacatggactgtgtctcacccgtaacaatggcggtaccctccagctcagcaacgttctcgcccgtaacaatggcggcaccctttcagctcagcagccttctcgctattgcagatggcggcacagctatctcgctaacccagcttacgacatccatggaggaacagactctccttgtaaaaagtttgaaaacagactctgatcgagcagagctagctagcttcctcaacatgtttttgtggctctctaatttcatccgttcttggcctctactaatctatgctgccacttgggttactgtaatgacgtttacggtggcagtggcttcactctccacagaggtggcatttgtctccgccatatcttcctctgagaagtgcaagagtgatgggtcccttgttagagttagggttccggtggaggagacaccgtgtttcccagctcatcttttcaccaagtcccacatcgatgtcatcgttccaccgatctttgcagcgctcgttgtagctgcttctgcttgcgtagtaaaagttgtgggcctatgggagcatgattaa

SEQ ID NO: 43058 - DNA, 261 bp, Glycine max
  Peptide Sequence Number=SeqID_134743
atgaagctgcgcccagctcatcgaggaactcatcaatgcatcggggaagagaatggactatggcttagcctgatgagactcaaatcaagcatggattggacctgtttttcgagttcggtcttctggctatggggtatcggtaagggtggaaaggtctgggggaaggggtggttatcggaaaggagggtgggggaagtaaggagtgttgagggtgatgaggatggtgcagggcctaagtggaataaggccgaaacggcctga

SEQ ID NO: 43059 - DNA, 267 bp, Glycine max
  Peptide Sequence Number=SeqID_134744
atgacagtcttgatccccaggaacactatacaatcccaacaaagaaagagcagggtttacaaaggtgagagaacaaggactggagataacaacttgctggccaaatatgaactctcaggcattcctcctgctcccaggggtgttcctcaaatcacagtgtgctccgacattgatggcaatgatatcttgaatgtctctgctgatgataaaactaccgaacaagatcaccattaccaacgacaaggtggacacacatataggctttaa

SEQ ID NO: 43060 - DNA, 720 bp, Glycine max
  Peptide Sequence Number=SeqID_134745
atggacacgcgctctcccgttaatgctgtgcatgacaacatcataagtaagctggaagttacttttagtgagtcattacatatacatgatgctcagaattcggaacatgcatctgaaggggatcatattggtaattgtgatgtgggagagcggaacttacgcgaaggttttgaactgcaagaaaccaaactagagataaagtgcttgaaagagtgttcgacttttccttatcctgatatgatgctgccttcaagctcttctgacgaggaggctgatgcatcgtcaccctctaagcagtctccacgccaaaactactcgtgctcagtatctttgccagcacctcgaaagcttgtatctgccatgaaaggtagccgcgagaaagagcggggatcacaaatgaaattgacagtgaagtgggcccctgatgtatatgatccggtacctacattgttatcacatactgttaaaaacaagaaacagcaaaaacccaggatcaagaagagtgaaaagaaaaatggaaagaagggccagaaggtcagttactctaaaagaggcagcagcaaagataaacagtatcgaaataggtggttttattctcatgatgaagtgtttgaagcttcctctgataatgctgctaaccatgattcctactgtggaactagctactacttggaaacatcactcacaaaggttcactggtctattggagaagcgctgtaa

SEQ ID NO: 43061 - DNA, 102 bp, Glycine max
  Peptide Sequence Number=SeqID_134746
atggctcccgcagaggccgagaagaaacccgcggagaggggaggtgggtggcggaagaaggaagggtgtggggagggaggattgaagatggaggcgaaataa

SEQ ID NO: 43062 - DNA, 228 bp, Glycine max
  Peptide Sequence Number=SeqID_134747
atgacggtgacactgatggcagagccaataataacactagtgacaagagtgataatggtgaccaataatgataatggtagaatagtgggttattacgatgaacatgacaataatagtgataacagtggtcatgatgtgtgcagtaataatgatgatgatgacaataacgatagaggtgataagaacaacaacggtgataagagtgacaatgaagtggttgcaatataa

SEQ ID NO: 43063 - DNA, 1035 bp, Glycine max
  Peptide Sequence Number=SeqID_134748
gcagaagaacagaaactaaactttggaacccagatgatgtcttcggattctgttcttcctctccccgaaaatcccatcattgtggggtttggtggggttggagtggattttctggcagtagtgccatcttttcctaaacctgattccaagattcgaaccactgaattcacgttccaaggtggtggaaataatggaaatactatgacatgtgctgcccggttgggcttaaagccaagaataatttccaaggtttcaaatgatggtccgggtaagactatgctggaggaactagaagctgaaggggtggatacctctttttttgtggtctcgaaggaagggacttcaccatttagctacgtcattgttgacaaccaaacgaaaacaaggacttgtatattcactccaggatatcctgaaatggtccctcaagatcttccacgagccaatttgttatctgcactggatggagcaagaatggtctattttgatgcaaggatgcctgacagtgctcttgtcattgctcaagaggcctggacagaggcatcatctattccaagagcactagtttcaattattttaagattgccaagacttaaatttgctattgtaactttgggaaaagatggctgcataatgcttgagcgatgtgtggatgatgaaggttctcacatagaagaaatggacgttgaaagctgtttgacaacattaaaagagagaaaggacgatagcacagccatgccaacctgcatagcctcgcccgttaccaaattaagagccaagggcatagaagaatctgtgtgtgggaggttatattatggggcatctgaaaagatcccaccatcagagcttatggatacaactggtgctggggatgcatttgttggagctgttttatatgcaatctgtgccaacatatcaccagagaaaatgttgccattggcttcttatgtggcagctgccaattgtagagctcttggagctcgtagaggtcttccatacagcaataatccatgcctggcatcctttactgagtag

SEQ ID NO: 43064 - DNA, 2412 bp, Glycine max
  Peptide Sequence Number=SeqID_134749
atgatgccattgacgcctgatcagtctaacaagaaagttgggtcgagtatgtcggcttctccgtcgccgttcctgacgcctcgcccggaacggcgccgtcccgattcaaggggttccgattggggctccaaccgtcaggacaaggataaagagaccaacgtccaagttttgcttcgatgcagtcatggttttaaattgtggcccgcaaccacaattgcggtggcagcgtcaaggccactaagcgatgatgagctcagatcgaacgttcccagggtggtgacatgttatgaaaacaaaagggaagtctcagttatgcagactctagctaacaagcaagtagatagagttttcacctttgacaaggtattcggacctaaatcacagcaaagatcaatatacgaacaagccattgccccaattgttaatgaagttctagatggtttcaattgcactgttttcgcatatggccagacagggactggtaaaacttatacaatggagggtggaatgagaaataagggtggtgatttacctgctgaggctggtgtcattccaagagcagtgcgtcaaatatttgatattttggaagcacaaaatgctgattatagcataaaagtgacattccttgagctttataacgaagagataactgatttgttgtcccccgaagacaattctaggcctacagacgaaaaacaaaagaaacctataacccttatggaagatggaaagggtagtgtatttgtgagaggccttgaagaagaatcagtatacagtttgaatgaaatttatactctgttggaacgaggagcatcaaaaaggcgcactgcagaaacgttgcttaacaagagaagcagtcgttcgcattcagtcttcaccattactgtgtatgtgaaagaaacagtgattggtgatgaggagttaattaaatgtggcaagctcaatcttgttgatttggcaggatccgaaaatatattgcgttcaggagcacgtgaggggcgtgctagagaagcaggggagataaacaagagcttactcaccttgggacgtgtcataaatgcgcttgtggaacattctcctcatgtgccttacagagacagtaagcttacaaggattttgcgagactccttaggagggaaaacaaagacatgcataattgctactatttccccatctgcttattgtatggaagaaacacttagtacactagactatgctagtcgtgcaaaaagcataaagaataagcctgaggcaaaccaaaaggtttcaaaggctgttttgttgaaggacttgtacatggaaattgataggatgaaagaagatattcaagcagcaagggagaagaatggtgtctatatttctcatgaaagatttgccaaggaagaagctgaaaagaagtctaatgtttcttgcaacctcttcattcagtcaaggaatgagaagatagagcaattagagaatgacctcagtcttagtgagaagcaagtggccagcttccgtgaactctatttaacagagcaagaacagaaactggaattagaaagtgagcttaaggattgcaaggtgaatttggaaaaaaccagcaacaccttgcatggcctccaagagaattacaagctattagtttcaaccttgaaggagaaggaacacaccatttccaagctactgaaatcagaaaatgccttgattgagcgtgcaaaggaaatgtgtactgatctgcagaatgcatcggatgatattaatttactgtcctcaaagttggatcacaaagaaagactggaggcagaaaatcaaaaaacaattttgaattttgggtctctcttaaatgggagcttaaaggacttgcacacaaccattacgggatgtgtttctcaacaacagaaacaacttagaagcatggaagaccatgtcagctcctatcttgccagtaaaaatgatgctgcacaaactctagaatcaaggatcaacaaaatgacaggaatttacacttcaggggtagagaccctgaaggagctagctaatacattgcacatgaaagcttcatctgatatggaacaaatacaatctaaagtttcatcgcaaacattggctgttgaaaatgcattgactaaattgtcattatgttgtgtgccccaacagtttcttgccactgctgttcatgaagccaaggatgtaatatgcaacatccagaattctattgacgagcaaaagcagctgctagcattctcccttcaacaacaagaagaaggatttcaacaaagtctgacttcagcacgagtagtttcagaggcagccgtaaacttctttgatgacattcatctccgttcttctagagtcatgaaaattcttgaagaaagtcaaaatgagaggttccagcagttaactaactttgagaagaagttcaaggtatga

SEQ ID NO: 43065 - DNA, 867 bp, Glycine max
  Peptide Sequence Number=SeqID_134750
atgatggtggtagatctgatcaacctccaacagaatcggctcaacgacgtcgtggcgaatgagctcgaacctagggttcccgaacagatgcaccaggttctcttttcttcccgtgaagaaattgtcgatcacgatgacgtcgtcaccgcgagcgatgagtttgtcgacgaggtggctcccgacgaagcccgcgccgccggtgacgacgattcgctgcctcctgccgccgatcccgaccggaacgcggcccgtgcgaggccttgtgccgctgaagcgggcaagcccggttcgagggaggaatgtgtgggccggctcgggtgggcccatgcgggagagagtgggctggatgatgaagaaggtggagccgatgaggatgccgacgaggatgaacaagaggcgctgctcgcggaggaggtagttgatggatctggggagagatctggtgtgcttgatggatttgggggagtagggataaaggtttacgagcttaggaacaagacgaaggcggagctgctgaaccagctgaaggatctcaaggcggagcttgccctgctccgcgtcgccaaggtcaccggcggcgcccccaacaagctctccaaaatgtattgtagtgattattgttatgcgggaatcgccaaggtggtgaggctttcgatagcgcaggttttgacggttatttcccaaaagcagaaagcggcgctgagagaggcttacaagaagaagaagtatttgccccttgacctacgtcccaaaaagacccgcgccattcggagacgccttaccaaacaccaggcgtctttgaagacggaacgtgagaaaaagaaggagctgtactttccactaagaaagtatgcgatcaaagtttag

SEQ ID NO: 43066 - DNA, 1071 bp, Glycine max
  Peptide Sequence Number=SeqID_134751
atggccacaaaacaagttactactactatggttcatgtagatgatgatgactacattgacatggaactatgtaattcctccccaaatttcttctcttattcccttagctctccaccatccaacagagagtttgaattccaaatgagtgagaaagagtcattaacttctccagctgatgatctcttctacaagggaaaactccttcctcttcaccttccccctcgtttgcaaatggttcaaaagctcgttgaaaactcctccaccaatgccaaatttgagtacatcaaatcagattcaccttcaacaaatgccaacaccccttttgaatccaacatctctccttcagaatcacgccgtgtgagcagtgatgtgagcccaaatgaataccaacttgggtggttttctgacattaacaagtacaaccttagtggtggtgatcttcctaagaagtctttgcccaagaaactgaaacagatgaagcagttctggcttggcctgagactcaaggcctcaagggcttacctgaaaaccttgttcaacaaatctggttgctcagacaagttttgtgccagtgctgcaagcaacaacaacatgggagcggagaagaaatcattaaagtgcaaagagtgtcagaacaagtacatgaaggttgcaaggagaaacccttttgagagtttctatgatagcaaggaccaggcaacttgttctgtcgtgaagagcatcagaagagagatgcttgaagttgttgaagatgatttctgtgaccacaggaggtctttctctggggttggtcaacgacattgttccacaaaggcttcatctttgtccacatcttcatcagggtcatcttcttcatcttcttctttttcttttagctcagctgggtactatgatttgcaacttttcaagaggagcatcagtgccaattatgagttggaaagttcaatccagggagccattgctcattgcaagcagtctcagcagcagtgtggttcaaagaatggttcagatgatagaaggatttgttctcaatttgcaacaaaaatgcagttggtgagagttaatgaatag

SEQ ID NO: 43067 - DNA, 309 bp, Glycine max
  Peptide Sequence Number=SeqID_134752
atggcacaccaagagatgaagttgagtgtcgttggtctggccggaggagagatagttgcaggaaccgtcggggttgaggttgttgaactccatgtggacggtcacagtgatggaggtttcaggggcacagttggcgaagaagaggctatattcattggagatggtgacggggtaggaatggctgaaggttgggggaggaagaaacccagccgtgagaggttcgcttggtgggacggcaccaccacggacacggacaccgacaccgacggcggattagtggttgtgtgtggcaaagactatttgatctga

SEQ ID NO: 43068 - DNA, 1329 bp, Glycine max
  Peptide Sequence Number=SeqID_134753
atgggcataaccgcctccaccaatgccgtcgccaccctcctcctcctcttcttcttcatttccccttcagccgcagagatcaaaaccctcaccataacctccgacacccgccccatgatcctcttggagaaattcggcttcacccacaccggccacgtgtcgatctctgtctcctccgtcttcgtggtggcctcaggtgggtcccaacccgatccctcccgattagggttctttctcctgagcgaagagtccctcctgcaagtcctgatcgagatccagcaaaaccctagcttctgcgtcctcgactcccgctacaccacgcacctcttcaccttccgcgaactctctcctccaccctccgcctccgccaaccacacctcccccgtcacaatccccaacgaatactccctcttcttcgccaactgcgcccccgaaacctccgtctccatgctcgtccacaccgagctctacaacctcgacgccgactccgaacactcccgcgattacctctccgccggccagacccaactccccactctctactctctcttctccttcgcctacttcgccttcctcgccctctggatatacatctgctactccaacaagctctccctccaccggatccacctcctcatggcggcgctcctccttatgaaggccctcaacctcctctccgccgccgaggacaagcactacgtcaaggtcaccggaactccccatggctgggatgtcctcttctacatcttccagttcttccgcgtcgtcctcctcttcaccgtcatcgttctcgtcggcaccggctggtccttcctcaaacccttcctccaggagcgcgaaaagaaggtcctcatgatcgtcatccctttacaagtcctcgctaatgtggcttccgtcgtcatcggcgaaacggggcccttcatcaaggattgggttacttggaatcaggttttcttgctcgtcgacattatttgctgctgcgccatcattttccctattgtctggtccatcagatctctcagggaaacctccaagaccgatgggaaggccgcgagaaacctcgccaagttgaccctcttcaggcaattctacattgttgtcattgggtacttgtacttcacccgcattgtggtctttgctttgaagaccattgccgcttataagtaccagtgggtgagtaatctagctgaggaggccgccagcctcgcgttttatgtcgtcatgttttatatgtttaggcctgtggagaggaatgagtactttgtgctcgatgaggaggaagaagaggccgcggagatcgcgctcagggatgaagaatttgagctttga

SEQ ID NO: 43069 - DNA, 2601 bp, Glycine max
  Peptide Sequence Number=SeqID_134754
atgaatgtggtaggcaaagttggaagcttgataactcaaggtgtctactcagttgctacaccttttcacccctttggtggggctgttgatgtgattgttgttcagcaacaagatgggacatttcgaagcacgccttggtatgttcggtttggtaaatttcagggtgtactcaaaggtgccgagaagtttgttaggataaatgttaatggtgttgaggccaattttcacatgtatcttgacaattcgggggaggcttattttttgaaggaggtggatgatgataaagtagttgattcaattgaggctgttcaagattctattgacaaaaagaatggctatttgagtaatgttcatagacttgatcatagcatctcggattctggggtgcttcagttgaaagatgagagtgattccttggttttgcctcaacttcaaagggcagaatctgatgttgataggaggttttatgaattcccggatgatcgatcttctttagaagattcagttgagttgtcggaatatgagtctaattcgtatgagagcctagagggagacaattttggggagtcacagggttcacatccagagatggtcttggtgagtgttgatggtcatatattgactgcccctatctcagaatcagagcagactgaggagaatgtgcagttaaaaactcctcaatttcatctgggaccaggtgaagagactgacttatgtgaaggcaacggagagtttagtactggtgaaagtgcttgggctgctgattatattaatcagttgggtgctcaaacaactaatgtccaatctagacgttgtgacactaacggtgatgataatacttctaagcttttgcttgaagtttgtcaaggagaggaggcacatatttgtctagcacaggataccgtggagattaaaaatcaagaagatcatatgaaaactgattcagaagaggctgcatcaggtatcaagagggagaatgttttcaaaagttgtttggagctacaagattttggtcagcaggctggaaatgctgatttacaaaatataggttcttcattgaagattcaaaattcagtagaggaatctaatgcaagtcatcctgcagttgatgaaaatgaacaggagagcattgcaatatctaaaaacggtgatgagttatcacctcctagtggttctgcttcttctaatggccatagatcaccaaaatcagagttggaaactcaagaggttgagaaaaatgcatcaggagaagttgaaactgcttctggctctcattctgtcactacttatagtgaacagaatgatgaacacgttgacaagacagtaacaaatgatgagttagatgataatcaacaaacccctgcactcaaagatgttagggctacaagtgaggtggtggagcctcaaacagaaacttccaataaaggggatcaaagccatttgggtttgggatttgagatctccctttgtggtcatgaacttaaggtgggcatgggttcagtagctgctgctgaagcgtttgaagcacatcgcatatccgtagttgacttcacaagttctgctccatcaataattaaaaatcaaaatcttgttatcaagtttaaagagaggtacatgacgtgggaaaaggctgctcctcttgttcttggaatggctgtttatagtttagatttacctgttgagtccaaagatacaattcctgtggaacaggatcatgcattgaagtccagggatgatgatctgggatcatcttcgtctggacgcagatggagactttggcctattccttttcgaaaggtcaaaacatttgagcatactaatagcaactcatcaaatgaggaggtatttctagattctgagtctggatctctgatagaaccaactccagcatccagtacccagggatctcctcataagcaatttctaagaacaaatgttcccactaccaagcagatagcatccttaaatctcaaagagggtcaaaatttggtaaccttcagtttctctacaagggttctcggaacacaacaggttgatgctcatatttatttatggaagtggaatgcaagaattgtaatttcagacgttgatggaactattacaaaggcgagccctggtgcagcggtaaagttgtgccttggtgacttgttggtcatgggttcgaatccggaaacagcctctttgcatatgcaaggggcgagccctggtgcagcggtaaagttgtgccttggtgacttgttggtcatgggttcgaatccggaaacagcctctttgcatatgcaaggagcacctcacgagttcaagattgcttgtttagaggatatcaaaagacttttcccatctgactataatccattctatgctggatttggcaatagagatacagatgaacttagttacagaaagattggaatcccgaagggcaaaatatttattatcaaccctaagggtgaggtagctattagtcagcgtatcggcgcaaagtcgtatacatcattacataccctcgtcaatgacatgtttccaccaacttctttggtcgagcaggaggactacaactcatggaattattggaaaacgccattgccagatattgattag

SEQ ID NO: 43070 - DNA, 981 bp, Glycine max
  Peptide Sequence Number=SeqID_134755
atgaagaaaaagagaagcagtaagtttgggagggaagttttacctggaaaagaggtgaagaacatgagagagatgaagaggagaagaggaaccctggaattgggaatggacatggtgagaactggaatgcaagaaaatggtggttgttcgtggaagaaaggttttgagtgtgggagactgaccgggtcgcgctgtgattcgttgacatcccgtctgccgttacaaccatcatcaactccaacgtcatttccgatcgacagcaacgcgccacaacgatcgtccccgcaaacaccaccagcaacgtcgtttccagccgacagcaacgcgccacaacaaccgtccccacaaacaccaccagcaacgtcgtttccagccgacagcaacgcgccgaacctaccgtcaccgtcaagcgaaaaccgaagcctccaaggcgtcgggcgccacaaaggaggccaccacagcggccgccgcaagcgcgtcaacacaagaaaatacttcggatacgtcccgcaaaccaacgacacgtcgttcacaaaccaaaccgcgttggcccaggagttcctccatgcgcacaactggatcaggaaacagtacaaccttcccgagtacacgtgggacgagaaactcgcgagctacgctcgtgggtacctcatgcagcgctacgaggattgcaagctggtgcattcaaactccaactatggcgaaaacgtcttctgggggaagaagttgcactggtccccttccgacgccacctactattggtaccaggagaagcagtggtacaatttccagaccctctcgtgcgcgccaccgcccaaagcgtgcggtcacttcacacaggtcgtgtggagggactcccagagaattgggtgcgcgcttcagcattgccacaaccctagtttgggcatgctcattgcttgcgagtatgaccccgctggtaactatgagaatgaggatcctttgaaacaacatgagcgatag

SEQ ID NO: 43071 - DNA, 1098 bp, Glycine max
  Peptide Sequence Number=SeqID_134756
atggttagatcgtgttggaagccaattgctgatggtgatgaaggagatgggagtgggagagttgatggtcttctatggtacaaggatttggggaaccacctttatggggaattctcaatggctgtggttcaggccaatagttcattagaggatcgaggtgaacttgagtctggacccttgagttctaatcacttgggtcctcaagggacttttataggtgtttatgatggccatggtggaagtgaggcttcgcagtttgtcagtgacaatctcttctgcaatctcaaaaggcttgcatctgaaaatcaaggcgtgtcagaacatgttatcaaaagggcttactcagcaacagaggagagttttctgtctcttgtgaagaaacagtggctaagtaagccacagattgcatccactggtacttgttgtttggtgggggtgatttgcaatggcatgatatatgttgcaaattctggagattcccgggtggtgttaggaagattagagagagcaacaagggaaatagaagctatacagttatctacagaacacaatgttaaccaagaatcggtgagagatgaacttcggtcaaagcacccctttgattcacaaatcgtggttttgagacaaaacgtttggcgtgtgaaaggcctcatacaggtttcacgatccataggggatgcatatctgaagaaagcagaattcaacagggatcctctaccagccaagtatagactagcagaaacattcttcaggccaattcttagttgtgagccatcaacatcatcccacacactccaccctgatgatcaatttctcatatttgcttctgatggcttatgggagcatcttaccaaccaagaggttgttagcatagtcagcaacaatccacctaacggaattgctagaagacttgtgaaagctgcacttagagaagcagctaagaagtgtgaaatgagactttctgacctccaaaagattgagcaagggatgaggagacacatccatgatgacataacagtgattgtggtgtttcttaatccaaaactcactgagaacacctctctctgtggttctcctctttcaatcaagggagattaa

SEQ ID NO: 43072 - DNA, 585 bp, Glycine max
  Peptide Sequence Number=SeqID_134757
atggagaatgtaggtggtaattcacagggttttccaagtaggcgccagaatacatcagtgttaacaaattattttgattatgtgacagtcaaattgacctctcatgggaagaaggtggagaaatttagaaggtctgcacttgagattgaagacagagtagttgttataggattaagttctctgattacatgtccgttgaagacaggttgtacactattttctaataaaagtgccacacatattagtgtggaattcttggacgcatttcatgatcttactcaatctaaaaggttttcatggggagtgactgcactagtccatatgtatgacaatctaaatgttgtgtccaagcatttgactaaacatcttgcaggatatatcactttcttgcagtcttggatctacaagcatttccttacaattgcaaatattattgctgacaaggattactatgagaggaaaccacgtgcttgtcgctggaagtgtgggaagacattaccagtgacgacttatcataggcgttttgatcatcgtgctttcaaagaatttgagctcatttcactattttctggacatatcagatga

SEQ ID NO: 43073 - DNA, 192 bp, Glycine max
  Peptide Sequence Number=SeqID_134758
atggcactatttgagatggtaggtgagtcctatgggtctgccatggtcgcatgcaagcgccaaccaactgcttttgcactatgggcagctgctaaactaacagcagcaaccagatacacagcaagcaggcacaaaccaaaggcccaagaggaagataaccaagccacaatatctctaaatgattttgcataa

SEQ ID NO: 43074 - DNA, 303 bp, Glycine max
  Peptide Sequence Number=SeqID_134759
atgttgggtgtgagggggtgtatcagaaaaaacccaagtccaacattggctagagatggtgccaatttaaagttacagcgatggcagacttggtggatctcccttacatggtgtatttggcaccatagaaataggagtgttttctcaaatgaaagcttcaatagtaacaaattgatggaggatgctctattcttctgctggacctggctaaaaaacttggaaaaaggatttgacatcccattccactactggtccagtcaaatcagggatgggttttgtaatcagggggggattagcatatag

SEQ ID NO: 43075 - DNA, 981 bp, Glycine max
  Peptide Sequence Number=SeqID_134760
atggaagatgcccataatgaagatgttggtcttgataagacggtgggatttgtaggctcgaacaacttcatggagatggaattaggaatcaggaaaaagcgcaactctgcaaatcacatcatcatggtggccgtaacccgcctcgcgaagcgcgcgtcaaccttctcaccccagatgaggaggtgcctgagctcctccgaagtcaaatcccacgcgccgccgcacgacgccgcgtccttccgcccgtttccgcggcgcgaagatctgagcaagcggtgcgtgcagtgggcgttcctcggctgccccggcgtcggaaaaggaacgtacgctagtcgcctgtccaacctcctcggcgtccctcacatcgccaccggcgatctcgttcgcgacgaactcgcctcctctgaccccctttcttcccagctatcagaaattgtaaaacaaggtcaattggtgtcagatgaaattattatacgtttattgtcaaagagacttgttgctggggaagctaaaggcgatctgggatttattcttgatggttttcctcgaacaattaagcaagcagaaatattggaaggggtaactgacattgacttggtaatcaatctgaagctccgagaagatgttctgcttgagaaatgccttggtaggagaatttgcaatcagtgtgggggtaattttaatgttgcttctattaacatcaaggccgagaatgggagccctgaaattattatggctccacttcttcctcctgagaattgtatgtcaaagctcattactcgatcagatgatactgaatcagtggtcaaagaaaggcttcgaatatacaatgaaatgactcagcctgtggaggaattttaccgttcgagaggaaaattattggagtttaacctgcctggaggaatcccggaatcttggcctaagttgctacatgctcttaatcttgatgattacgaggacaaacgatctgctgcagcataa

SEQ ID NO: 43076 - DNA, 1254 bp, Glycine max
  Peptide Sequence Number=SeqID_134761
atgtcatcaggtggtgctgatcctccccgacccttgtcacatgactccagtgaaaaagggacaagtggaaagaaaaaacgatatatggttagactattactacctagagatagtcttacatcatctaccccatccttgtctattgtatctatgcgagtcagatcttccgatgttgcacccgcaccatctccacctccgactgaagttagaccatctccatcacatcttgatgcatgtttcacccatctaaggttgcgacaaaggctatcactttgtccattaggcaacaactttgtcacccttgacctacatggggagcaattccaaaagatcatcaagaacttttttcctagcattttcagagaaaattggtctggagacctgaggaagaaaatgaaattaagaaagtttttaactcgaaatcctttcataaactttctaagatgtttagggatgcctgaaatgaaaataaaaagggcatattggattgaagatcgtgtttggaacgatctgttattacattggaatgcacttgagtattgttccaagtgtgcacatgcaaaaaaaagggcatctgaaaagggtgggtgtaagtacacgagtggttctattagcttgcaagatcacaccattcgcttgttagaggagtttggtcgatctgtctacatagatgaggtctttcagcaaactcatttacgaaatgatactggtcaatttgtcaatgatagatccaggcagaaacatttgtgggaccaaagcataagggatgcctttatgatattggagacattgctcatacttataaatgtgggaatgacaacttcatgcaacatacacaaggatcttctaatcgcgctcaagatgccgcaaagatttaaccgattaagggaggagctttgtcaattaaaggagaagatgcatgccaaagaagaaaatgtgcaaaaagttgttgatgactcgcttagcgagacagattggccaagcgagactcatccccttagtgagacatctagctcgcttagcggatgggaaatcctagaagaggataagtcagagttctgcacgctcagcccgcagccagcccgcccagtgatgatgttgtctcttcttgcgctcagcgcgtccattctcgctttgcggaatttcacttactctcgctcagtgagacatgctcgccgagcgagcctttgtgtgatgagaagcccaagaacctttaaaacactgagattggtggaaaccaaaagacacaactga

SEQ ID NO: 43077 - DNA, 2236 bp, Glycine max
  Peptide Sequence Number=SeqID_134762
tgcaaaaggcacagagcatgctagatcgtcatctgtccaagtagtgtcgcaacctgaaagtccttctccccttcaatcaccatcaaatgcaagttcagtcccagttgaaattcccgtaattttaaggacttctgacatgatgacagatctccctgaaacacagatggaagaggcaaagttgtcacagcctagacctggtcaagcagtcaatgagaatgctggggaatcatcatcctctggaactcagggttatgctgaacaggaactgcaaatgaatacagaaccaaactcaaaactagaaaaacagcatcctgcatcttgtagcaatgaagctggtcaaaagcttgatttttacctcgaaggacaacacctggatcataaattgactctatatcaggcaattcttcaccatataataaaaaaaaatgcagattctttttctagtgcaaaactgtggagtcaagtgcacataataacctatagaagggatgtagaatctgaggatgtaatacctccagaatgtcattcttcaccccagcatttctctgatgaaaaagttttagcttattatcagcatactccttttttctcagacatgttctcttgtgaactagtttctgatttggagatgtccagtccaatttatgatattttgtttcttcttaaaagcttggaaagcatgaacagaattatatttcaccttatgtcgcgtgaaagaatttgtgcttttgcccaagggaaagttgataacctggatagtctaaaaataacagttccttctgtcccacagattgagtttgtaagcagtaagttgacagagaagctagagcaacagatgagggactctttggctgtctccatttgtggtatgccattgtggtgtaatcaattaatggcttcatgtcctttcttatttagttttgaggcaagatgcaaatacttcagattggcagcatttggtcagccacaagtccaaccttctcacaacggctcaggaacagtaagtgacaggcgactgagccctggtggattgcctcgaaagaaatttttagttcatcgcgaccggattttggaatctgctgcacaaatgatggacctgcatgccagtaataaagtggttcttgaggtggaatatgatgaagaagtgggcactggtcttggaccaactttggaattttatacgttggtgtgccaggagttccagaaatctggcttggccatgtggagagaagatgattcttcctttaccctcaagacaaacttgcaggctgaggaaataggagttcattccttttatggactctttcctcgtccatggtcatcaatgcaagatacatctggtggcatacagttctctgaagtaacaaagaattttttccttctaggccaagttgttgctaaagcacttcaagatggaaggatcttagatcttcacttctcaaaagctttctataaacttattcttggaaaggaactttctctctacgacatacaatcctttgatcctgggcttggtaaggtgctacaagagtttcaagcattagttatgaggaagaaatttatggaatctgtcagtggagggaattccgagttgcaatatggactaagctttcgagatatgagcattgaagatctttgtcttgattttactcttcctgggtttcctgatattgttcttgcttcagggaccgatcataccatggtaaatatgagaaacttggaggattatgtttctcttattgtcgatgcaactgtgaggtctggagtttcaagacaagtggaagcttttaaatctggctttaaccaggttttctccattgatcatcttcggattttcaatgaagaagaacttgagcgaatgctttgtggagagtatgactcttgggctgtcaacgagtttggagatcacattaagtttgatcatgggtatactgctagcagtcctcccattgttaatttgttggagattgtccgagagtttgataatggacagcgacgagcatttctgcagtttgtgacgggcgcgcctcgccttcctccgggaggattggcatctctcaatccgaagttaactattgtccgaaagcattgtagcaaccgggcagacacagacctacctagcgtgatgacttgtgcaaattatctcaagctgcctccgtactcatcaaaagaaaggatgaaagagaagctcttgtatgccataacagagggtcaaggatctttccacctttcataa

SEQ ID NO: 43078 - DNA, 2130 bp, Glycine max
  Peptide Sequence Number=SeqID_134763
atgggtggtagtggagttagtttacttggagtttctttgaagggattatgtgcggtttgtttgttaggttttttgttgaatgctgatcccagaaagtgtgggtcaggggctttgaaggagaggttctttagcttacccttcctatcaacccagatattattaaagtatgcagacaccaaaagcaagttgtttggtgaaacaccaaatgaatcaatattgagatgttttttcatctgcatgcttattggcctatgcttgtctgtgagcagaactggtacttcagaagtgccccaaaggaagtctcctgcatctcctcagaatgctcgcaaattgaagacaccaggctctgataccgactcagtctcatcatctccaaaaccaggaagtaagacgccaaaaaatagaagtcctaaggtcacagaacgcaagtcaccaagaagtccaatatctgagaagaagcgaccaggtagggttcaagaattggagtctcaacttgctcaacttgaagaagatctaaagagaactaaagaccaactcaactcatctgagtcatggaagaggaaagctcagcaggaggctgaagaagcaaataagcagcttttagcggtatcgaaagagctggaggaatcccagcaacagcttctggaactatctgcttctgaagaggaacggcttcaagaactccgtaagatttctcaggaccgagatcgagcatggcagtctgagcttgaggctgtccagaagcagcactcaatggattcaactgctctagtgtctgccatgaatgaaatacagaaactgaaaattcaacttgaaagagtgcgcgaatgtgaagctgttcacattagcaatgctgagtcagataatgctgagattgaggatttgaggatggagcttgatgaagcactcactttagtggaaaagctgaaaagtgaggtaattgattgcaaagaatctgaatcccgggctttggaagtagttggcaaaactcaaatgcaattggaagcagcaaacaagactgtggaaacactccagttagaaggtgagaaagcatcagaagcttacaaatccttagctttagagttggagcaatcaagagctcaagtaaaatcattggaggaacttgtcagcaaacttcaggctgatttggttggtggtggtaacaaaaatatgttaggtcccgtcaatgaagcagaacttgaacttgcaccgaaaaacgtacaaaatgaggagataaaccatctcaaagccgagcttgtttctgccaaatctgaagcagtgcagttaaaatctgcactggacgtttctgaggtacgataccaagaagagtatattcggagcacattgcagatcagaagtgcttttgaacaactggagcatgcaaaatcagaatcttctcaaagacaaggtgaattaaatgaggaattgaagagagctagagctgatattgaagagttaagggagaagatgatggacaaggaatctcagttgcagggtttatcagatgagaatgagatgctcgtgtcaaggatcaagcaaaaccagcctagtgaaagagattctgaacctgtggtggcgctcaaaaaattggatgctgacataactgagttgaagaaaagattattggacagagagacggaactgcaaaatgtgactgaggaaaacaatgcactaaagaaggaaataaagagggtggagttagagaagaataaaatccccgatgaggctgttgcttctgctgaagcagcaagggccgcagagcgcgaggctttgatgaaacttggctacataactgaagaagccgataaaagtaaccaaagagtagcacagataactgaacagctagacactgcgcaggctgcaaattccgagttagaggctgaattaaggaggttgaaagtgcagtcggaccagtggagaaaagcggccgaagcagctgctgctatgatttcttctggaaacaatggaaagtttgtggaacgaacaggttcacttgacagtagctacaattctgttactgccaagatgagttcaccttattcagaagacacagatgatgatgactctcccaaaaagaaaaatacaaacatgttgaagaagattggagtgttgtggaagaagactcattaa

SEQ ID NO: 43079 - DNA, 414 bp, Glycine max
  Peptide Sequence Number=SeqID_134764
atgttccattcaaagcctctcagtgcttgtgctgctcttgtcctttttcctcgcttaagatcacccaagagagaacctaagacacacaacacagactcacacaaagagttacaagagaaatcatcatggcatcagcagcatctggatgagcctgcagcggcggcacccgccaccgccacacccccagctgaagctgaagctaaaccaaagccaccacctattggccccaagagaggtgctaaggtgaagattcttaggaaggaatcttactggtacaaaggcaccggttcagtggttgctgttgatcaggaccccaacactcgctaccctgttgtggttcgattcaacaaagtcaactatgccaatgtatcaacaaacaactatgctttggatgagatcgtggaagtcgaatga

SEQ ID NO: 43080 - DNA, 237 bp, Glycine max
  Peptide Sequence Number=SeqID_134765
atgtcagcggattcaccaccacataacggcgccgggaagttgggaaatgcgaatgcaaatgcaaatgcaaatgcgggatttaaaaggagtgagagggggcgtcagtggtgtgggcttcaaccccatatgacgtcatttgtcgcctcttctatcgcttccttaatgttgttgtcttcattaactactatctcaccctcaaacacccctctcaatacaacaacaattacaacgtcttag

SEQ ID NO: 43081 - DNA, 546 bp, Glycine max
  Peptide Sequence Number=SeqID_134766
atgttagtactctatactcgtggtggtgcttcttcttctggaagcttctctgttgcacagttcatatttcgtgtccactttttgatgcctataggtaaagcatccaatgaccatcttagtgatacttcttacatgctagaggaatcattggtcaatgggctattaatattgcaagtatgggaagtagagcctggtataaaatatgctgctccttttactttattaaggttgaaacaagaaaacaggacaaaattctaccccagcactgtgcctagcatatttcatgtctgtgatttacatattgcattatctctactactggcattaattttgcgagccacagtttcttctaggagagcagattttgattatgaggatggatatgatgttaggggtagaagttgggagcccctactgaatcctcaacctggccaaccatctgggtctagcaaaggtgataatagtggaaatcactcagatttttggagtgtgcggatgagagagaagattaccgatgagcatgctggttacattagtgtcctttaa

SEQ ID NO: 43082 - DNA, 303 bp, Glycine max
  Peptide Sequence Number=SeqID_134767
atgagtcaagaacaagctcaccaccatagaaagccagatgatgacaaaggtgatgacaaaaagctcaaaggtcaatcaaagaatgagttcaagatgttcaagatagaatcaagaacacttcaagactcaagaggaaagttgaagaacacttcaagattcaagaggaaagttgatttcaagattcaagaattaagagaagacttaatcaagataagtatgaaaaggttttttcaaaaattgagtagcacatggatttttctcaaaaacatgtttaccaaagagtttttactctctagtaattga

SEQ ID NO: 43083 - DNA, 484 bp, Glycine max
  Peptide Sequence Number=SeqID_134768
atgccaccgaggaagctctccgcaaagagatctaggaggaacgcagcagtcgaaggaaccagcaccgcttctaagtttgacagccatcgtttcaggagcgccgagcaccagcagcgtgtcgaggccatcaaaggatggtcgttccaccgagagagacacgtccaactcagggacgatgagtacatagattttcaggaagagatagctcaccggtgttggacgttgctggtcactcccatggctaagtttgacccagatatagtcctagagttttacgctaatgcttggcccacggaggagggcgtgcgggacatgcggtcatgggtaaggggccagtggattccttttgatgcagacgccctcagccagttcctgggtgacccgctagtgttagaggagggccaggagtgcgagtttagtcagagaaggaatcgggccgatggatttgatgaggaggccattgcccagctgttatgcataccgg

SEQ ID NO: 43084 - DNA, 378 bp, Glycine max
  Peptide Sequence Number=SeqID_134769
atggtgaaagttggaacctcttacgtgccgatcaacgtctcattttcgccaaaagttggcccagggcttcccgcactacgagccggaagcatcagcgcggcaagtgtaaagcctggggtgcctaatgacgctgacgctaacactcacacccgccggcttaattgcttgccgctacagggctgcccgctttcgccatgtcagggaaacctgtcgtgcaactgcattaagaacggcaacgcgcggggatcgagtgcggctcttcgctattacgccagcggcgctaaagggcggatgtgctgcaactggcgattactatgttgggtaactgtgccagggtgtttcccagtcacgaaggcgttctgtgagaaaaaaagctga

SEQ ID NO: 43085 - DNA, 432 bp, Glycine max
  Peptide Sequence Number=SeqID_134770
atggcggtgcaactaatccatgaccgagtggagatggagtgcctagaaggagcttgggagaccctcaaaggaaatgtgaggtgccgatttcggggcacgattcgattcacggctacttcattggtgcatccaggggaacccgcacgtacgcttcagcgcactgtggagtggatattacccacgcctacaccatatcgtctagcggagttagtccaagtgatcgaggtgacgccatctaaggaagaccctgaggaatacccagaggagctaccccctgagcctgctgtggatgctcttgactttctagagggtgatgaggacccaccccttgaggtggattctcccgaggacgtcatgtcggcatctgaggcagactttacggaggagagcggccctggagagatggcgactagtggaggctcttcatcatag

SEQ ID NO: 43086 - DNA, 496 bp, Glycine max
  Peptide Sequence Number=SeqID_134771
atgggtgaagtagaggaggtacaagagaagatgaaggccgacatggaggccatgaaagagcaaatggccacgatgatggaggccatgatgatcatgaagaagataatggaagccagtgcagttgcagttgccgctaccagcactgttgctaaggtgaacccgatgcccccatctagcctcaaccaaatgaatcatccaacctcagctatggtaggcaaagatttgggaagtacgggcggcccccatgatgtgcaaattcaaaacgagcacgccttcccgccatatggcttgcctctcaactatacgccacccaatgtggcgtacactcccaataagaatgtcaataactccactcctatactcgttgagagccgaaaaacccaaactaatcatgcacatgtctctcaaactgtggaggagacacatgaaattccccaccacaatccagccgactccgagccttgccttggatatgccactgaagggcaagcagttg

SEQ ID NO: 43087 - DNA, 300 bp, Glycine max
  Peptide Sequence Number=SeqID_134772
atgccgatctccccttgcggaagtatcagttggtctgtgccatcccgacatagggatcgcgctcgcaagacatccagtggacccggaggagcccaacagggccctagggtttccgactctgggatcgcgctcgcaagacacccagtgggcccgaagaagtccaataaggtcttggagttgccagctctgattacgggcctctgtcagttctacggagtgtttgtcgcccccaacaaggtcatcatgccccctactaatcgagctttcatcaagaagtactgtgccctcaggcaggcgtag

SEQ ID NO: 43088 - DNA, 495 bp, Glycine max
  Peptide Sequence Number=SeqID_134773
atggtgaaagttggaacctcttacgtgccgatcaacgtctcattttcgccaaaagttggcccagggcttcccggtatcaacagggacaccaggatttatttattctgcgaaggaggaagaaaggaaaacatgcactctcatttccgatacacacgatcaagcttattcgcaatacgtcgacctcggggtgtgccgtggcttctgtttctatcagctgtccctcctgttcagatgacggggattgttatccgcgtcacaattcggcacacaagcatacgagccggaagcatacgaagtgtaaagcctggggtgccaggtgtttccagtcagaagtgctgtgcaggagaaaaaagcgacggccagtcagaatatgtgatacgactcatatatccgcttcctcgcatcactgactcgctacgctcggtcgtcatgcggcgacgctcagaaagtggcttaccccaacggggcaggaattcagatgcccgaaattcttaa

SEQ ID NO: 43089 - DNA, 479 bp, Glycine max
  Peptide Sequence Number=SeqID_134774
ggcctctctaaccggtgaaaagtggtgggtgtccactaacggccattcctggctcggctccgataacgcaattccggaaggagtcggtagttgggcactggatcccttcggacctggagaacgtgtgacgctgggtcggggtttggtgaaccaactggtcgctcctctagttgaagcctcccagttcaaatacgtcataaggcgtggaattagaccaaggggaatctccataggaactagtccctcagatttcgcacgtaggagatcgagacacagccccagggctatgaggaaagatgaaagcccggccagaaccacacgtgcaagtttccctgcatgtggctcgtccgtgataacttattcggatttgcgcgaactagcggaccgatcactaagtggggatgctccctccagcatgagcgaaccttttcgaaactggttaggaatgggcgtcactatcccagccctgatccagccag

SEQ ID NO: 43090 - DNA, 492 bp, Glycine max
  Peptide Sequence Number=SeqID_134775
atgccgcgtaccgccgtcgcgatctcggacaccgcgccgaccagcagggcgaccacgagcacgaccagcagccagtcgagccagaagaggccgaccagggccgtcgccagcagcccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43091 - DNA, 287 bp, Glycine max
  Peptide Sequence Number=SeqID_134776
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagcattgatgtgcattactggcagtgaatctcctgttgttgttgttctttctggaagcatggaacccggattcaagcggggagacatcttattcttgcacatgagtaaagacccaattcgggcaggggagattgttgtgtttaatgtcgat

SEQ ID NO: 43092 - DNA, 201 bp, Glycine max
  Peptide Sequence Number=SeqID_134777
gctgttgcttctggaggaagcaaccctgctcgcctgggagagctgggcggcaagcatctcccttattttgctataaataggggaggaaccgaggcgcttccgaaacgtttccgtaacgttttccgtgaagaatttcgcaaaggtttcgaccgttcttcgacgtacttcattcgttcttcatcgttcttcgatcttcaacgg

SEQ ID NO: 43093 - DNA, 219 bp, Glycine max
  Peptide Sequence Number=SeqID_134778
atgaaaattctaagttcgggagttgtatttacgcttgaggaaggtgatcattttaaggcgttggaccttaaaaatgatccattttacttggggagaagcttgccacccatctcgcccaggcgagcaaggttgcttcctccagaagcaacagccttctggaggaatcttctggagggcccaagtgggcctggttgctatttgcaacctcctttttactaa

SEQ ID NO: 43094 - DNA, 777 bp, Glycine max
  Peptide Sequence Number=SeqID_134779
atgcgatcatgggtgaggggtcagtggattccctttgatgcagatgccctcagccagttcctgagagacccgctagtgttagaggaaggccaggagtgcgagtttagtcagagaaggaatagggccgatgggtttgacgatgaggccattgcccagttgttatgtataccaggtcaagattttgcccggaccgttgcagggaggcgggtgcagatcatgcgcaccaacatgactaccctaacccagatatggatgacgttgttgctcagcaatgtcctgcccaatgatcataattctgaccttcctctgtcgaagtgtcagctggtgtatgccattctgacatggatgagcgtccatgtggctcagttgattgctgacgccatctatttatttgcagagccctgggatttccagggtgatgcaccacaggccacggacgcaccatcaccacctcatcaggctgatcctgctgggtcattaggcatggagcggtatctacagcacttggtccgccagcaggcggccaaccatcgggtgcaggtgcagatacatgagtgtctctaccagctcagcctcagtcagcaaggccagggtttcgctccttttgcgtgccccactctagctcagtttagggctgaggtcgcatggcctggagattggcccaaggcccagacggaggaggtacctgcaggagctcccgacgatgtagaggaggcccgcatggatgaggagatgaccgacttgctcggcttcttgggaggaagcggagccatgtga

SEQ ID NO: 43095 - DNA, 306 bp, Glycine max
  Peptide Sequence Number=SeqID_134780
atggaaaagagtatgattgatgcttccagtggtggagcttttggtgatatgactcctgttgaggctaggaatttgattgagaagatggcttccaactcccaacaatttagtgtaagaaatgatgctattgtccttagaggagtccatgatgtggccacgaattcatcttcatctgctgaaaataagaagcttaagggaaaacttgatgccttggtcaacctagtaactgaggcttgccataaatcagaaatctgcatctgcacctgttactgttgcaagaacctgtggcctatgttcttctactga

SEQ ID NO: 43096 - DNA, 555 bp, Glycine max
  Peptide Sequence Number=SeqID_134781
atgattggcgtcgacggcgccacgcttgaggcgcatggcgcagtgagcgagccggttgtgcgtcagatggcgctgggggcgttgaatgccgccgccgcaacctgggcggtctctgtcagcggcattgcagggccggatggcggcagcgcgcaaaagcctgtcggcaccgtctggttcggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43097 - DNA, 498 bp, Glycine max
  Peptide Sequence Number=SeqID_134782
atgttgattccctcaacactattttggagactcaaatggtcttggagaaagaggagagcatacccgcctaatccagggacccgcaaatccagggctagaggatctgaggccccatcttcttcagctgcccctgctccccctacttctgctcttccttctacaccagctcctactcctctagcaccaattcatctaggtacttcagctcagagctcagaacttattatatctatgctgcagagcctgcatgaaggcaagcttctggttatgcagagtttgcaagatgtggtccagcagaggcctgttatgagtgtggaagaattttcacagagggtggcctggccaggagtccaaccttctcgtttgggagggggtgaggcctctacagcccaggaacctcagccagaccaggaggatgactcttctgaagccactctcactccacctgagccacttatttttgaggatgatctagtggctgatccagtgaccgcataa

SEQ ID NO: 43098 - DNA, 411 bp, Glycine max
  Peptide Sequence Number=SeqID_134783
atgaccatgattacgccaagctcgaaattaaccctcactaaagggaacaaaagctggtaccgggccccccctcgaggtcgacgagttgatataaggttcggacaagaccgatgtagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtg

SEQ ID NO: 43099 - DNA, 131 bp, Glycine max
  Peptide Sequence Number=SeqID_134784
atggaggatgaagagaacgaagatgtaggacttcccctggagttggaaaagatagtcgcccatgaggaccaagaaatggggcctcatcaagaagagacgaatcgaattcctgcagcccgggggatccacta

SEQ ID NO: 43100 - DNA, 675 bp, Glycine max
  Peptide Sequence Number=SeqID_134785
atgcccaccggcgattcggggttgatgtccaggcagcgcacttccacgtactgcacgccgcgttcggcgagcgcggtgatggggcgttcgcagcggcccggtggcgcgcttggggcggatgctggagtagtactcgttttcgatctgcagcacgttggtgttgagctggatccattcgccgttgcgatgcgtgccgagtttctggtagtcgggccagggctgggtgaccgcgtcgtacaggcggccgaggaaggtgtcgagatcgttgtagcagagcttgagctgcgactgcgccttgttctggtagcccaggtcgctcatgcgcaggctggtggcgtagggcaggtacagggtatggtcgcccaggcgctgcaggccgtgctcgccatcgcgcaggaaatcacgcgccagcgccggcgcggcgccgaacaggtacatcagcagccaggaatagcgcgtgaagttgcggatcaggccgatgtagccgcgcgaacgccggtcctggtcggtgccgggctgggtgtcgagcaccgaccacagcgcttcgggcagcgagaagttgtagtggacgccggcgatgcactgcatggtcttgccgtagcgctcggccaggccgcgacggtagacgtgcttgagcatgccggtattggacgtgccgtaccaggcgatgggaat

SEQ ID NO: 43101 - DNA, 195 bp, Glycine max
  Peptide Sequence Number=SeqID_134786
atggatgaagttctggaagcactcaagaaatttcaaaatgggaattatgagtctgagaatctagagaaaggagatgatgatggtgttatctcttccacttcatccagcgaaaaagaaaaattgtttaacagaaatcgaaatgctggaagtaacttgacaaggaaaggaaaattgcagaatgtagaagagcagtga

SEQ ID NO: 43102 - DNA, 276 bp, Glycine max
  Peptide Sequence Number=SeqID_134787
atggtgaaagttggaacctcttacgtgccgatcaacgtctcattttcgccaaaagttggcccagggcttcccggtatcaacagggacaccaggatttatttattctgcgaaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 43103 - DNA, 303 bp, Glycine max
  Peptide Sequence Number=SeqID_134788
atgaggcttgacgaaaaagagcaatcccgacatcaccgcgagggtccaggtaagccatttatcgaattcctgcagcccgggggatccactagttctagagcggccgccaccgcgggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 43104 - DNA, 288 bp, Glycine max
  Peptide Sequence Number=SeqID_134789
atgactaaagcacgtcaaaagaggggaaaagaaggacaagcttgccacccagctcgcccaggcgagccaggtttcctagaaggcccaaaacatcacggattgcctaacgatgggtgccaaagacctcgaagcggtcaagcaaaagttgcatgctgtcgcaacctacccttttgcgggcgagcgaggcaaggttcacgggtgcgtcttccaaaggaggacaatgcgcagagtcgccaccaacgtttatttgtggaaaacgtcggaaaaaccgaaggaaaccggtcatga

SEQ ID NO: 43105 - DNA, 378 bp, Glycine max
  Peptide Sequence Number=SeqID_134790
atgaaacaaaaaggaaaaagaaagaaagttcgcgaaggtcgacatgttatagttaagaagtataaatcattcgtaaagagcaaacatatcttctggaaacaagggattgatgctaagagtttattttccggaataaccgagataagaatggatgaattcattgaactgataaaagaacataattgggaagcgttgggatgcttgagtgcccacctggctgtagccatgactaattttgcacgttgttttcaaatcatcattgtcacgcgtgccttatggagtgataggggagttcggcccgagaccaacaccttgacacccaaatttgtttcgccccagatatcaagattgggttcccacgataaaagaccccattga

SEQ ID NO: 43106 - DNA, 152 bp, Glycine max
  Peptide Sequence Number=SeqID_134791
atcagttcagggcagagtcgcatggcccagagattggcctgaggcccagacagggaggcgccgcaaaggctcccggcgatggagaggaggcccgcatggatgaggagatgacggatttgctcgatttcttaggaggcagcggagccacgtga

SEQ ID NO: 43107 - DNA, 712 bp, Glycine max
  Peptide Sequence Number=SeqID_134792
gcggtgatcgttggcggtcgaaatatcggcgacgcctatttcgatgcggccgaacgggcgaatttccacgatttcgatattctcggcttcggtgacgtcgtggccgacgcaacggaaatcttcgatgattactggaacagcgccgtttccgtccccgttcgctcgcttctggcgcgcaggccgagcaaactcgcaagattacggcgcgagctggacgccctgccaaaaagcgaagccgcaaaaccttatctggagcgcgttgaaagccagtatgaccgagatcatttcctgatgtcggaccgcatgcactgggtggattccgtggatgtgcttgccgatcctccggaaaaagcggcaggcaagcggcggaagggccacaacttcctgatggaaagcctgctgcccctgctgcaggcggcaagcgacagcctgcacgtcacatccccttacttcattcccggcaaacagggcgttgagattttccttgatattgccgaacggggcgtatcgctggccatcctcaccaattcgctggcggcaacggatgtggccgccgttcacgccggatatgcccgctatcgcaagccgcttctctcgggcggcgtacgcctgcacgagctgcgttcgcaggtggaccagccgaacttcaccctgcgcggttccggacaggcgagcctgcacaccaaggcattcacgcgtgacggcatgacag

SEQ ID NO: 43108 - DNA, 759 bp, Glycine max
  Peptide Sequence Number=SeqID_134793
atgaggggagcgccaaccgaagaaagtctctcgcctttccttgtgagggatctaggcgctcaaagtctcaaggagaacttcgaagctccggaggaagatgaagaagtccaagctctaaaattagagctagggaaggcgagactcgccaaggagaagttcaaatcagctgctacacacatccgaaaagaatgcaccgagttacaagaggaaaacgcggccactgcaagagcccttgaacaagaaactaaaagggcccgcaaggaggaatatggccgagagaaattccgaggagcactgtggggtagcaacaatgagctcaagctccgaagaaaggaaagagaccggtcacgggtgcatggcatgatcttaaaagaagagttagctgcgtgcgcaagatccaagaggagtttggctcaaaacttggaagccactgagcaaagcatgatagctatcatagggcaatacaaggaagagttgaaccagtctgtggcctatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccacgtctattagccaaagcaaaagccatggccgaagtgtgtacggcccccgaggagattcatgggctaatcaattactgtcaacacatgatagatttgatggcccacataattagaaaccgttag

SEQ ID NO: 43109 - DNA, 243 bp, Glycine max
  Peptide Sequence Number=SeqID_134794
atgcaagaacaaatagaggaagcaaaagaacatcgcctagatgaaaatgctctgataccacatgatgaagctccatgtggagcttgtaggccttggatcatcttcatcaatgaagtcctttgcttcttaaagatcaatggcagcggaatggagaagaagaaatatgattggagatgccacttcaaggagaagatgagtcaagaacaagctcaccaccataagaagccatggataagagtttga

SEQ ID NO: 43110 - DNA, 1175 bp, Glycine max
  Peptide Sequence Number=SeqID_134795
atgggaacaaatcaaaccggcaagaggttctaccaagtcaaggtcaaaagcctagataccaccagcatcaaggaattagggcggttgatggaacccctccaaatgcaagccttccgtaagacttacggaaagatcttagagttaaccatagcagaggtgtccatagaagccattgtatcacttacccaatactacgaccagcctttgaggtgcttcacattcggggacttccaattagtaccaaccattgaagaatttgaggaaattctaggatgtcctctcgggggaagaaaaccatatctttcctccgggtgtctcccctctttgagcagaattgcaaccgtggtcaaggattcagcaagaggtttggaccgcataaaacagactcggaacggcatagcgggcctaccacagaggtacctagaagacaaggcgagggttatggccaatcaaggagattgggtcccgtttatggatgtgttagctttgctaatttttggggtcgtcctctttccaaacgtggatggtctggtggacctagcagcaatcgacgctttccttgcctaccaccatagcaaggaaagtctggtggtagctgtcttggcagatctatttgacacatttgacccgaagaggagaatagattgggaccagcttttggccgggataggaggtggaacaatcaattggttcccccgatggaaggaaggaaaagaaggagtccttttctcatgtggaggatacccaaacattccgctgataggaacgaggggttgtattaactacaatcccgcgctcgctataagacaactagggtaccccatgaggggagcaccgacggaagaaggcatgtctcctttccttgtgagggattttggcgcacaaaattccaaggctatacaaagaatccataaggcatgggaaaccccgttaaggaaagatcaagaacttaggggcattcgtaatggcatcattggtgggtaccatgaatggttaaaagttcatgtacgaggtttagattggctcaccaagttaaaagtcgtcagcgaagaaagttttgaagcaccggaagaggacgaagaagtccaagctctcaaaagcgagttaggaaaggcgaaacttgccaaggagaagttcaagttggacgctacacacattcggaaggagtgtgccgg

SEQ ID NO: 43111 - DNA, 444 bp, Glycine max
  Peptide Sequence Number=SeqID_134796
atgaccggaaggcttcttgccggttcattggctttcgaaagccgcatcctccattaccttatcgttcgcatcttactccctagatctttaaaccttgctcaggtttctgaagaagatctcattgtcatgtgggcctttcataaaggcacttcagtcatagcatcctttggttatataaaggagcatgatggctcttgggttaagaagggtgctagaaattttggtgaagaaggaaatgaagaagaagattcatctcttctttcaaagattatggaaaggtttgatggtcttcaaacctttattggtgaaaggtttgatactttggaattgcaagtggatatgcgcttcaatgaaatggagtcaagaatgacaaaggttgaagaagatgtatcttacatttgttcaagcttcgatcttccaccaccgctgccaccatcatcttag

SEQ ID NO: 43112 - DNA, 593 bp, Glycine max
  Peptide Sequence Number=SeqID_134797
ccgatcaggacggtgtcaaggacactgtttgtgacaaatacggcatcaggaaggaaaagtgggcccagttttgccagactcacagagacccttcttgggagaagctcctggctgagaagacaaagaagaagctgcaggaagctgcacagtcaggaagcgttgatggcgtcatcgaccctccatccccggtcagacgccacgtgaagtggaagatggcccgcacgaagaagataggggagatgacgaataaggccacaaaggaaatcgctgagaagattaatgccatgtaccactgtgtgttttctgtgcatgattcgtttgaggagcaggccacacaaggatcattcgtcccccatggacgtcaagatgttctggccgctgctattggacatccagagcaccctggacgtgtccatgctgctggagccggtgtcaccatcaagcaatactttggatcggctccatggacgtcccacagcgcttcctccctacctcctgacgaattacagcagctaacccagcagatcagggaccagctagaggagtccatcacagagaaagtgacgaggcaggtcatggcatccttcagctag

SEQ ID NO: 43113 - DNA, 740 bp, Glycine max
  Peptide Sequence Number=SeqID_134798
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtgattctcagcccattacagcagtcgagcttcagccaatcagaggctgccagtaaatcagacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43114 - DNA, 567 bp, Glycine max
  Peptide Sequence Number=SeqID_134799
atggagaaaaaaatcactggatataccaccgttgatatatcccaatggcatcgtaaagaacattttgaggcatttcagtcagttgctcaatgtacctataaccagaccgatcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacgatgaaaacctggcctatttccctaaagggtttattgagaatatgtttttcgtctcagtcaatccctggttcatcatgccgattgtgatggcttccatgtcggcagaatgcttaatgaattacaacagtactgcgatgagtggcagggcggggcgtaatttttttaaggcagatattggtgcctag

SEQ ID NO: 43115 - DNA, 207 bp, Glycine max
  Peptide Sequence Number=SeqID_134800
atgagggtgagtggttttaagaggctgaaaacagagaagctgaaaaactgcagaaatcagagagttcaaaagggaggtagtgagctaggtttaagagtagcagacttttacaaagaaccaacaagtggcaccgtctatggggaaatcaagatcaagaaagatgggaacaacaaagtacgatatatagaagttttaaggggaaaatga

SEQ ID NO: 43116 - DNA, 462 bp, Glycine max
  Peptide Sequence Number=SeqID_134801
atgaccagaaggctgcttgccggttcattggcttttgaaagccgcatccttcactatctcattgtgcgtattttacttccaagatcttcaaaccttgcacaggcattgcgattaaatgctcatttgccatatccacacctagtcactcttttccttcaacactttaacatccctcttgattttgaaccttatgttccaatcaagagatcattcttgatctgtgctactgtgattgcatcttttggttaccgcaaagagcatgatggctcttgggtaaaaaagggtgctcaacccattgatgatgaaggacacttaccaattggagaggattcctctctccttcagagaattttggacaggtttgatggtcttcaaacctatgttggtgaaaggtttgatgctttggaactgcaagtggatatgcgatttgacaagatggactcagcgatcaccaaaggttga

SEQ ID NO: 43117 - DNA, 246 bp, Glycine max
  Peptide Sequence Number=SeqID_134802
atgtccaacgcctcagctcttctcaccaagttgttgtcctttgggacaaacgtgagaggtgctaataccttcctcaagcgtaaatacaactcgcgaatctggaatattcttcatgaccggtttcctttggtttttctaacgttttcctcctttggaagacgcacccgtgagcctcacctcgctcgcccgcaaaagggtaggttgcgacagttggcgactccactggggactgtttttgtgagttag

SEQ ID NO: 43118 - DNA, 1031 bp, Glycine max
  Peptide Sequence Number=SeqID_134803
ggtcggcggtgctgggttatggccccgtgctaagtttcggattggttggccccctcctcccccccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacgtaggtaaaactaacctgtctcacgacggtctaaacccagctcacgttccctattggtgggtgaacaatgcaacgcttggtgaattctacttcacaatgataggaagagccgacatcgaaggatcaaaaagcaacgtcgctatgaacgcttggctgccacaagccagttatccctgtggtaacttatctgacacctctagcttcaaattccgaaggactaaaggatcgatagggcacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgcccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 43119 - DNA, 305 bp, Glycine max
  Peptide Sequence Number=SeqID_134804
atgggaacaaatcaaaccggcaagaggttctaccaagtcaaggtcaaaagcccagataccaccagcatcaaggaattagggcggttgatggaacccctccaaatgcaagccttccgcaagacttacggaaaaatcttagaattgaccatagcagaggaaaccatatctttcctccgggtgtctcccctctttgagcagaattgcaactgtggtcaaggattcagccagaggtttggaccgcataaaacagactcggaacggcatagcgggcctaccacagaagtacctagaagacaaggcgaggg

SEQ ID NO: 43120 - DNA, 432 bp, Glycine max
  Peptide Sequence Number=SeqID_134805
atgcctggccaagtaaaggtgggtgtggaggaggttaaagatccagatgctcccgttcctgtacccactgatgaggcagctgtgtctccggcaaaaccacctcaaaagtcgtatccgaagatcgatgatccgctttatctgatgacattgaccatcctagagcttttcttgaggccttaccagataaagcacgaagacctctctgaaatcgcacacggtggtcaatgtctcaacatattagtgttacagttgtggattatgcatttgactaaaacaagtatgcgagcggggaattatgatctgtatggattccttgagccacaatccattcagaggtctaggcaatcgcagtttaaggctgaaagttacataaagagttggatgcagagttcaaaacgcgatgtctaccttggagcctacctgaatgggtaa

SEQ ID NO: 43121 - DNA, 138 bp, Glycine max
  Peptide Sequence Number=SeqID_134806
atgccctctatcaactgcgagggctggccgacacccaccggcacgctctgctcatccttgccgcatatgccgacgcccttcgtccagggtcaaatcgttgccgatcatgctgcatctttctgcattgttccggggccg

SEQ ID NO: 43122 - DNA, 368 bp, Glycine max
  Peptide Sequence Number=SeqID_134807
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaagagttggagctcagagaaccttcgaaaaaccgccctgcaagcg

SEQ ID NO: 43123 - DNA, 129 bp, Glycine max
  Peptide Sequence Number=SeqID_134808
accaaatgtcaagaagagccaacggttaacgaaggttgggcagcgtttttaccgaggcagcttcatgtagctttctctagaagcttcattaagaaggttcctccagaagcttcctcgtggcttctttga

SEQ ID NO: 43124 - DNA, 650 bp, Glycine max
  Peptide Sequence Number=SeqID_134809
aagctgctctatccgaaagcactgacaccgtgaattatcctccatctctcatcagacgacacatgaaatggaagatggtccacaccaagaaaactgggcaaatgacgtctgaggcagcaaaggaaattattaacaagattgactcacagggttcctttatcgcccatggacatcaggatgtactgattgctgccattaggcgaccagaacaccctggtcgtgtgcgtgctgttggagccggtgtcacgatcaagcaatactttggaccggctccaaggacctcccacacgtcttcctccatggctcctaaagacctggaggagttgacacaacaaattagggaccagctggaggagtcgatcacaaaaaaaggactcgcactgcctcctgaacctgaagttggtctttcaactatttgtgtcagcacaaagaagagttgtgttgatccctcggggaatgatccagacacgagtgacttagacaaatgcgggttgtacatcgaagaaaatcctccgcgcctggttgccctaggaagagtttatgtgggatccacaaacattcacaacattcctttgttgcatgatcaagtcaaggttggtgttgaggaggttagagatgcatatgctcccattcctgtatctactaaagag

SEQ ID NO: 43125 - DNA, 279 bp, Glycine max
  Peptide Sequence Number=SeqID_134810
gggcagaatcatcttaggcaacggtcagaggtcgagacaaggtcaaaggcagaaaccaatcaaggtactttgggacggacgcaatgagaggctagggtcacgaccaataggtcgtcatcctttgcttagcccgggacaaatggaaagtgtcactacgaagcagcctagggttgtaagggatggccttaggcctagggtgcgttctgaagcaatggggcatgccacattgcccccactctcttgctattcatgcctaaacatgcgcccaccaagtgctcg

SEQ ID NO: 43126 - DNA, 165 bp, Glycine max
  Peptide Sequence Number=SeqID_134811
atgcatgccaaaaaggtgtcgcaacctacccttaggcaggagagcgacgcgagactcacgggtgcatcttccaaggaaggaaaacgcaaggagtcgctaccaacgtttattcgaggaaaacgtcggaaaaaatggaaaaagacgtggtctacgaatttcaagtga

SEQ ID NO: 43127 - DNA, 123 bp, Glycine max
  Peptide Sequence Number=SeqID_134812
atggaagacgcacccgtgagcctcgcctcgctcgcccgcaaaagggggccctatacccaggttcatggaaatctaaggagtagaggtgaatctatggtcatgctaggtctccgacttgcttga

SEQ ID NO: 43128 - DNA, 642 bp, Glycine max
  Peptide Sequence Number=SeqID_134813
atgcccaaaagcactttggagaaattaccatttaatgcttcgtatctaaagccaagttccatggtagttcgtgccttcgacggcgcccgccgagagctgcctgttgggacgcccatggatccattcagtggaagtcgttccctctacactccatcagaaattgaagttcgtagtggaagggcatttggtcatcgtatcgggcgaggaagacatcttggtgagttgcccatgcccatcctctatgccatatatggaggccgcagaggagtcgttagaaaccgccttccaatctttcgaggtggtaagcatttcctccgtggactccttctctgggcaaccttgcctgttagatacggcagtaatggtggcccgggtaatgttggggaatggctacaagcccggaatgggtttaggcaaggacaacgatccgacgacgagtccctcgaaggtactaatacctgggacccgcccatcgatttcgagcaagaaaaaaatcaaacagaagatgaagagaatgaggatgtgggacttcccccggaattggaaaggatagtcgtccatgagggccaagaaataaggtctcatcaagaagagacagaactagtagacttgggaactggcagtggaaaaagggaagtaaag

SEQ ID NO: 43129 - DNA, 216 bp, Glycine max
  Peptide Sequence Number=SeqID_134814
atgaacaaagcgagcgagattttcgatatcgatgctgttctgtgctccggtgatgtcggagctaggctcatcaggctatatgagctggaagagcagcagcctgtaatccctccactgtcaagagccaggggtgatcgctgctctgtgaagccagcctcacgcggtgccccctcgtctaggaaccaagagccctgtgctttcgctcagaacacctga

SEQ ID NO: 43130 - DNA, 189 bp, Glycine max
  Peptide Sequence Number=SeqID_134815
atgcatggctccaaactcaaaggtggaggacacatgaacgaaaacgcaattcatggggctccgaaaaagatgtggaggacacatgaacgaaaacgcaattcatggggctccgaaaaaggggtgagaatggagaattacactaagcaatcactacgcatggctccaaactcgaaggtggaggatacatga

SEQ ID NO: 43131 - DNA, 482 bp, Glycine max
  Peptide Sequence Number=SeqID_134816
aggactgcacatcctcgcctgcagagggctgcacgccctcgcctttagagggctacgcgtcctcattttcattcctgggccaccccctgatattggagggcgaccaactgtgcgagcacatccagagagggaggctatcacgcatctactatgcataccagggcaagatttcacccgtgccgctgcaaagagacgagtgcggatcatgcgcaccaacatgaccactcttacggatcgcgcccacaagacacccagtggacccggagaagtccaacagggccctggggtttccagctctggttgcgggcctctgtcagtcctacagggtgcctgttcccccagcgaggaatcgcacccacaaagacactcggtggacccggagaagtccagcagggccccagggtttccagccctggttacgggcctctgtagtcctacagggtgcccgtttcccccagcaaggtcacgtcatcatgacatag

SEQ ID NO: 43132 - DNA, 315 bp, Glycine max
  Peptide Sequence Number=SeqID_134817
atggatatgagcccgcgcactttcttgcgccgttttcagcaggcgaccggcaaatcaccggcccgctggctgctcgatgagcggttgcttcgcgcccgccagcagctcaccgacagccgcctcagcatcgacagaatcgccgaaatctgcggtttcgctaatgccacgaaagccgatcccgataaaatgagccggttcctcactgagtacacgcagcagggctgggaagtcaaaaccatggcagtcgaacgccgccgcagcgcactgttctggtcgcgcgaagcgtatttatttgtgcttgaacgcgccatctga

SEQ ID NO: 43133 - DNA, 426 bp, Glycine max
  Peptide Sequence Number=SeqID_134818
atgggttctacacctgcctccaatcctcctcctcctccttctcctctttctcctcctccttcggacgcatcgtcttcgccgtctgccatgaagcagacacacaaagtctcacgtctacgatcgttgtccactagaccacctggtgctgagagaccagtggtgcatgttgatcctgctattgggaaggccgacggtccccacaggaagaaattaagaacatatttggggattgtggcacgtgataaggcggaatttgatatcccagaggcttctcacagtaggacgaaaaggaagttactgcagaccgttggggagagatggaggcaatttaaatcaaacctcacgaggaaatgggcccttacagccgatcaggacggtgtcgaggacattgtctgtgagaaatacggcatcagcaaggaaaagtga

SEQ ID NO: 43134 - DNA, 271 bp, Glycine max
  Peptide Sequence Number=SeqID_134819
gcgagtctcacgggtgcgctttccaaaggaggaaagatgcgcggagttgccaccaacgaaggtattagcacctctcacgtcgacaaaagcggggctcttgctcctacgtaccctccatcaaagaggaaatcagacctacttgaagaacgaagaacgaacgaagaacggatgaagaacggtgaagaacgacgaagaacgatgaagaatttccacagaatcgcttacggaagcgttacggaagcacttcgactcgatttttcttcacgaaaac

SEQ ID NO: 43135 - DNA, 225 bp, Glycine max
  misc_feature (9)..(9): n is a, c, g, or t
  Peptide Sequence Number=SeqID_134820
atgtcgtanaattatctctggtgtctacttggtctgagttgactcgtgctctagagtctcaattcggtccttcaccttttgattgtccaatggccgagctcttcaagcttcaacaaacagatgataatgaggatcctagtagtacaattgtacctcagggtactcaagaagatgaaatagtagaatttgaagatcatcatttgtctttcaatgctttgaaaggtg

SEQ ID NO: 43136 - DNA, 465 bp, Glycine max
  Peptide Sequence Number=SeqID_134821
atgcagtcccagattcagtctcagggacttgcactacctcctgagcctctagttggtccctcaggtcctcgagtaagcacaaaagggagttatgttgatcccttaggaaacgatcctgagacggtaaaggtgggtgtggaggaggttaaagatgcaaatactccagttcttgtacccactgatgaggtttccttagtggggcaggcaattgacaccttccttgcttggccgacacatctggtcaagtctttatcacaacagacaactgtgtctccggcaaaaccacctcaaaagtcggatccagaggtcgatgattcgctttatctgatgacattgatcatcccagagcttttcttgaggccttaccagcttacatgggatgccaccgtgttcggagtctttaatctagacttcctgctctacataaagcacgaagacctctccgaaatcgcacacagtggttaa

SEQ ID NO: 43137 - DNA, 465 bp, Glycine max
  Peptide Sequence Number=SeqID_134822
atggatggatcaagtttgacgtcaagccttcaacaaggcatatgggaagatctgggatctggcaatgatagaagtgaagccatacctcttgctggattctatccttctatgccaagaatagcaaaagtggtcaagatcttggaacaagagctagaccaagtgaagcaacataggaatggggtggtagggataccaaggaagcgcttggaggagaaggtagaagctttggcaaatcaaggggagtgggcctcattcattcacatattagcacggttggcatttgggaccatactatttccgaatgtagatgggctagtggatatagcagcgatcgatacctttcttgcttatcaccacagcaaggaaagccccatcattgctgttttggcggatgcatatgatacatttgacttgagatgcgaaaagagcagcgcgagaattgtctattgtacgcctgctctttat

SEQ ID NO: 43138 - DNA, 188 bp, Glycine max
  Peptide Sequence Number=SeqID_134823
ggtggacccttgggtacttgtacctatcacttttagaggactacacgtcctcgccaacagagggctgcacgccctcacctctagaggactacatgtcctcgccttgagagggctacacgccctcaccttgggtactagttaccctcaccgtcagaggactacacgtcctcgccttgagaggactacac

SEQ ID NO: 43139 - DNA, 105 bp, Glycine max
  Peptide Sequence Number=SeqID_134824
atggccctctacagcgacgttttctgcttgtccaacgccgagaagggacgacgatctgtcggtcgtgaccctatcctctatttgcattcgtccctaagtacctga

SEQ ID NO: 43140 - DNA, 756 bp, Glycine max
  Peptide Sequence Number=SeqID_134825
atggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattcccctcaagtagtctttgaaagaagacatatgattcgtggctttcttttctatccggaggggcatgcgctgagtgaaaacgattacgcgggttatctgaccaaaattgccaattttgccggcaaaatgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcataaaataagagcacctggctctgcccattcacaaggactcgattctctgtccaaacatcacatgccagcagatgtggtcaccatcataggtactcaagatattgtgtctggagaggtggatagatag

SEQ ID NO: 43141 - DNA, 563 bp, Glycine max
  Peptide Sequence Number=SeqID_134826
gtagaggtgaatgggccccgttcatagacattctcgcactgttgatcttcggaggagtcctctttccaaatgtcaatgggttggtggatctagcagcgatcgacgcttttctcgcctatcatgaccacaaggaaagcccggttgtcgctatgttagccgacctatatgacaccttcgaccgaagatgtgagaagagcagtacgaggattgtttgttgtactccaactctttatgtatggttggtttcgcaccttttttgccaagaggtgagacatgcttgcccgctagaaagccaccgtttatgcacagagaaaagaggggcaaattgggaccaactcttagcaaacaaagaaggagcatctgtcaactggttccctcgatggaaagaaggaagaaccggagttcttatttcatgcagaggatttccgaatgttcccttgatggggacaaggggttgcatcagttacaatcccgttcttgctataaggcaacttggctaccctatgagaggggcaccgctggaggaagagctcgcgcttgtcattttcacgaggtttcaataa

SEQ ID NO: 43142 - DNA, 700 bp, Glycine max
  Peptide Sequence Number=SeqID_134827
gactacacatcctccatttcagagcactacacgtcctcgccttcagagggctacacgctctcatctttagagggcttcacgcccacgccttcaaaggactacacgtcctccacttcagaggactacacattctccacttcaaatgactacatgtcctccacttcagaggactacacgtcctcgccttcagagggctacacactctctctcgccttcattcctgggccaccctctggtcctggaggagggccacctatgcaagtacaaccagaggaggaggctatcgtgcaactactatgcataccggggcaagatttcacccgtgccgctgcaaagaaacaagtgcggatcatgcgcaccaacatgaccactattacacagatatggatgacattgctacttagcaacattctgcccagtgaccgtaatgccgatctccccttgcagaaggatcgtgcccacaagacacccagtggacccggagaagtccaacagggccctagggtctccaactttggttacgggcctctatcagtcctacagggtgccctaccccccggcaaggccatgccatcgcgacatagggatcgtgcccacaagacacccagtggacccagagaagtccaacagggttctggggtttccagctctgattacgagcctctgtcagttttacggagtgcttgtcacccccagcaag

SEQ ID NO: 43143 - DNA, 444 bp, Glycine max
  Peptide Sequence Number=SeqID_134828
tgaggtgttgatcagcaaagtctatgaacatcccgtcctggcggacagcgcccgcatgggtcagcacgtgtttgagtatgatgcggatagcgcggctgcacaagattacatggctttgtattttgagttgcaggataccaacaacattgccaaggcaatcattgccatcatcaatatcgcccaccagaagccatcagggtcttttagccaaggcatctgctcaaagttcatcccaaaaatccctgcgattaatgtcgcaggcataaaaagcatggcgacgacggctgttgagtacttcacgcaaaggccatactgcgcgccgcagttgtatggtgacatgtttgaggcggtgattttcaagttgctcggcatcttcattgatggcttcaaagacctgaaatcgttcgcgcactggctcaaactaccagaagccattcctggaaa

SEQ ID NO: 43144 - DNA, 60 bp, Glycine max
  Peptide Sequence Number=SeqID_134829
atcttcagccgttcttcgacgttcttcgttcgttcgtcatcgttcttcggtctttaacgg

SEQ ID NO: 43145 - DNA, 554 bp, Glycine max
  Peptide Sequence Number=SeqID_134830
aggatcccacataatggcctaactaatgagattaccctcacccatcttggcactaaatttgtgttgcatcctcaaacaccttcacaggtggccaaagatcaactaactatgaaagataagaggggtgaggaagaaaaactagaaaaccaaaagaaaaagaaggatagtaaggccttgtcttcaaaggccaaggggaaggaaaaagaggaaaaggattcctccaaaaagatcgttaagaaggaaaatcattttgcaacaaaatgtgatatcaaaagagccctccttcttaaacaatctttctaccttctcctatcaagggaaacatcccttagcaccgctatacctcttgagcttgaggttattcctcaggtaaaggagttgttggatgaggggcttcccatggaccctaagagaataaaggtcattcctgagtggcctactccaccaacaccactcattgagttggtgaggaactatattctctcatgggaagatggccaagaaaggggtgttgaggaaagaatccatgagcttcaagaacctctggatttgag

SEQ ID NO: 43146 - DNA, 522 bp, Glycine max
  Peptide Sequence Number=SeqID_134831
atgaaggtggaaatataccacactgagctggacgagtttaaggctgaactggataggcgtaacttctataaacgcctcaccaatttagttgacagcagcctagacttagcgttagtgaaagagttttatgccaacctttacagctctgaagacccttcaccaaagcaagtcagggtcagaggccacctggtgaggattgatgcagacagcctcaacacattcttagagacgcctgtgatattagctgagggttgcccacagattataaagagattggggctgccttgtataccaagccaagggtttgttttcaactctgagggccatcttgggaagattctcaggaaagatttgacgactcttgctcaggtgtggagtgttctctcatattccaaccgggctcctacttcacacacctcagacctgacagtagatatagctaggctgatctttggcctagtctctcagatggacatgaatgtgggagcccttatctctggccagatcacatctatagcctag

SEQ ID NO: 43147 - DNA, 362 bp, Glycine max
  Peptide Sequence Number=SeqID_134832
atggcagaaaaagctgctctgaaaagacttggtgaaccaatagaagtcgcttacgtttatttgttccttgcttctgatgaatcgtcatttgtaacgggacaagtaattggcgttgatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 43148 - DNA, 1329 bp, Glycine max
  Peptide Sequence Number=SeqID_134833
atggcccgcaccaagaaaataggggagatgacgactgaggccgcaaaggaaatcgctgagaagattgattcctttgaggagcaggcgtcacagggatccttcatcccccatagacgtcaggatgttctcatcgctgttattggatgtccaaagcaccctggacgtgtctgtgctgctagagccgaattgcagcagctgacccaacaaagcagggaccagctagaggagtcgatcatagaaaaagtgactcggcagctcatggcatcgttcagccagatgcagtcccaatttcagtcccagatgcaatctcagggacttgcactacctctgaagcctcaggttggtccctcaggtcctcgagtaagcacaaaggagagttgtgttgatccctcaaggaatgatcctaagacgggtgactcagataggtgcggcttgtacatcgaagcaaatcctgcccacctggttgccctgagaagagtttatgagggatccactgttgttcataacactcctttgttgcctagtcaagtaaatgtgggtgtggaagaggttaaagatccaaatgctcccgttcttgtacccactgatgaggtttccttagtggggcaggcaattcacaccttccttgcctggccgacacatctggtcaagcctttatcacagcaggcaattgtgtctccggcaaaaccacctcaaacgttggatccagaggttgatgatccgctttatcttatgacattgaccatcctagagcttttcttgaggccttaccaggttacatgggatgccgccgtgttcgaggtctttaatccagacttcctgatctacacaaagtatgaagatctctccgaaatcgcatacagtggtcaatgtctcatcatatcagtgttacagttgtggattttgcatctgactaaaacaagtatgcgagcggggaattctgatctatatggattcctcgagccacagtccattcagagcggacattggcagatggtggtcatcctgcccaaggaacacctagttgtctggttttgttcattgcataacaggtcagacaactaccttaagaggataattaatagtgctttaaaaggtcttaatgatgctccacggcctaaatcaaaggctgctgctagacaaaatggaagcactgagtacggctattatgtcatgcactggatgtccaccatcatattaggaagtttcaggaataactgggaagtgtattttaacgatcctagaccattggagccagagagattaaaggcgcttcggatccagtggacacagtattctctcgagttagagctcagagctaggatttag

SEQ ID NO: 43149 - DNA, 466 bp, Glycine max
  Peptide Sequence Number=SeqID_134834
atgaggggcactgtgcataagcctcgagcgaacctaggggaagatcaaaaagggctatacgccctcaccttcagaggactacacgtcctcgccttgaggacgacacgtcttcaccttcagagggctacacgccctcaccttcagaggactataggtcctcaccttaagaggactacatgtcctcgccttcagaggactgcacgtcctcaccttccgaggactacacgtcctcaccttcaaaggactgcacgccctcgccttcagagggctacacgccctcaccttcagaggactacacatcctcaccttcataaggctacacgtccttaccttcaaagggctgcacatcctcgccttcagagggctacatgccctcaccttcagaggactacacatcctcaccttcatagggctacatgtcctcacctttggaggaatacacgtcctcgccttcagagggctgcat

SEQ ID NO: 43150 - DNA, 645 bp, Glycine max
  Peptide Sequence Number=SeqID_134835
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctgctcagttggtagagctccgctcttgcaattgggtcgttgcgattacgggttggatgtctaattgtccaggcggtaatgatagtatcttgtacctgaaccgatctagtatggatcgtacatggacggtagttggagtcggtggctctcctagggtttcctcatttgggatcctggggaagaggatcaagctggcccttgcgaacagcttgatgcactatctccccttcaaccctttgagcgaaatgtggcaaaaggaaaaagaatccatggaccgaccccaatcgtctccaccccgtaggaaactacgagatcaccccaaggacgccttcggcatccaggggtcgcggaccgaccatagaaccctgttcaaaaagcggaacgcattagctatccgctctcagctctccgttcccggttctcctgtagctggatcctccggaaccacaagaatccttagttag

SEQ ID NO: 43151 - DNA, 210 bp, Glycine max
  Peptide Sequence Number=SeqID_134836
gtgaaagttggaaacctcttacgtgccgatcaacgtctcattttcgccaaaaagttggaccagggcttcccgtggcttctgtttctatcagctgtccctcctgttcagctactgacgggatggtgcgtaacggcaaaagcaccgccggacatcagcgctggcaagtgtagcggtcacgctgcgcgtaaccaccacacccgccgcgcttaa

SEQ ID NO: 43152 - DNA, 457 bp, Glycine max
  Peptide Sequence Number=SeqID_134837
aggactacacgtcctcgcctttagaggactacacgtcctcaccatcagaggactacacgtcctcaccatcagagggctgcacgtcctcacctttagaggactacatgtcctcaccatcagagggctacacgccctcgcctttatagggctacacgccctcaccttcagagggttacacacccttatcttcagaggactatacgtcctccccatgagagaactacacgtcctcgccttcggagggctacacgcccttgcctttagaggattatacgtcctcgccatcagaggactacacgtcctcgccttcagaggacttcacatcctcaccttcagagggttacacaccctccttcagaggactatcacgtcctcccctttagtgggctacgcgtcctcgccttcagagggctacatcgctctcgcctttagagggctaccatatcctcgcacctaa

SEQ ID NO: 43153 - DNA, 504 bp, Glycine max
  Peptide Sequence Number=SeqID_134838
atgggatcgagtcaggcgccttcgcttaaaaggaggttctatcaagtcaaggtcaagagcctaggagtcaccagtctaaaaaagttagggcagttgatgggtcagctccagcgacaagcctttcgcaaagcttacggtaaaatttgggacctagccatggcagaggtctccacagaggccattgcctccctcgcccaatattatgagcagtcgttgaggtgcttcacctttggggacttccagttatcacccatggtggaagagtttgaagagatcctgggatgccctccagggggaaggaaaccatacctcttctcgggattctatccctctttagctaggatttctaagagagtccaaatctcggcgcaggaattagaccacagaaagcaagtaaaaaatggggtggttggagtaccgaggaaatgtttggaagcaaaagcaagaatcttggcaagtaaaggcaaatgggtcccattcatagacatcgtggggatcctctag

SEQ ID NO: 43154 - DNA, 369 bp, Glycine max
  Peptide Sequence Number=SeqID_134839
atgggttctccacctgcctccactactcctcctcctcctcctccttccctccttcacctcctctcctcctcgtcctcctcctacttcggacgcatcggcttcaacgcctgccgtgaagcggacacgcaaagcctcacacctatgatcattgcggaatttgatatcccagaggcttctgacagtaggacgaaaaggaagttactacagaccgcgggggagagatggaggcagtttaaatcagacctcacgaggaaatgggcccttacagccgatcaggacggtgtcgaggacactgtctttgacaaatacggcatcagcaaggaaaagtgggcccagttttgccagactcgcagagccccttcttgggag

SEQ ID NO: 43155 - DNA, 164 bp, Glycine max
  Peptide Sequence Number=SeqID_134840
gggttgaggaaagaagcctagagtttcaagaacctctggatttaaggtcaaatccctttcaagggggagggaatgatgcaatcctacccccccaagggcattggatagaagactccaagaagattgggccaaagatgcaagagaagaccgtagggttctcatga

SEQ ID NO: 43156 - DNA, 634 bp, Glycine max
  Peptide Sequence Number=SeqID_134841
atggaccctcgggtactagtaccctggtcttcagaggactacactcctcgccaacagagggctgcacgccctcaccttaagaagactgtgtgtcctcaccttcagaggactgcatgtccttaccttcagagggctacacgccctcgccatcagaggactgcgtgtcctcaccttcagagggctacaacgccctcgccatcagaggactgcatgtcctcaccttcagagggttacacgccctcgcccatcagaggactgcatgtcctcaccttcgtagggctacacgccctcacctttagaggactacacgtcctcgccaacagagggctgcatgccctcaccttgagaggactacacgtcctcgccaacgtagggctacacgccctcacctttagaggactacacgtcctcgccaacagagggctgcacgccctcacctttagaggactacacatcctcgccttcagaggactccacgtcctcaccttgagaggactacacgtcctcgccttgagaggactacacgtcctcgccttgagaggactacatgtcctcaccatcagagggctggacgccctcacctccagaggactacacgtcctcgccttgagagggctacccgccctcgccttgg

SEQ ID NO: 43157 - DNA, 372 bp, Glycine max
  Peptide Sequence Number=SeqID_134842
atggtgggttacacaccttcaagttttacagatttggtcttcgccagcaaaaagatcgaagtggatccgaaaagaggcaaatttgatcatcctactaggacgactgagaaaactggggcaaatgaagagggtgagaaagagggagaaacccatgctgtgactgccattcctatacggccaagtttcccactaacccaacaatgtcattactcagccaataacaaacctcctccttacccaccacccaccataaccccagccaaggttcatcaacctccatttctccgagaatacgactcgaacgcaacgtgtgcttgtcacggagaagccccggggcgttccattgagcattgtaggggctctgaagcgtaa

SEQ ID NO: 43158 - DNA, 321 bp, Glycine max
  Peptide Sequence Number=SeqID_134843
atgaagacaatctctggacattgtgttttggtaaaagacatatcagtttcgaaagcagctaaaattctcacaaagtttgtctctgctgacgatggtacttctcatctgaagcagctccacaaggagcttggatcatctcactctcataagaagcacaaaaggcacacaacagagaacgataatgatagtgggaaggtagtgggaaattctgttgaaagtgttgatattaacaaggagctcagccttgggcatgtgaaatttgatcagttcaaaaggcaacaaagtgacagtgggaatgctgatggtgaaaattttagttaa

SEQ ID NO: 43159 - DNA, 408 bp, Glycine max
  Peptide Sequence Number=SeqID_134844
catggcaaggaaagcccggtcgtcgccattttggccatgaatgacacgttcgaccggggatgtgaaaagagcggcgcaagaattgtttgttgtgcaccaactcttggctaccccatgagaggagcgccattagacgaaagcatcacgcctttcatcgcacggggttttagtgaccacaacgcgagggacaaagagcttaggggaagcagtaatgggagcatcggcggctatcataagtggctgagagtccggacacaaggattggattggctcccaaatctaaagattgtgagagacgatgaggttaaagcttcggaagaaagtgatgaggtacaagccctaaaggcagatcttgaaagagcctgggtagtcgaagagaagttcaagtccatagccatcaaagtctga

SEQ ID NO: 43160 - DNA, 524 bp, Glycine max
  Peptide Sequence Number=SeqID_134845
catcggctaactctgtgccagcagccgcggtaagacagaggatgcaagcgttatccggaatgattgggcgtaaagcgtctgtaggtggctttttaagttcgccgtcaaatcccagggctcaaccctggacaggcggtggaaactaccaagctggagtacgataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 43161 - DNA, 280 bp, Glycine max
  Peptide Sequence Number=SeqID_134846
atggacgactatcttctccaactccggggaaagtcccacatcttcatcctcttcactctctgtctgatccgtttcttgcttgaaatcaatggtcaggtcctaggtattagtaccttcgagggactcatcgtcggatctggcgttggcccaaccgtagagtttaaaagccacaaagggttacattatgcttgtcgcgtaaatgttcgggcacgttcctccactcgccaatttcctagtcggaaactaggagggcatggtcgtaccaaatccgacccactcg

SEQ ID NO: 43162 - DNA, 363 bp, Glycine max
  Peptide Sequence Number=SeqID_134847
atggcattagcacgtgacttttgtaaggaaacaacccatggggcattttggtttagaataggtagcaaaatacctttggcaatttacactttgggtatgatagcaaaatacttggatgtattagaaataccaagatgtgcacatgtgcaatttttggtaccccaaaatgctttgagtatgcatgtatgtaaatttagccaaggagatgtgtgtgatgtaagtaacaaatacaccttggaagtacatgtaaataatctaggaaatggccccaaggaagcttgcctcaagaggtccaggaaggacaaggcagccgaaggaactagttccgctccggagtatgacagtcaccgctttaggagcgct

SEQ ID NO: 43163 - DNA, 306 bp, Glycine max
  Peptide Sequence Number=SeqID_134848
atgagtgattcggcagatttggattcctatatacccactcgtgcggtacttcatttttgggaagaggttttgattgatcaaaaagaagaatctacttcaaccgatatgcccttaggcacggcaatacataacatagaaatcacactcggaaagggtggacaattagctagagcagcaggtgctgtagcgaaactaattgcaaaagaggggaaatcggccacattaaaattaccttctggggaggtccgtttgatatccaaaaaactgctcggcaacagtcggacaagtgggaaatgttgggagtaa

SEQ ID NO: 43164 - DNA, 384 bp, Glycine max
  Peptide Sequence Number=SeqID_134849
atgatacgcggagataccttacggttatccgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcagcgggcccgatgatacgcggagataccttacggttatccgcacccttgtgtcatccagaggtggcgggcccgatgatacgcggagataccttacggttatccgcacccttttgtcatccagaggcggcgggcccgatgacaagcagagacaaaatttggtcattctgcacccttgtgccatccagaggcggcgggcccgatga

SEQ ID NO: 43165 - DNA, 236 bp, Glycine max
  Peptide Sequence Number=SeqID_134850
atgaagggtataaagaggggtaatctctatatacttcaaggtacaacatgtattgatgatggtctagtagctgttgcatcgaaatttaataagagcatacctgacttaactcaattgtggcacatgaggctaggtcatatgagtgaaaaagcaattcacaccactaaaggaactcttgattacattcatgctgactgttgggggcctgcaagagtaccttcactaggtggtggaag

SEQ ID NO: 43166 - DNA, 537 bp, Glycine max
  Peptide Sequence Number=SeqID_134851
ggctacacgtccctcaccttgagaggactacacgtcctcaccatcagagggctgcacgccctcacctctagaggactacacgtcctcgccttgagagggctacacgccctcaccttgggtactagttaccctcaccgtcagaggactacacgtcctcgccttgagaggactacacggctacacgccctcaccttgggtactagttaccctcaccatcagaggactacagcctcgccttcaaagggtcaccttacttcagaggactacatgtcctcgcctgtcaaagggtcatgtacacgccttcaccttgagaggactacacgtcctcaccctcagagggttgcatgccctcacctccagaggactacatgtcctcgccttgagagggctacacgtcctcacctttgggtactaggttaccctcaccgtcagaggggttacacgccctcacccttgataggactaacacgtccttcgccagcagaggggctgcacgccctcaccttccagaggactacacctcctcgccttgagagg

SEQ ID NO: 43167 - DNA, 621 bp, Glycine max
  Peptide Sequence Number=SeqID_134852
atgtctcctccacctctaggacctcacgatcactcacaaactcatatcaagctctcaggatggcttcctctcgtagctctggtctctatgaatcttcacacaacaaattctctcaaactctctagaacttggacctttctctctctagaactctctgattatgcagaagcttcaagaaaagggtacatcccttgtggtacaagtagagggtacatctacttgggtttgactgagaacaagagagggtacatctcttgtggattagttctagtggagggtacatccactaggttcaaagagaacaagggaggtgtctacactggggaatcagtgatagcaacaacttctccagatgacgaatcagaaagatcagcaattcctccaactggggaagcaggggggtcagctttttcttcaactggtgaatcaggaggggcggcagcttcatctgatgatgcatcagagatgataatcagaggtggagatgggggaactacttcaagctcaggagaaggaggtagattcaccactagagttcatggctcggctggcattggttcaacccgtgccggtgtgggctctgaaggagcagcctcattggttctcaccaatggaagttaa

SEQ ID NO: 43168 - DNA, 794 bp, Glycine max
  Peptide Sequence Number=SeqID_134853
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgttgcacatctctcacttacatcaaaagctagaaatgattaagcttagtgaggaaggcggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43169 - DNA, 288 bp, Glycine max
  Peptide Sequence Number=SeqID_134854
atgacagtcgcaacgtgctcttttgcgggcgagcgaggcgaggctcacgggtgccctttccaaaggaggaaagatgcgcgaagtcgccaccaacgtttatttgtggaaaacttcggaaaaaccgatggaaaccggtcaaaaatgaaaattctaagttcgggagttgtatttacgcttgaggaaggtcgacaaagcggggcttttgctcctacgtaccctccatcaaagaggaaatcagacctacgtagttcttccttatgcatgaatcaagtgattctttttacttga

SEQ ID NO: 43170 - DNA, 294 bp, Glycine max
  Peptide Sequence Number=SeqID_134855
atggagcggtatctacagcacttggttcgccaacaggcggccaaccaccgggggcaggtgcagatacatgagtgtctctaccagctcagccttagtcagcagggccagggtttcgttccttttgtgtgccctactcctgatcagtttagggctgaggtcgcatggcctggagattggctcgaggcccaggctggggaggcgcctgcagaggctcccggcgatgcagaggagacctgcatggatgaggagatgacagatttgctcggtttcttgggagggagtggagccacatga

SEQ ID NO: 43171 - DNA, 669 bp, Glycine max
  Peptide Sequence Number=SeqID_134856
atgattatgaggggccaagacatttatagtagccaagatgaggttactacttcaccttcttctagcgaaagtgaagaagaaaaagggaaagaatctagtgaagaaatctattcccaagaagaaggacaacctttaatggttatggatgagtgtaaggagttaagtgtctcctccaagaggttagctaagaaggaaagtcagtttgaaataaagacaaatattaaagaaacttaccctcttagacaacctccacattttctcctttgtaaaaagacacttgttagcactgccacacctcttaggcttgagtttattcctcaagtaaaagagttgttgcatgagggtttggttcacaagagcttaaatccttgtgctttgttggtgcccaaaataggtattattaggcatcaaatccctaaaataggtggtatgatgaatgttttgagtggtgcaaccctcttttgtaaaatcactcgtgcacccaacatcttcatgatttgtgtacatagggactcattaggtaatgatcaatgggttcccatgaaccctaagagaataaaggtcattcctgagtggcccactccaccaagtgtaagaaaaatttggggcttccatttacaaaaggtgttgcagaaaaaaacccagagtttcaagaaccttgagatttga

SEQ ID NO: 43172 - DNA, 678 bp, Glycine max
  Peptide Sequence Number=SeqID_134857
atgtcggtggcttcttccttcctttcgcttggaggcacatacctccacggaactgcatggctgttttggtatgaaaacgaaataggtttaactaccgaggggtatcggggcgtttggggagctgcgtctctgataaacctcctgggggtcgtcacgtccttcaaaggcttgaacaatgcgtggcctacccgacttgacgacattaactactccccctccatgattagcgagcgggttcgttttcatgttgggctggtcctcttgaaacgtcagccatcagacgtctatcaaatgttggaccttgtatttaagggccagacaacgttcggtggagtggcccggggttttcccatggtatgcgcaggttgcgtcagggtcataccactttgggaaaggaggctggtagatcttcccgggagatatcacaaccatctggttggcgatgagggacggcaagaggtcttcgtacgtcattgggattggggtgaattctggagttggcctcgggggaaagttccttatcgcttggaaccggcgccaaagtgggcattgccggccgggcgagtcggggttggagccggaacttggggggcctccctctggatgggcgtgggcgccctagcttgtatgggtgctgagttaggagagtccccggcacgagctgagaagctcgggtga

SEQ ID NO: 43173 - DNA, 741 bp, Glycine max
  Peptide Sequence Number=SeqID_134858
atgaccggccctttcgatgagtcaatctcttgctttctcataagggtggacccttggaggattgcacgtcctcaacatcggagggctccacgccctcaccttcagaggactacacgtccccaccatcagagggctacacgccctcaccttcaaagggctacacgccctcgccttcagaaggctacacatccttgccttcagaggactacgtgtaccctcacctttgtagggctacacgccctcaccttcagagggctgcacgccctcacattcagaggactacacgtccttgccatcagaggactacatgtcctcgccttcagaggacttcacgtccttaccttcagagggctacacgccttcgccatcagagcgctgcacaccctcaccttcagaggactacacgtcctcgcctacggagaactacacgtcctctccatcagaggactacacgtcctctccatcagaggactacacgtccttgccttcagaggacttcacgtcctcacctttagagggctacacgccttcgccttcatagaactacacgccctcaccttcagaggactagacgtcctcgcctttagaggactacacgtcctcgccatcagagggctgcacgacctcgccttcagaggactacaggtcctcgccatcagaggactagatgtcctcgcctttaaaggactacacgtcctcgccatcagagggttgcacaccctcacccttagaggactacat

SEQ ID NO: 43174 - DNA, 827 bp, Glycine max
  Peptide Sequence Number=SeqID_134859
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcaaatacgccagcatttgtaacattgctattctcatttgtgaacagtaacgcacctgattttggaacatggaacgacaacaagattgtacttgctgttctttgtgcaagtatcctagaaaatcttcggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43175 - DNA, 511 bp, Glycine max
  Peptide Sequence Number=SeqID_134860
atgaccggtagattgctggccggatcattaacctttgattgtcgcatcatgcactatattattgttagaattttgcttccccgttcttcaaatttggctcaagcctctgaggaggacttgattttgatatgggcttttcttaccggtcgtcagatcgagtgggctcacttggttaggtaccgaatgcataaggcattacgggccaatgcacctcttccttatcctcaactggtcaccctatttctccttcattttcaaattcctcttgatgatgaaccttttgttcaagtcaagcgatcctttgctattggtgctggtgttgtaacttcatttggttaccgtaaagatcgtgatggtcaatggctgaagaaggacacgctacctcaacaagacgagcgtactccttctcattctcctcaacgagatgattcctcagcccttatgaatgaagttctttcagagttacggggcctccgcacatatgttggtgaacgattcgattccttggatg

SEQ ID NO: 43176 - DNA, 279 bp, Glycine max
  Peptide Sequence Number=SeqID_134861
atgcaaatagcaaccaggcccacttgggccttccaggatgttctccagaaggcggtgccttctggaagaagcaacctagctcgcctgggcgagctgggtggcaagcttctccttccttttcctataaataggggaaggagggaagaacaaaaatgttcaaccctcctggtatctgagaatcacttaaaattagtgagaaaaattgtttccgtgaagaaaatccaagccatgggcgcttccgtaacgcttcccatgacgtttccgtgggtgatttcgtga

SEQ ID NO: 43177 - DNA, 441 bp, Glycine max
  Peptide Sequence Number=SeqID_134862
atggctaagtttgacccagatgtagtcctagagttttattctattgcttggcccacggaggagggcgtgcgggacatgcggtcatgggtaaggggccaatggattccttttgatgcagacgccctcagccagttcctgggtgacccgctagtgttagaggaggaccaggagtgcgagtttagtcagagaaggaatcaggccgatggatttgatgaggaggccattgcccagcagttatgcatactgggtcaggattttgcccggaccgctgccgggaggcgggtgcggatcatgcgcaccagcatgatcaccttgacccagatgtggataacgttgctgcttagcattgtcctgcccagggatcataactccgacctccctctgccgaagtgtcagctggtgtatgccatcctgacacggatgagcgtccatgtgacttag

SEQ ID NO: 43178 - DNA, 361 bp, Glycine max
  Peptide Sequence Number=SeqID_134863
gcttgactttgctattatcctcagagaaggaacctctacctcaaatgggaggactgcgtcgatcccatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgaggtgtcagtgaagtgcttcatgtggcaggagaaaaaggctgcaccggtgcgtcagcagaatatgtga

SEQ ID NO: 43179 - DNA, 384 bp, Glycine max
  Peptide Sequence Number=SeqID_134864
atggaagggttagtggacctagcagcgattgacgttttcctcgcctttcatcatgacaaggaaagcccggtcgtcgccattttggccatgtatgacacgttcgaccggggatgtgaaaagagcagcgcaagaattgtttgtgcactggctctctatgtgtggttagtttcacacctttttctccaagaaggatgtccaaatgttccctggatgagaacatggggttgtattaattataatcccgtcctcgccataagacagcttggctaccccatgagaggagcgccattagacgaaagcatcacgcctttcattacacggggtttcagtgaccccaatgcaaaggtactccaaggagttcgcaaggcatgggatgcggcgtga

SEQ ID NO: 43180 - DNA, 471 bp, Glycine max
  Peptide Sequence Number=SeqID_134865
atggatgactcctcaaccatagaagaaattgaggtacattttgaatttgaagaagttttggaagcatttaatgaaatgcatgaggaaacgcaaaggctttctattttgaacaagaagatgagaagcgatctaaaattgcatatcactaaattggcttcaacacaaagtgagctggataaattgagacaagaaaatgaaaaacttggttcgagctataaagccactagttgtgtttgtccttctacttcttttaatatggatgattaccaatctttgcaaattgagttcgaaaagttcaaaaatgatcactatgaagaatgtatgaagtttcaaactgagcttttctatcttaaagatctttttagaaaaatgaacaaaggaaacagtgatcttggtaagttgcttagtgtgcaaaagcatactaccgataagactggtttagggtgtaataagcatactaccttttcttag

SEQ ID NO: 43181 - DNA, 354 bp, Glycine max
  Peptide Sequence Number=SeqID_134866
atggaaagagtcacaaataatatcggagatgaagtcacaactaaccaagcaactgaggaatggacaagatttcgtgatactttagcaatgaatatagaaatagaatcaaacaatgtgaagaacaagtcaagtggaaaaagaaaaatgtctagtgaggacacaagaagttacttcgcatggaacttgaaaatagagtgtgtgctagttaatgtgcttagagatcaaagaaatttgggcaataaaggtgatggaaattggaaaatagtagcatacagtactgcagctcaaattttgtccaagcggtttggagttcacctcatggcagataatgttaagaaccgttttaagctttag

SEQ ID NO: 43182 - DNA, 63 bp, Glycine max
  Peptide Sequence Number=SeqID_134867
atggggggtgcaaatagcaccccaggccccacttgggccctccggaatatcctccagaaggcg

SEQ ID NO: 43183 - DNA, 252 bp, Glycine max
  Peptide Sequence Number=SeqID_134868
atgaccggacgccttcttgccggttcattgacttttgaaagccgcatcctgcattatctcattgtgcatattttgcttccacgatcttccaaccttgcccagacttttgttggtgacaagtttgatgccatggaattgcaagttgacatgtggttcgatgccatggaatcaagaatcaccaaggttgaagaagatgtctccttcatccgtacttgctttgatccaccaccaccgcctccatcatcctcttag

SEQ ID NO: 43184 - DNA, 153 bp, Glycine max
  Peptide Sequence Number=SeqID_134869
atgggggaaatcgacattcccattcagataggcccccacacttgcaatgtggtgtttcaaaccttggattcatgccctgggagtagtcccatcaacgcttcaccagaaattgaagtttgcagtgggtggacttttagtgatagtgtcgggtga

SEQ ID NO: 43185 - DNA, 273 bp, Glycine max
  Peptide Sequence Number=SeqID_134870
atggaatgccccggggtattcccatggtacgtgcaagtcgcgttaggatcataccactttggggaaagggggttggaagatcttcccgggagttattacggccagttggttggcgatgagagatggcaagaggttctcatacgtcattgggagtggggtggaattttggaattggccccgggggaaagttcctcattgcgttgggattgccggccgggcgagtcgtggttggagttggaacttggggtgccgccctctgaacgggtgccttag

SEQ ID NO: 43186 - DNA, 342 bp, Glycine max
  Peptide Sequence Number=SeqID_134871
atggctgagaagaccaagaaaaagctagaagaaactgctcagttcagaagcactgagggcgtcattaatcctccatctcccatcagacgacatgattctttggaggagcaggcatcacagggttcgtttatcccccatggacgtcaggatgtcctgactgctgccattgggcgaccacaacaccttggtcgcgtgcatgctgctagagccggtgtcaccatcaagcaatacttcagatcggctgcacgaagctcctgcagttcctcctccatccctcatgaagaactcgagcagctcactcaacaaatcagggaccaactggaggagtcaatcagagaaaaa

SEQ ID NO: 43187 - DNA, 621 bp, Glycine max
  Peptide Sequence Number=SeqID_134872
atggaatggaacgcggtgcaaagaaaggataaggaacttaggggaagcagcaacgggatcattggcagatatcataagtggttgaaggcttggatgcaagagttagattggctcctgaagctaaaggtctcaagtgaggaagaggttgaaaccttggaggagagtgaggaggtacaagccttaaaggcgaaacttggaaaggtgcaagcagccaaggaaaggttcaagacaacggccatcaaggtccgaaaagagtgcgacaaactaagagacatcaatgtggccacagccgaagcattggaacgggaatcaaagagggaccgaaaggaagaatggggccgaaacaagttccaaggggctttgtggggtagcaacaacgagcttaagcttcgaagggctgggaaagaccagtctagagtcgaaaacatgatattggaagataagttgaaggcttatcaaaggttcgctttcaccttgaatgggagtcaagagcttccaagactgttagccaaagcaaaagcaatggtggacgtatactcgacccccaaggaagttcatgggctcctcgattattgtcagcatatgatcgatttgatggcccacataattaagaatcactaa

SEQ ID NO: 43188 - DNA, 930 bp, Glycine max
  Peptide Sequence Number=SeqID_134873
atgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaagcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatctcatggaagaagaacgcggccactgccgccgctgtcagttcggctgccgaagcagacccgactctcttggcaactacgcaccatcctccctcaaacatagtaggacggggaagggacacactggggcgcgatggcagccctcacctgggatacaaccgagcggcttacccttatggattgccgcccaactattcaccacccatcttgcaagaagatgcgggccacattgcttctaccgtccatgaaaaagagcctcctcagcagcccgacgaagtccataaagaccctcaagattatgctcggagggatgtcgagttttatcccccgatccccgaagggccggcaccaggcacgttgcctcaacccaacatcgcagcatcgccaatagttttgtccatggaagggccgcccccggcaactgaagaaaggaggaagctcgatctccttgaggaaagattgagggctgtggaaggatttggggactacccgtttgcagacatgacggacctttgcttagtacccgatgttgttattcccccgaagttcaaa

SEQ ID NO: 43189 - DNA, 132 bp, Glycine max
  Peptide Sequence Number=SeqID_134874
atgactgaagcacgtcaaaaggggatacagaaaaaaaataggggaggagcttgccacccagctcgcccaggcgagccaggttgcttcctccgccttctggaggaagaaactggaaggcccaagtgggcctga

SEQ ID NO: 43190 - DNA, 699 bp, Glycine max
  Peptide Sequence Number=SeqID_134875
atggcccagaagaagagcactccagtcactcctgccacatccagaagaagcaaggttgctatcccctccaagaaaaggaaagaaatttcctcatccgagtctgatgatgatgtcgaactagatgtctcgacatctaagagggccaagaaatctggaagaaaggtgcctggaaatgttcctgatgcaccattggacaacatctctttccactcaggcaatcattctcccacacttctgatattcacgaaaccactccaaaagctctgcttctccatggctacctcaccaaaagtagactcatcccctgtttcaccctctgtaccatcatctccatcatccaccaaaactccatcaaaccaggaacaacctgaattcaatatccaacccatacaaatgattcctggtccaggccctgttcctgagaaactggtccctaaaagacaacagagagtgaagatttctgaaaaccctagctttgcaacaagccctagggaagaagacactgagatggataagaagatccgcagtcttgtgaatagcattttgaaaaatgcttctgtccctgatgctgataaagatgttccaacatcttccaccccaaatgctgaagtccgctcttcatccagtgaagaggaatcaacagaggagaggatcagccacagaggagacccctgcaccaagggcaccagaactgctctg

SEQ ID NO: 43191 - DNA, 778 bp, Glycine max
  Peptide Sequence Number=SeqID_134876
aggactacacgtccttgctttagaggactacacgtcccctccttcagagaggtacacaccctcgccttcacttggctacatgtcctccccttcaaagggctgcacgacatcgcctttagaggacaacacatcttcaccttcagagggctacacgccctcgccttcagaggattataagtccttaccttcagaggactacacgtcctcacccccaaagggctacatgccttcgcctctagagggctacatgccctcgcctttagaggactacgcgtcctcgccttcaaaagactacatgtcctcaccttcagtgggctacaggccctcgccttcaaaggactacacgactacacgtcttacccttcagagggccacacgccctcgccttcataggaatacatgtcctccttttcagagggttacacaccttcaccttcagaaggctacacaccctcgccttcagagagctacacgccctcaccttcagagcagtacgcgtcctcgccttcagaggactacacatcttaaccttcagaggactacacgtcctccccatcagaggactacacatcctcactttcagtggactacatgccctagccttcaaatgactacacgttgtcgccttgagaggactacacgtcctccacctcttaggtctgcatggccttaccttgggaggactacacgtcctacccttcagagggcaacacaccctcgccttcagacgactacacgtcctcctcttcagagggctacacaccctcaccttcataag

SEQ ID NO: 43192 - DNA, 779 bp, Glycine max
  Peptide Sequence Number=SeqID_134877
atcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgacacggcgccccgtgcgcccggcctcctcgtcctcgcgacaaacacaaaccccggcgcttcgtgcgccaaggaactcaaatctgttaagtgcgacctcccgggggcccggagacggtgttcccgcgggagtcgtcacgacacaacatttacatacaatgactcttcggcaacggatatctcggctcttgcatcgatgaagaacgtagcgaaatgcgatacttggtgtgaattgcagaatcccgtgaaccatcgagtctttgaacgcaagttgcgcccgaagccattaggccgagggcacgcctgcctgggtgtcacacatcgtttcccccaacgcaaacatgtaacaatgttgctgcgcggggtgtatgctgacctccccgcggagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcag

SEQ ID NO: 43193 - DNA, 379 bp, Glycine max
  Peptide Sequence Number=SeqID_134878
atggcctcgatcaaatttggcgccgtttccggggagcagtgtccaaagtgtaaaactagaggcaatccatctgacttacaaccctttgatcctgacatagataggacatttcatagattagttaggaatcattttatacctttttatcattctgagcattccataactggtgaatctgtgcattctgttattggtgattttgaacatcctgatcttgagcattataattttgagcattctgattctgagcattctgattttgcacattctgagaacatgggacaacctccacctcgtgagaggactctaagggaaatggctgcacctgatttcacctatgaaagcttgtgcctaaaaagccctgagaggattcccatat

SEQ ID NO: 43194 - DNA, 150 bp, Glycine max
  Peptide Sequence Number=SeqID_134879
atggtgtggcgtctccaatcacctttcctccttctccattccgctgccattgatcttcaagaagcaaaggactccattgatgaagaagatccaaggccaacaagctctatatggagctacattatgtggtatcagagcatcatcgtctag

SEQ ID NO: 43195 - DNA, 246 bp, Glycine max
  Peptide Sequence Number=SeqID_134880
atggttcagcccaaaccaagtgctggccttaaggggaaacctcaccaacatgctctcactcatcatgccttcttgtatttcaacaaacaaaagcttgggccccctaggcctaagtcatgttttggcatttatcctaattctcgcaagctgcatttcactgagcacttggtgggcgcacttttgggtaccaacaacaagggaatgggggcaatgtggcttgccccatcatctcagtacacaacctag

SEQ ID NO: 43196 - DNA, 447 bp, Glycine max
  Peptide Sequence Number=SeqID_134881
atggtctctcgtggtggagacaaaagtgacgaatgtctgtttcatctcagggaattacacgacatggaaacatgccctgcggtggaagagctacttcaacggctcatggactgggggcagctcgaagtgtccgagagaggtagggaagagccgcagatttgctcacatttggcagaaagaaaggctcccccaacccccaaagccctagtaatatgtttcactaggaatatgaccagccccaggtccgagtaccccccggcagtgcccaagccgacgccattttcctatcaaagcaataaggccgtcccatggaaatatacccctcccacttttggagaaggggctgcaaccgaggttgactccttgtcagccaaggtgaccaacattaccgggtgtttgctccccctcactcggcagaattaccctccaaggggaaagcacccatga

SEQ ID NO: 43197 - DNA, 360 bp, Glycine max
  Peptide Sequence Number=SeqID_134882
atggaagaagatcaatggatgtatgacagtataatgtctgaagaagttgatataaatgatgaaaatgaagacgatgctggtgtgaatgaagaagaacatgttgattgttctaaggcgttcaatacttctcagtgggctcgatcagtcgctcatgaaattggatttgtggcggtaattatgagatcagacaaaaacactggtatgagaggaaggacttcatttgtgttaattggttgtgaaaggagtgatcagtataggtataggaaaaaagattttgttagaagagataatgacattaggaaatatgggtgtcccttcaagcttcatgggaaaccagtggttggagggcaaggttggatg

SEQ ID NO: 43198 - DNA, 201 bp, Glycine max
  Peptide Sequence Number=SeqID_134883
atgaacgaaaatgcaattcatggggctccgaaaagattgagaatggagaattgcactaagcaatctacttcgcgtagctccaaactagaaggtggaggacacatgaacgataacgcaattcatggggctccgaaaagattgagaatggagaattgcactaagcaatcactacgtatagctccaaaggtggaggacacatga

SEQ ID NO: 43199 - DNA, 834 bp, Glycine max
  Peptide Sequence Number=SeqID_134884
ggatggtgcgccggcggcggctacgacgcacacgacgccacggtgatcgtgctcagccgcagcgcggtcgagctggacaccctgctgccgaccagcggcggcggcagcgtgcgcgcggctgtcgaggccatggagcactaccaatgggaagtgggctgcgaggacgcggactatgaagacgatccgcagcaaaggacacgccatgacggcaaagaaagacaaggacgaggcagtgcacacgtctgcaccggccccgcagagtaccaagctggcgaagcccgcgcatcaccaggccaccacgctgccgccccgggatgcgttccacggcaaggcgggccgctacgtgcgcgatcccgccaccggcttgcgcgtgccgcaggactgaacgctggccctatccctcaacctctgaaaggaatccccatggcaaagtccatgaaacagatgctgctgctggccatggtccagacggcggcgggcacagcggccacgcccacggcggcggccaatgccatcctgtgccgggcgctgatgcccgagcccatcacggccgaccaggtggcgcgcgatctgatccgcccctacaagggcaacagcggcaagctcacggcaggggagcatcgcaagctgtcgtgcgaagtggaaatcgccgggagcggcacgccaggcgtggcgcctgcctatggcgacctgctgcaggcctgcggcttcgcggagaccgtcacggccggcactgatgtgcagtacacgctggtgagcggcggtgagccgctgctgacgctgtacggttatctggatggcacgctgttcaagctcgtggacgccaagggtacg

SEQ ID NO: 43200 - DNA, 345 bp, Glycine max
  Peptide Sequence Number=SeqID_134885
gtgaactctagaggtggtggcggtgtgcctattgcccactgtcagccatcctcaggctactgtggtgtctcgccctgcgcctgcctgggggcgcagtacttcttgatgaaagctcgattagtagggggcctgatgaccttgctgggggcgacaggcactccgcaccctgtaggactaacagaggcccgtaaccagagctggaaaccccagggccctgttggactcctctgggtccactggtttagccacatgcatacttacctatgtcggaacggcacagaccaactgatacttctgcaaggggagatcggcattgcggttgctgggcagaatgttgctaagtag

SEQ ID NO: 43201 - DNA, 171 bp, Glycine max
  Peptide Sequence Number=SeqID_134886
atgggatctttgttagcgatgggatgttcatttcggtttgatgttagtgtttgtggttgttgtgagggtggcgtaaagggggatgaaggatggttttgttggtcaaaggaggcgttagttatagttgtggacacgagggttgtggagacgatggttgtggttgaggaataa

SEQ ID NO: 43202 - DNA, 282 bp, Glycine max
  Peptide Sequence Number=SeqID_134887
atgttgtgtctgggggctccactatggtatgcgcacgtggcatttgagttgtatcacttggggtatggtgactggaagaccttcccgggtatggccaccaccaaatggttttccaataatgagggccataactcggaatacgccatgggaataggagagaactcgtctctcggggggcgtcatgcgctttttctgttgtggcagacccttctacttgagttggggggggaacttccggctcggatcgagaagttcgggtggttgtgttggtacgagttttga

SEQ ID NO: 43203 - DNA, 843 bp, Glycine max
  Peptide Sequence Number=SeqID_134888
tctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcaccgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggag

SEQ ID NO: 43204 - DNA, 465 bp, Glycine max
  Peptide Sequence Number=SeqID_134889
atgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagagaagagatctaccgccaagaagaaggacaacctttaatggttaaggaggagtgtattattaggcaccaaatccctaaaataggtggtgtgatgaatgctttgggtggtgcaacactcttttgtaaaatcactcgtgcacccaacatcttcatgatttgtgtacatagggactcattaggggttcccatgaaccctaagagaataaaggtcattcctgagtggccggctccaccaagtgtgttgaggaaaaaagcccagagtttcaagaacctcgggatttga

SEQ ID NO: 43205 - DNA, 225 bp, Glycine max
  Peptide Sequence Number=SeqID_134890
atgcccctctatgccaaatttttgaaggatatgttaaccaagaagaactggtacatccatagtgatagaattgttgtggaaggcaaagctctcatagacttgggagccagtatcaatttaatgcctctttccatgtgtcggagacttggagagatagagataatgcccacacacatgaccctccagttagcttatcgctccatgttagttgatgaatacgactaa

SEQ ID NO: 43206 - DNA, 793 bp, Glycine max
  Peptide Sequence Number=SeqID_134891
atgcgctgggactactgggccttcggcatttcaggtttcctgctgattctgtccatcatcattatgggcgtgaaaggctttaactgggggcttgatttcaccggtggtacggtcatcgagatctccctggaaaaaccggtcgatatggaccagatgcgcgaatcgctgcagaaagcgggctttgaagagccgctgctgcagaacttcggcagcagccgcgacatcatggtacgtatgccgccggtgcacgatgccaacggcagccaggagctgggcagtaaggttgttagcgtgattaacgaaacaaccagccagaacgcagcggttaagcgtattgagttcgtcggcccaagcgtgggtgctgacctggcgcagaccggcgcgatggcgctgctggtggcgctgatttccatcctggtgtacgtcggtttccgctttgagtggcgactggcggccggtgtggttatcgccctggcgcacgacgtggtgatcaccatgggcatactgtctctgttccacattgagattgacctgacgattgtggcatccctgatgtccgttatcggttactcactgaacgacagtatcgtggtatctgaccgtattcgtgaaaacttccgtaagatccgtcgcggtacgccgtacgaaatctttaacgtgtcgttgacccagacgctgcaccgtaccttgatcacctccggtactaccctgatggtgatcctgatgctgttcctcttcggtggtccggtactggaaggcttctcgctgaccatgttgattggtgtcaccatcg

SEQ ID NO: 43207 - DNA, 216 bp, Glycine max
  Peptide Sequence Number=SeqID_134892
atgcagagttcaaaacgcaatgtctaccttggagcctacctgaatgggccaaacaactaccttaaaggaataattaacagttctttgaaaggacttgatgatactccacaacctaaacccaaggctagtgctaggtggattgttgttaagacaattggaagcagacagattgaaggcgcttcgcatccagtaggcacaatattatctcaaagttag

SEQ ID NO: 43208 - DNA, 354 bp, Glycine max
  Peptide Sequence Number=SeqID_134893
atggctaagtttgacccagatatagttctagagttttacgctaatgcttggcccacagaggagggcgtgcgggacatgcggtcatgggagggccaggagtgcgagtttagtcagagaaggaaccaagccgatggatttgacgaggaggccattgcccagctgttatgcatatcgggtcaggattttgcctggaccgctgccgggagacaggtgcagatcatgcgcaccaacatgaccaccttgacccagatgtggatgacgttgctgctcagcaatgttctgcccagcgatcataactccgacctccctctgtcgaagtgtcagctggtatgccacctaccaggcaccctctag

SEQ ID NO: 43209 - DNA, 183 bp, Glycine max
  Peptide Sequence Number=SeqID_134894
atgccctactccagaccagttcagggcagaggttgcatggtccggagattggcccgagcccaagcaggagaggcacccccagaagctcccggcgacggagaagaggcccacgaggatgaggagatggccgatttgcttgacttcttgggagggagtggagataccgcatacgtttttgtttag

SEQ ID NO: 43210 - DNA, 372 bp, Glycine max
  Peptide Sequence Number=SeqID_134895
atgccaatctccccctgcaaaagtatcggttggtctgtgtcgtcccgacatggggatcgcacccacaagacacccagtggacccggaaaagtccaacagggccctggggtttccagctctggttacgggcctctatcagtcctacagggtgccctgggatcgcacctgcaagacacccagtggacccgaagaagtccaacagggtcttggagttgtcaagctctaattacgggtctctgtcagttctacagagtacctataacctccagcaagggcattaggccccctactgatcgagctttcatcaagaagtattgcgcccccaggcaggcgcagggcgaaacaccacaacagcattgggatggccggtag

SEQ ID NO: 43211 - DNA, 396 bp, Glycine max
  Peptide Sequence Number=SeqID_134896
atgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatgggcttcctgaacaagccttttatttggtagcggacaaattggagtattaccaaatcatgcgcctattgccacaggggggagatataggggatgttgagaatacgtcttcttaa

SEQ ID NO: 43212 - DNA, 279 bp, Glycine max
  Peptide Sequence Number=SeqID_134897
atgacggcacagaccaaccgatacatctgcaggcggagattggcattgtggtcgttgggcagaatgttgctaaatagcaacgtcatccacgtaagggtggtcatgttggtgcgcatggtccgcactcgtctttttgcagcgacacggggggaatcttgccccggtatgcatagtagatgtatgatagcctccctctctggatgtgctcgcacagttggtcgccctccaatatcagggggtgacctagggactgataaaaggaaactattggccccttaa

SEQ ID NO: 43213 - DNA, 136 bp, Glycine max
  Peptide Sequence Number=SeqID_134898
atggccattaaagatcaatgcgactctttgcaaatccagaagaaggtatcaaagggtaataattgtcaattttgtaggaaatttggacacttccagaaggattacctaaagagtaagtcttggttcaaaaagaaag

SEQ ID NO: 43214 - DNA, 336 bp, Glycine max
  Peptide Sequence Number=SeqID_134899
atgagtgccatcaccttgaggtctagcaaccaaattcaagtgcctccaccagtagcagtacctgcacctgaacctgtcaagcttcattctacacttgaaaaagaggatgagatagttccacaaaagagaaaacttcctgatcatgagggagctaacaaaaattttcatgtaggtggaccttcttcgagtagttcagatttgcagcagcctcctatccctctttcattcccacctagagaaattccaaacaaaaatatggaagaagtggaaaaggagatcttggagaccttcaggaaagtagaggtgaacatacctctgctagatgccatcaagtag

SEQ ID NO: 43215 - DNA, 735 bp, Glycine max
  Peptide Sequence Number=SeqID_134900
atgggtcaacttcaacagcaagccttccgcaaagcctatggtaagatttgggacctagctagggtagaagtctccatggaaccgattgcatccctttcccagtattatgaccagcccctaaggtgcttcacattcgaggacttccatctagtgccgactgtgaaagagtttgaagaaatcctgggatgcccactgggaggaaggaagccatatcttttctctaggttctatccctccacgacaagagttgccaaggaagtgtttggaggaaagggcaaaaggccttggcaaatcaaggcgactgggctttcttttattgacatcttggcgctcttgatctttggagttgtcctctttccgaatatggaagggttagtggacctagcagcgattgacgctttcctcgcctttcatcatggcaaggaaagcccggtcgtcgccattttggccatgtatgacacggggatgccgtctatctgctacaaggtcaccgctcgtgcgtcgaaaaaggaaaggcaaattgagaccaactcttggctagcccaactcttggctagcatggaggggcgtctgggttgtattaattataatcccgtcctcgccataagacaacttggctaccccatgagaggagtgccatcagacgaaagcatcacgcctttcatcgcacggggtttcagtgaccacaatgcgagggtactccaaggagttcgcaaggcatgggatgcggcatga

SEQ ID NO: 43216 - DNA, 438 bp, Glycine max
  Peptide Sequence Number=SeqID_134901
atgcctactgacatcagggaaattgaggctgctctgtgcatacccggcagagggtttattttaaatgctgaaggtcaccctgggaagatcctcaaaaaagatctaaccactcttgctcaggtctggagtgttctctcatactccaacctggctccgacttcccacaccttggatttgactatggatagagctaggggggctagaagaccaagggcaaggccagttgaggctccttctacattagcaactcctcatccagcttctacatcagcagctcctcctccagctcatatgacaccagctccttctaccctacctcctgcagattttcaaggtttcgaagccatgcttcgaagcatacatcaggggcatattattttactacaaagtgttggatcaagtggcctcgaaataattaagaagggggggttgaattaa

SEQ ID NO: 43217 - DNA, 810 bp, Glycine max
  Peptide Sequence Number=SeqID_134902
atgggatcaagtcaaaagccttcgcttaaaaagaggttctatcaagtcaaaatcaagagcttagaggtcactagtttaggagagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagttggaagaaatcctgggatgccaactgggaggaaggaagccatatcttttctttgggttctatccctccacgacaagagttgccaaggtagtgaaaatctcagcacaagagttggaacgtctaaagcaaaacagaaatggagtagtcggagtaccaaggaagtttgtcctctttccaaatatggaagggttagtggacctagcagcgattgacgctttcctcgcctttcatcatggcaaggaaagcccggtcgtcgccattttggccatgtatgacacgttcggccggggatgcccgtctatccgctacaaggtcaccgctcgtgcgttgaaaagggaaagggtaattgattcattgcaccaagaggaaacaatgtggacagaccgatttgctcttactttgaacaggagtcaagaacttccccgattgctagccaaggccaaagcaatggcggacacctactccgcccccgaggagatccacggacttctcagctattgtcaacatatgatagacttaatggacaatatgattagaaaccgctag

SEQ ID NO: 43218 - DNA, 399 bp, Glycine max
  Peptide Sequence Number=SeqID_134903
atggagtgcctagagggtgtttgggagaccctccaaggcaatgagaggtgccgattccgtggcccaattcgacttactgctacttcattagtacatccggaggaacccgcacgcacacttcagcagcctgtggagtggatactacctacacctactccatatcgactagttgagccggttcaagtgatagaggtgtcatcctctaaagaggatcttgaagagaacctagaggagttacctcctgaacctgctgtggatgcacttgacttacctatggatgatgaagacccactcattgatgttgattctccagaggatattatgtcagcatccgaggcagactctacagaggagagtggccctggagggacagcgaatagtgacgactcttcatcatag

SEQ ID NO: 43219 - DNA, 165 bp, Glycine max
  Peptide Sequence Number=SeqID_134904
atggtgacaacaacaaaggccttaaggacagcctgcttagttgatgcaatcctccctaggaagggaccagtcactagatccatgagcaagaggctccaagaagattgggctagagctactgaagaaggccctagggttctcatgaacctcatggtagatttctga

SEQ ID NO: 43220 - DNA, 212 bp, Glycine max
  Peptide Sequence Number=SeqID_134905
atgacccctactcatgatgccttgctatattacaataagaggtggaacatgtcacgccaaaatgagtttgttggttactcgttcacaggaaaaaatcctaaaaattttgacattccttccggatgtaccatggatgaactgaagaatttgatcaagcaagttgcgcctgttgggattcccctttatgttattcatgaaacacaaatgataag

SEQ ID NO: 43221 - DNA, 198 bp, Glycine max
  Peptide Sequence Number=SeqID_134906
atggtccatgacatctttgtcaaggcgaaactggaagtaacagggacatcgatagtcctaaatatgtttggcagtagacgaagcagcgataggaaaatgcaaggatcacgcatgagcgaacataaaaaaaaggataaactcattttattcagaaagtttataactagtcaagatctgagcgacaatacttcttcctag

SEQ ID NO: 43222 - DNA, 197 bp, Glycine max
  Peptide Sequence Number=SeqID_134907
gacacagctatgaccatgattacgccaagctcgaaattaccctcataaagggaacaaaagctggtaccgggccccccctcgaggtcgacggtatcgataagcttgatgtttacacggtagtgatattcttcgtttctcttgtcatcttcggattcctatctaacgatccaggacgtaatccagggcgtgaagaataa

SEQ ID NO: 43223 - DNA, 444 bp, Glycine max
  Peptide Sequence Number=SeqID_134908
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggctgattaattgggtaacgccgatatattattcccagaatcacgacgttgtaaaacgacggccagtgaattgtaatacgactcactatagggcgaatttcggagctccatatattatgccgcggtcggccgactctagaacctag

SEQ ID NO: 43224 - DNA, 441 bp, Glycine max
  Peptide Sequence Number=SeqID_134909
atgaagcacttcactgacaccctcatcagtgccaacatattgtacaattccactttcagtaccggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43225 - DNA, 354 bp, Glycine max
  Peptide Sequence Number=SeqID_134910
atgagctcaaatggaagctcccaatccgatggctgcatgatgggagaggtgggaaatcttgctaaaatcctggatgaatctcctatgaaaactagcatgtccaagaaaagaacgtacttcccgcacataagcatgcatattccctttagatgccacaagaatgaaaggtgtgactctagcacatgggaaaggaatatgccacaagaatatgccaaaaggggcaaaactacacacacccatccaatagctaagctcacacccatgccaaaatacacaaaaaatacaaaaaaagtccctactacaaagactactccaaatgccttgaaatacaaggctaaaaccctatactactag

SEQ ID NO: 43226 - DNA, 477 bp, Glycine max
  Peptide Sequence Number=SeqID_134911
atgacgaagtctatttcgttgaagcctttgggaagacacgacaccgtgaggcgccatttggtggaggagattccgattgtggtgcctaggtacgccgtcaagcctctggcgacggtgacattggaaagcacggaccaaagggttacaaggaatgtgaacttttttcacaagccgcgcgcgctcgaaaaccttgccctgcctcttctctttgtcaccgtgaaatcactcttctctttctcctcccgcctgaaaactgccggaaaccgctccctcgacaaccacattgtccttgctcaaacccacagaaccccctacactaccggaaaacccacattctcctcgcttgaacccacagaaccccctacactgttcttggaagtctggctcaaagaaaacccaacatacactgttgctactagggtgctgaaacagtcgtgggtgctcaaagctcaaagctttctctgcgagtattgctga

SEQ ID NO: 43227 - DNA, 357 bp, Glycine max
  Peptide Sequence Number=SeqID_134912
atgcgtttctgcacaatccggggtacaatagcaatcaggcccacttgggccttccagattcttcctccagaagtctgttgcttctggaggaagcaaccttggtcgcctggggggagctgggtggcaagctcctccccctattttgctataaatagggggaggagtgaagaaaaaaaggttcagccttccttggcacttctcattctcttgaaattgctgaggaaaattatttcccgtgaagaaaattcaagccgaggcgcttcccgtaacgtttccgtgagtaattacgcgaagattctcgaccgttcttcaacattcatcgttcgttctttgttttcttcagtcttcaacgggtaa

SEQ ID NO: 43228 - DNA, 558 bp, Glycine max
  Peptide Sequence Number=SeqID_134913
atgcttattccccggataccgtcattgcttcttctccgggaaaagaagttcatgacccgtaggccttctaccttcacgcggcattgctccgagtctgggccgtgtctcagtcccagtgtggctgatcatcctctcggaccagctactgatcatcgccttggttcttacgcgttactcacccgtccgccactggaaacaccacttcccgtccgacttgcatgtgtaaggcatgccgccagcgttcatcctgagccagggatcgaactctccatgagattcctagttgcattacttatagcttccttgttcgtagacaagctgattcggaattctcttctattccaaggcataacttgtatccagggcgcttcatattcgactggagttcgctcccagaaatatagcccccccacccctcgtgtaatcccacgagcctcttatccattctcaattattattcgatcacggcatacaaatagaaaaacttacattgggtttagggataatcaggctcgaactgataacttccaccacgtcaaggtgacactctaccgctga

SEQ ID NO: 43229 - DNA, 441 bp, Glycine max
  Peptide Sequence Number=SeqID_134914
atgtctcctctctaccttacttatggctcttcttgtagtgtccccaagcctgttccactttgggcctgtgcacctgcctggaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccacgaagatacttaacagggaagtga

SEQ ID NO: 43230 - DNA, 191 bp, Glycine max
  Peptide Sequence Number=SeqID_134915
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 43231 - DNA, 345 bp, Glycine max
  Peptide Sequence Number=SeqID_134916
atggaacttgctagattgataggctcttggtgtgatcaaattgacattagccaagaacgtcgcattcaacatcgtaaacgagaagactattggaggcttaatgaaggcgttatcagatatgtacaagaagccgtcggcagcaaacaaaatgtttgcaagaaagattcaggagaatcttctagtcatgtttccaattcagcattgaatactgaaggcagagaaaggactacccagaagggccagaatggtcgaggcagatcaaagtcaagagggaaaggtcagacaaaatttcgaagtgacattatttgctggaattgtgacaagagaggtcactttaccaattag

SEQ ID NO: 43232 - DNA, 387 bp, Glycine max
  Peptide Sequence Number=SeqID_134917
atggatcgcaaggaagagcatggtcgtgacaaattccgtggagcgttgtggggcaacaacaagaccaacatgttagctatcatcaccaagtaccaagaagaactaagtctagccacggcccacgagcatagggtggcggacgagtatgcccaagtttacgcggaaaaggaggctagaggaagggtgatcgacttgttacaccaagaggcaaccatgtggatggaccgattttctcttaccttgaacgggagtcaagaacttccccgattgctaaccaaggccaaggcaatggcggacacctactccgcccccgaggagatccacggacttctcgactattgtcagcatatgatagatttaatggctcatataattaggaaccgctag

SEQ ID NO: 43233 - DNA, 516 bp, Glycine max
  Peptide Sequence Number=SeqID_134918
atggggacaaatcaaaacggcaaaaggttttatcaagtcaaggttaaaagtctagatgtcactagcctcaaggaattgggacgattgatgggacctctccaaaggcaagccttccgcaaagtgtatgggaagattctagatttgaccgcagcagaggtatttacggaagctgtcgtatccctcgcccaatactatgacctgctgttgaggtgtttcacgtttggggacttccaaatggtaccaactattgaagagtttgaggaaatattaggatgccctcttggggggagaaaaccgtatcttttctccggttttcttccttccttgagcaagattgcagctgtggttggagattcaacaaaagagttggatcgcatgaagcaaactcggaacgacgtagtgggcttgccttggaaatacttggaaggcaaggcaagggatatgacgagcctagagaagtggggcccgtttgcggatattttagctttgctgattttgggttgtcctcttttctga

SEQ ID NO: 43234 - DNA, 192 bp, Glycine max
  Peptide Sequence Number=SeqID_134919
gcaggcgcagggcgacacaccacagtagcctggggatggccggcagcggacaatagacgcactgccgccacctctagagcccctcagctcatctacaaaggctggagcgttgcctacgacccgtggtcgaccagcaggcgaccaagtccaaagccaaaggtagcaagataccttggatacgcatgtatatag

SEQ ID NO: 43235 - DNA, 191 bp, Glycine max
  Peptide Sequence Number=SeqID_134920
gacgagttcaacatgttcaagaggaaaagttgaagaacacttcaagattcaagaggaaagttgaattcaagaatcaagattcaaggatcaagcttcaagaatcaagatcaagattcaagattcaagattccagaatcaagagaaggcttaatcaagataagtatgaaaaggttttttcaaaaactgagtag

SEQ ID NO: 43236 - DNA, 816 bp, Glycine max
  Peptide Sequence Number=SeqID_134921
atggtgaaagttggaacctcttacgtgccgatcaacgtctcattttcgccaaaagttggccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcggagtgtgtttaatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccagaagatacttaa

SEQ ID NO: 43237 - DNA, 159 bp, Glycine max
  Peptide Sequence Number=SeqID_134922
atgggcagaaaagggttaggaaatagaagaataatgagacatcagaagcgtgcactgattaaattttcacgaattgggatactggtgaatcgggagagacttactgaggaaacaacaccagaaaatctagcctttccatggattcaaatgcagaattga

SEQ ID NO: 43238 - DNA, 896 bp, Glycine max
  Peptide Sequence Number=SeqID_134923
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgaggcggtggatactgtggtggtggatattgtggtggtggataaggatacggcattgggtacggcattggatacggcatcggaaagggaaaaggttgtgcacattgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43239 - DNA, 498 bp, Glycine max
  Peptide Sequence Number=SeqID_134924
atgccgatctcccctacggaagtatcagttggtctatggcgtcatgacaaaggatcgcgcccacaagacacccagtggacccggagaagtccaacagggccctggggtttccagctctggttatgggcctctgtcaatcctaccgggtgctcgtccccccagcaagggatcgtgcccgcaagacacccagtggacccgaagaagtccaataggatcctggggtttccagctctgattacgggcctttgtcagttctatggagtgtccgtcgcccccaacatggtcatcgagccccctattaaccggactttcatcaagaagtactgcgccccaaggcaggcgcagggcgagataccacagcagcctggggatggccggcagtgggcaatagacgcactgccgccacctccagagcccctcagctcatttacaaaggctagagcattgcctacgacccatggccaaccagcaggcgaccaagtccaaagccaaaggtaa

SEQ ID NO: 43240 - DNA, 455 bp, Glycine max
  Peptide Sequence Number=SeqID_134925
gcttccggtatcacaggacacagattattatctgcgaagtgatctccgtcacagtattattcgcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatattcatctccttcttcctccaagctcttatccatggcctcctatagtgaagcaaaggaatccattgatgaagaagatccaaggcctacaagctgcacatggagctacgtcatgtggtatcaagagcatcttcgtctag

SEQ ID NO: 43241 - DNA, 405 bp, Glycine max
  Peptide Sequence Number=SeqID_134926
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccgcctgtcagcgtgactcaaaagtcagtatgacagatcttgtgagcgcggaagaatac

SEQ ID NO: 43242 - DNA, 475 bp, Glycine max
  Peptide Sequence Number=SeqID_134927
atgagtatctcatcctccaccgcttcaaccagaatcagatatccaattgtgagaccacctgcaatcatccaattcagagcagctttccacaatgaccagacattcatagaaatacccccatttttccatgaacaatgggcacccaattacccagatgaagttcggttcaaatacaatggagcaacctacccaatacgagtccaacaaccccgaggtagatatttttttgcagatggactcgcagacgtcagggcagatttaaaaatctacgagtctattatcatcaacttctttgcctgcgatgataacaccattttttatctacattttacgcctcccctgaatcaacagacatgtggcagaccaatacttcattcccatctacatgcctggacaactgaaataacccaatgtatactgggtgcaccccaaccactggaaatcccatcacatgcaaggaaatatctgaaacaat

SEQ ID NO: 43243 - DNA, 54 bp, Glycine max
  Peptide Sequence Number=SeqID_134928
atggccgaccagcaggctaccaagtccaaagccaaaggtaggaagataccttag

SEQ ID NO: 43244 - DNA, 252 bp, Glycine max
  Peptide Sequence Number=SeqID_134929
atggaaaaatctgacaagaaaactttcaaagataagaaaggaaagaaagcatacatcgcttgggaatataatgatatggattcatcaagtgatttagaaaacgaaatcataaatctaggcctcatggccaaagactatgaaagcaaagaagaggtaacatcttctaactatgatttatctatttcttttgatgaacttcaagatgcattcaatgatttgcgagaatctatcaaacttgccattatattctaa

SEQ ID NO: 43245 - DNA, 327 bp, Glycine max
  Peptide Sequence Number=SeqID_134930
atggggcaactcacagcgcaggcgcgtggcaattgcatgctggccgtagggggtgacggcaaagtcgacgccaaactcggcccgtgtcaggctggcacgcccttcgcagacgacgcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43246 - DNA, 390 bp, Glycine max
  Peptide Sequence Number=SeqID_134931
atggaggccatgaaagagccaatggccaccatgatggaggccatgatgagcatgaagaagataatggaggtcaatgcggctgcaatagccgctaccagcaccattgctgaggtgaacctgacccccccatatggcctcaaccaaataaatcatccaaccccagatatggtaggtatggaaggcaaagagttgggagtcgacttcgagccttgcctcgaatatgccactgaagggcaagaagttggtggtatacccctgcaaaacactttggagggccctcagtatcacccacaaccacaccccttgcattccacagcgggtaaaaaccctcatgttatggcagaaatgggagtagttggatcatctagaggaaaggcacagggtcgttga

SEQ ID NO: 43247 - DNA, 851 bp, Glycine max
  Peptide Sequence Number=SeqID_134932
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcagcctagacaagagttacatcacctgggcagagcttagaccagagttacatcacgtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43248 - DNA, 294 bp, Glycine max
  Peptide Sequence Number=SeqID_134933
atggcagcttgcctaggcgagctaaggcttagtcctgaagtcatgagcttgcccaggcgagctggtttcttaaccttgaagtcatttggtggtccaaaccaggcagaggctagcctaggcgagctgaggtcgttcgctccaagctgggctgtgtgcacgaaccccccgttcagcccgaccgctgcgccttatccggtaactatcgtcttgagtccaacccggattagcaaagcgaggtatgtatgcggtgctacagagttcttgaagtggtggcctaactacgggctacactag

SEQ ID NO: 43249 - DNA, 294 bp, Glycine max
  Peptide Sequence Number=SeqID_134934
atgggctacgtgggagtacgtgagctcagttggaggtgggctacaggggatggtgggtttatgcgcgcattgtggatgtggaaaaacttgttgtgcaccatcgcccgaccgccacctagtaccacatgtgatggggtgaaacttcctgcttttattgttgaccacagagtggtacctggagatatgtcgcgggggtcaggagaccttgggggacgtcaggcgagctcctggcagtcaacagataaaaagaaaacaagaccacaaagcaaggaggcttgtggtggctgggccact

SEQ ID NO: 43250 - DNA, 837 bp, Glycine max
  Peptide Sequence Number=SeqID_134935
aaagattacaaagcagaaagggaaaaacccccattactaggtctggacgtatcaaaactattgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgctatatcaacacagacttgctgtagaaagagaactgggaagagatgccttgcactgattgcaagtagcagatcatttctcacaaaggctgctggatgcaaatcaaattcaacctcgtattacagattctcccctgcgtacatcaacaaatcctggcagttcaccaacttacaggagttttcggtggatattgctcgttttcatcagcattccccaacacttctcaaggaattcacgcaagcaaccactcccaaaggctctgacttctccatggaacaacctgtactcaatatccaatccatacaaatgattcctggtccaggccctgttcctgagaaactggtccctaaaagacaacagggagtgaagatttctgaaaaccctagctttgcaacaagccctagggaagaagacactgagatggataagaagatccgcagttttgtgaatagcattttgaaaaatgcttctgtccctgatgctgataaagatgtcccaacatcttccaccccaaatgctgaagtcctctcttcatcca

SEQ ID NO: 43251 - DNA, 363 bp, Glycine max
  Peptide Sequence Number=SeqID_134936
gaccatcctaaattgaagttatcctcccatgggaggaaggtgcagaaatttggtaggcctgctcctgagattgagggcctagttgttgccacaggactaagtcctttgatcgcgtgttcaatagacattggcgatcgaggacttatattcgcgttcgtggagaggtgccacagggaaactagcagtttccatcttcctgtgggggaggttagcatcaccctagatgatgtggcgtctctgcttcatcttcccattgttggcgccttctataccttcaagcctctgcatgtcgatgaggctatgttgatgttggtggagttactagaggtcaccagagaggcagctagggccgagacagcatag

SEQ ID NO: 43252 - DNA, 336 bp, Glycine max
  Peptide Sequence Number=SeqID_134937
atggcgtgcccgttagcgtgcataccgaaagagccctcatggacctcctccagcatgcgtctagcttccttagtgttcacgcatcggagcaacaccatgtcatggtttctcttgtatagtttaccatcccgctcctcctctaccaaacaacaatatgcgggcttgccgcgacacctgaactcaatgtatggtaggtctccgtgcggtgtcagctggaacatggacgctaaagtggcgagcgcatcgaccatttggttttcgtctcggggaactcgggatgcatgggttgacagtccttgtcccagtggacggactggttcttgcgtaagagtttga

SEQ ID NO: 43253 - DNA, 180 bp, Glycine max
  Peptide Sequence Number=SeqID_134938
atggtgaacttcttcttgactcatcttctacttgaagtggcatctccattcatctttctccttctccattccactgcaatcagacctcaagaagcaaaggaatccattgatgaagaagatccaaggcctacaagctccaatggagctacatcatgtgggtctatcatttttcagtcataa

SEQ ID NO: 43254 - DNA, 620 bp, Glycine max
  Peptide Sequence Number=SeqID_134939
atggggacaaatcaaaacggaaaaagattttatcaagtcaaggttaagggtcttgatgtcaccagcctcaaggaattgggacgattgatgggacctctccaaaggcaagccttccgcaaagtgtaccggaagattctagatttgaccgcagcggaggtatttacggaagctgtcgtatccctcgcccaatactatgaccagccgttgaggtgtttcacgtttggggacttccaaatggtaccgactattgaagagtttgaggaaatattaggatgccctcttggggggagaaaaccgtatcttttctctgggtttcttcccttcttgagcaagattgcagctgtggttggagactcggcaaaagagatggattgcatgaagcaaactcggaacggcgtagtgggcctgcctcggaaatacttggaaggcaaggcaagggatatggcgagccgcccgtttgcggatatattagctttgttgatttttggggttgtcctctttccgaacgttgacggtttggtggacttagccgccattgatgctttcctcgcatatcaccatagcaaggagagtccagtggtggctatcttggcagatttgtttgacacctttgaccggag

SEQ ID NO: 43255 - DNA, 288 bp, Glycine max
  Peptide Sequence Number=SeqID_134940
atgacatggttccgatggcacatggcctgcgtgaacactaaggaagctagaaaacaatgttgggggaggtggttgagggcgtcacttttggaccatggcaatgggcagtatggctatgaaagatctaaggatgggttactattgtcacagagagcggggattgctgcatccaacaacatggttgagaggaagcgtgtgcccatggcgtccaggacattcgcaattgactccaatgtcaagctctcaaggtgtaacgtgggactcagcactggtggatttcaccagtga

SEQ ID NO: 43256 - DNA, 429 bp, Glycine max
  Peptide Sequence Number=SeqID_134941
atgaagttcttattacttgatgacatgcaacctttggttggccgctttgggatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43257 - DNA, 746 bp, Glycine max
  Peptide Sequence Number=SeqID_134942
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggtaatgctcttaccagctggatccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43258 - DNA, 216 bp, Glycine max
  Peptide Sequence Number=SeqID_134943
atggggaagagcaaagtcgatatattgatagcaatttctccaaacacatggcatgcatcaaagtttatcatatttctccccaagataagtggatatgtgatttatgaagataacaaacaaaggccacatttctccccaagaaaagtgaatctcaagaaaagcgaatatatgatttatgaagacaacaaaggccacttgatcaacaagcccaactag

SEQ ID NO: 43259 - DNA, 741 bp, Glycine max
  Peptide Sequence Number=SeqID_134944
gagaacttcgaagctccggaggaagatgaggaagtccaagctctaaaattagagctagggaaggcaagactcgccaaagaaaaattcaagttagctgctacacacatccggagggagtgcaccgagttacgagaggaaaacgcggccactataagagcccttgaacaagaaaccaaaagggcccgcaaggaggaacatggccgagagaaattccgaggagcattgtggggtagcaacaatgagctcaagctccgaagagaggaaagagaccggtcacgggtgccgaaaaagacagcaagcagggaggggattgatgttgctcccagaagctcgactatgtggatggataggttcgcacctattcaccaatggacatcaagacacccgtgtccgtcttcagttatcgccaaaaaaaagaccatgggaccgaaccttgggtgtattaactataatcccgcacttgccataagacagctagggtaccccatgaggggagcgccaacagaagaaagtctctcgcctttccttgtgagggatttatgcgcgcaaagtctcaaggtgatacaaagagtccacaaggcgtggagaagtccgttgaggaaagacaaggagcttagaggcatccgtaatggcgtcatcggtggttatcatggatggctaagagttcacacgcgagggttagattggctctctaaattgaaagttatcgatgaagagaacttcgaagctccggagagatga

SEQ ID NO: 43260 - DNA, 663 bp, Glycine max
  Peptide Sequence Number=SeqID_134945
atgccgagcgcgcggggcgccgagtaccctgtcgcggtgacccgtctccccatcgtcgtcctcatctccggcactggctcgaacctcgccgcgctcctggccgccgagcgcgccgcggactgcccctacgaagtggtcgccgtgatcgccgaccgtgacgcgcccggcctcgagcacgcccgcagcgcggggatccccacccaggtggtgcgcctgtccgagcatcccgaccgggccgcctgggacgcggcgctcgccgagtccgtcaccgcccaccgccccgcgctcgtggtgctcgccggcttcatgaagctcgtcggccccccgctgctcgaggcctgcggcggccggatcatcaacacgcacccggccctgctgccctccttccccggcgcgcacggagtgcgcgacgccctcgcccacggcgtgaagatcaccggctgcagcgtcatcgaggtcgatgccggggtggacaccgggcagatcctcgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 43261 - DNA, 753 bp, Glycine max
  Peptide Sequence Number=SeqID_134946
atgcgttcatgggtgaggggtcagtggattccctttgacacggatgctctcagccagttccggggtgacccactagttttggaggaaggccagcagtgtgagttcagccagaggaggaacagggccgacgggttcgacgaggaggccattgtccagctgttatgcacaccgggacaggatttcacccggaccgttgcaaggaggcgggtgcggatcatgcacaccagcatgaccactttgacccagacgtggatgacatttctgctcagcaatgtcttgcctaacgatcataattctgatctccctctatcaaagtgccagttagtgtacgccatcctaacacagatgagcgtccacgtggcccaggtgattgctgacgccatctacttgtttgcaggtatgccacccaccaggcaccctctggacccggataagtctaacagggccctagggtttccgacgttgattatgggcctctgccaatcattcgaggttcccgtcacccccagtaaggtgatccgacagccgatcacccgggccttcatcgagaagtactgtacgcctaggcaggcgcagggtgatgcacatcaggccacagacgctcagccaccacctcatcaggccgatcccgctggatcactaggcatggagcattatctacagcacttggttcgccagcaggcggccaaccaccgggggcagatgcagatacatgagtgtctctaccggtttagcctcagtcagctggggtag

SEQ ID NO: 43262 - DNA, 560 bp, Glycine max
  Peptide Sequence Number=SeqID_134947
atgctcgaaagttttcaacaacaagatcaaatgtcagttctggaattgtacatagaaaaggatgtggctggtggttctatgtttcattctgcaaattctcttacatcatgtggaaataatttatctaataatgaggcacaaccgccaataaatgtgagcaatttacatggtgatgaagatgatgatgatgatgattatcttgtgtctaactcatacgtggaagagtctttagacaaagatgatagtattgacggtatatctgatacagatgatgaagtcaccggcatgattcaaccagtaagaattgttcacccagtagaaggtgtacaaggaattcaaaatccattttggaatgatgttttgcattataataatatcaactggagtcatccggatgatgaggacatttgtggtttggagatgccatcgagttttaatgttggccaagaattatatgttggcataaattttgatagtaaagatgtggtcaagaatgcagtcaaacaatatgttatgaaggtgcatcaaagtttcaaagtggttgaaagcaaatcgaacaa

SEQ ID NO: 43263 - DNA, 409 bp, Glycine max
  misc_feature (393)..(393): n is a, c, g, or t
  Peptide Sequence Number=SeqID_134948
atgaagaagataatggaagccagtgcggttgcagttgtcgctaccagcactgttgctaagtacgcacgaccccatgatgtgcaaattcaaaacgagcatgccttcccgccacatggcttgcctcccaactatacaccacccaatgtggcgtacactcctaatgaggatgtcaataaatgctcattgagagccaacaacctcatcatatacatgtctctcaacccatggagggagacacatgaaattccccaccacaatcaagccgacttcgggccttgcctcggatatgccactgaaggggaagcagttgttggtgtacccctacaaaaccctttggatggccctcagctcagggtcattgaaggaggtgaagattatgcctttgctaacctnagaagagttgttccta

SEQ ID NO: 43264 - DNA, 126 bp, Glycine max
  Peptide Sequence Number=SeqID_134949
atgatggaggccatgatgagcgtgaagaagataatggaagccaatacgattgcattgccgctaccagcgttgttgctaaggaatgggaaagttggatcatctagaggaaaggctcagggccattga

SEQ ID NO: 43265 - DNA, 420 bp, Glycine max
  misc_feature (116)..(116): n is a, c, g, or t
  Peptide Sequence Number=SeqID_134950
atgatacgcggagataccttacggttatccgcaccctttggtcatccagaggcggcgggcccgatgacaagcagagaccaagtttggtcattctgcacccttgtatcatccagagncggcgggcccgatgatacgcggagataccttacggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 43266 - DNA, 261 bp, Glycine max
  Peptide Sequence Number=SeqID_134951
atgacagaaaccgtttgtacggataaccgcttgggtatctccatacgtcacctgacttcacgggtcaggatgacagaaatcgtttgtacggataaccgcttgggtatctccatacgtcacctgacttcacgggatgacagaaggtgcggaagacaacgtaagtctccatgcgtcaacgggttcgttggcccccgattgacaaagggtgcagaagacgacgttagtctctgcatgctaccggactctgagtctgacggataa

SEQ ID NO: 43267 - DNA, 283 bp, Glycine max
  Peptide Sequence Number=SeqID_134952
atggaaggcccaagcgcacaaactattggtggatcagatttaagctatcgtgaagtagggagttgctacgtgcacccagcattattgctggggcacccagcaaacagtgaagtggcgaaactgcccttcagcaattattcttccggaaaaactcacagacaacttccggaagaacgtcatccggaatgtttccggaagaagcttcttccggaagaattccagtgtcttccggaagaagcttcttccggaaaaattccggatgacgttcttccggaagttgact

SEQ ID NO: 43268 - DNA, 4599 bp, Glycine max
  Peptide Sequence Number=SeqID_134953
atggatatacaggacggtcgcaaaattagcgttggtgaatgtgctctcttcaaaccatctgaagatcgcccaccatttattggtataattcattgtctgacatttggcaaagagaaaaaattgaagttaggtgttagttggctttatcgatccattgaagtaaaactcaacaagggcgtgccattggaggctgctccaaatgaaatcttctacaccttccataaggatgagactgatgctgaatcgctgctccatccatgtaaagttgcatttcttcgtaagggtgctgaacttccatcagggacttgtgtacgaatgcatgcaacagtgcagccaggtggtcgatctcctaagccaatgagtagtccaacatcaacatcacagttaaaatctgtttcagatagtgtccagaacaatacttcttcctttccatctcacattaaggggaggaaaagggaaagggcagatcaaggctctgagcctgtcaagcgagaacgatcaattaaaactgaggatggagattctggtcatttcaggcatgataacattttgaagacagagattgctaaaattacagaaaagggagggcttgttgacaatgaaggagtggaaaaattagtgcagctgatggttcctgatagaaatgagaaaaagatagatttagctagccggtcattgcttgcagctgtcattgcagcaacagaaaaattagattgtcttagtcagtttgtgcagctgaggggtttgcctgtatttgatgaatggctccaagaggtccataaagggaagattggtgatggtgttgggtctagggatggtgataaatctgtcgaggaatttctcttggtattgcttcgggcacttgataagcttcctgtaaatcttcaggctttacaaacatgcaacattggaaaatctgtgaatcatttgcgaacgcataaaaacactgaaattcagaggaaagcaagaggtttagtggacacatggaagaaacgtgttgaagctgaaatgaatataaaagatgcaaagtctggttcaggtcccactgttcactggcctgccaaatcacgttcttctgatgttggtcatggcgggaatagacattcaggtgcatcatctgatattgccatgaagagttctgttacacagctttctgcatccaaaacagcctctgtgaagattgtccagggagagaatactattagatctgcatcaacatctacatttccagggcctgctaaatcagtgctgtcacctgcatctgtgactgcaaacctaaaagatggacagccctgtattgccgctgtcagtggaggttctgatcttcccatggtgaatgcaagggatgagaaaagtagtagttctagtcaatctcacaacaacagtcaatcttgttctagtgaccatgctaaaactggaggtcattcaggaaaggaggatgccagaagctctactgcaatgagcgtgaataagatatctggaggctcttcacggcaccgaaaatctattaatggatttccaggttcaactccatccggagggcaaagggaaactggatcaagtaggaattcctccttgcacaaaaatttaacttcagagaaaatatctcaacctggattaatggataaggcacttgatggaacttctcttgaaggagttacttgcaagttgattgttaaaattccaagccaaggtagaagccctgctcaaagtgctagtgcaggttcttttgatgatcctacaatcatgaatagtcgagcctcatctcctgttcttccagagaagcacgatcagtttgatcactgctcaaaggaaaagagtgacctttatcgagccaatattggctcagatattaatactgaatcttggcagagtaatgattttaaagatgtattgactggctctgatgaggctgatggatcacctgctgcagttactgatgaagagcgctgtcggattgtcaatgattgtaagaaaacatttgaggtaccaaaagccgcttcctcatcatctggaaatgaaaataaagctggaaatttgcaggatgcttcttacagctcaataaatgctttaattgaaggtgttaagtactctgaggctgatgatgttggaatgaatcttcttgcgagtgtggctgctggagagattttgaaatccgaattgttaactccgactggatctccagaaagaaacactgctgctgttgaacagtcatgcacaggcaatgatatggttaagtcatctgaagaaaatcttgtccgggatgaatgccactcaaataatggtcttgatggtgaacataagaatcagggttctgtaacagatgatttaggggcaaatgacgaaagtgattctgattttcgagcttcaggtgagaaagctgcaagagagctaaataagagtgttaatgcatgtagtatggatttgcaacaggtttctgaaattattttagaaagcaaaggaaaattaaacgaaaaatctgtatctactgcattgcgtggcctttctgaaagttctgtacaagaagctagagatggtgacagaagcaagcagctccaggaggttggtcggggagtgaatggtggtgaaattgttgatgttaaggtcagttctgttgcagaagttgaggctgaagcaactgaaaaattgtcacatatagctgtgaaagtggatgtacagagtgataattgtactgctgaaggatcgagtggtggtggacggacagctgctgttcttgttccgtctgatttggcaagaggaaaagatgagaatgtactccattcttctgcttatagtgttgataaggttcctgaagacttgactgaacgggagtctgaaaaagctgatgatgttgatgctgagaatcttcctagtcagtctaaaaaggaaagaaatgagtgtgaaagtgataccttgacaatgcctgagaatagaggtttatgctctatcgtgactggtattgctgctgaacatgtggaggaaaatttagaaactaaagaggttcatgaccaacctgccagagaggaacttcccaaagattcacctagtgtccgttcacaagaaatggataagcatcttgattctaaaggatcaaaattgactgccatggaagcggaggaggctgaggagtgtacctctaccactgcagatgcttcttccgtgtctgctgcagctgtgtcagatgcagatgcaaaggttgaatttgatttaaatgaagggctcaatgcagatgatgagaaatgcggtgagttcaacagcagtgcacctgctggtcgtttggtcagtcctgtgccatttcctgcttcatctatgtcttgtggtattcctgctcctgtcactggggctgctgctgcaaaggggcgctttgtgcctcctgaagatttattgagaagtaaaggggaaattggttggaagggatccgctgccactagtgcatttaggccagccgagctcaggaaagttatggaaatgccttttggggcgctaacttcctctatacctgatgctccagctggaaagcagagtcgagcaccattggatattgacttgaatgtggctgatgaaagaatacttgatgatatttcttctcaaccctgtgctcgtcacacggattctgtatctcttacaactgatggtcatgatcctgtaagcagtaaaatggcttcacctgttcgctgctctggagggcttggccttgacttgaaccaggtggatgaagcttctgacgtgggcaattgcttgagcagtaatcataaaattgatgtgccaattatgaaggtgaagtcatcattgggtggcccaccaaatcgagaagtgaatgtccacagggactttgatttgaacaatggaccttcagttgatgaagtcaccactgaatcctcattgttctctcagcatgccaggagcagtgtgccatctcaaccacctgtttctggacttagggtgagtactgctgagccagtcaacttctcttggcttccttccagtggcaacacctattctgctgtcacaatatcttcaattatgcctgatagaggggatcagcccttttcaattgttgctccaaatgggccacaaaggttgttgactcctgctgctggtggcaacccatttggacctgatgtttataagggaccagtattgtcatctccatttgaatatcctgtcttcccttttaattccagctttcctcttccatcagcttctttttctgccggatcaactacttatgtatatccaacatcaggcaatcggctttgctttcctgtggtaaattcacagttaatggggcctgctggtgcggtttcatctcattacccccggccttatgttgttggccttacagaaggtagcaatagtggtagtgctgagaccagtagaaaatgggcaaggcagggtttagatcttaatgcgggacctggaggttcagacatggaggggagagacgacaattctcctcttccatctaggcaactttctgttgctagttcacaggccctagctgaggagcaagcaaggatccagttggctggtagtgtttgtaagaggaaggagcctgatggtgggtgggatggctacaaccaatcctcatggcaatag

SEQ ID NO: 43269 - DNA, 513 bp, Glycine max
  Peptide Sequence Number=SeqID_134954
atgaatgaagaacagtggatgtatgataatatcatgtctgaagaagttggtatgaatgttgaaaatgaggaagatgttggcgtgaaagtagaacacgttgattgctctgatgcttttaatacttttgagttgcttgctagtcgtgatgaagttttacattgggttcgatcggtggctcataacattggatttgttgtcgtgataatgaggtcagacaccaatactagtgttagaggaaagaccttatttctattaatagtttgcaaaaggagtggtgagtatagacataagaagattgatttgtcattagttggaaatccatatgcgggtcgactgactaaagatgagaagattgttgttgttgatatgacgaagtccatgttgaagccaagaaatattctcttgacattgaaggagcacaatgccaacagttatacaacaatcaaacaaatttacaatgccagacatgcttatcattctttcataagacggagtaacactgaaatgcaataa

SEQ ID NO: 43270 - DNA, 1782 bp, Glycine max
  Peptide Sequence Number=SeqID_134955
atggcaggaggaggagctccagctaaagcagatgagccacagccacatccaccaaaggatcagttaccaaatatttcttactgtattactagtcctcctccatggcctgaggccatacttcttggttttcaacattttcttgtgatgcttggcacaactgtgttgattcccactgctcttgttccccagatgggaggtggcaataatgagaaggcaagagttatcgaaaccctgctttttgtagctggtattaacacattgttgcaaacaatgtttggaactcgattgcctgcagtaattggagggtcttacacctttgttccaaccacaatctcaattatccttgctggccgattcagtgatgaaccagatcctatagagaaattcaagaggataatgaggtcaatccaaggtgctcttattgttgcttcgactcttcaaatagtactgggcttcagtggtctctggcgtaatgttgcaaggttcttaagtccactttcgtcagttcctttggtatctcttgttggttttgggctgtatgagttagggttccctggggtagctaaatgtgtagagatcggattgcctcagcttatattgctagtatttgtttcacagtatgtgccccatgtgctacattcgggaaaacatatcttcgaccgttttgctgtgttatttacaattgtaattgtgtggatatatgctcatctacttactgttggaggggcctataatgatgctccacataaaactcagatatcatgccgcactgaccgtgctggacttattgattctgctccttgggtggccaaattgtccatttctcgtttacgaaacacagtcatgtcggtgtttcatggggattgtcacaggtgtgtcagagatggattgatttggccaccatctaatccactgcggcaaaatggcctcaacattaaattattggcaattggttgtcatagggtcctaattaaaaactttttctttaggataagaattccatatccatttcaatggggagcaccttcatttgatgcaggtgaagcctttgccatgatgatggcatcttttgttgctcttgtggagtccagtggagctttcattgctgtatataggtatgcaagtgcaacgccattgccaccatctattctcagtcggggtattggttggcagggagttggcattctgttatcaggattgtttggaacagtcaatggatcctctgtgtctgtagaaaatgcaggtcttttggctttgacacgtgttggaagtagaagagtggtgcaaatctctgccggatttatgattttcttttcaattcttggaaaatttggagcagtttttgcctctatcccacctcccattattgctgccctgtactgcttgttctttgcttatgttggtgctggtggtcttagttttcttcagttctgcaacctcaacagttttagaacaaagttcattttaggcttctcaatcttcgtgggcttgtccgtgccacagtacttcaacgagtacacagcaattaatggttatggtccagtccacacaggcgcaagatggttcaatgatataatcaacgtcccattccaatcaaagccatttgttgctggtgttgtggcatattttctagacaacactttgtttaagagagaagctgctattaggaaggacagaggtaaacattggtgggacaagtacaagtccttcaagggtgacacaagaagtgaggagttctattcccttcctttcaatctaaacaagtacttcccctctgtttaa

SEQ ID NO: 43271 - DNA, 165 bp, Glycine max
  Peptide Sequence Number=SeqID_134956
atgacgactaagatcatgtcaagagaggttgtgacggttgacgacgatgatggtgatggtggcgacaacgacaatcatgatgttggaacggtggtgacaatgacgacaaagaaggttatgacgatagaggtggtgacagtcgatgacaatggtgatgatgattga

SEQ ID NO: 43272 - DNA, 1557 bp, Glycine max
  Peptide Sequence Number=SeqID_134957
atgggtggcaacggcaaacacaggtggaaattcagcttccaccgttcctccacccatcctcccaaggaattcacctgccccatttccggctcactaatgtccgaccctgtcgtcgtagcttcgggccaaaccttcgaacgactcgccgttcaactctgcaaagacctcaacttctcccccaagctagacgacggcacccgacccgacttctcaaccctaatccccaacctcgccatcaaaacgacaatcctccactggtgcgacaacgcccgcacccaacacccgcgccctcccgattacgcctccctccagcgcctcgtcttagaacaaaaagaaaatgaccgcgttagggtttccgaaatggagcttctcaacgccgtcgccgacctccctcccgtcatcttctcccacgccgccaccgagttaggcccccgagtcaaccacttcaactcgggatcctcctccgagcaggaatccgtcatcatcccctcgagtccgggaactccgttaccgttaactattcgcccgacgtgcttctcctcttcctcctcctcctcctgcgagatcgaaatcgaaaactctaacaccccggcgtcggaggaagaagaaggactattaaagaaattgaagagtaacgaggtgtttgagcaagaagaaggcgtaatcgcgctgagaaagatcacgaggaacaaagaggatgctagggtttcgctctgcacgccgcgggtgttactagcgctgcgtggtttgatcgcctcgcgatacggcgttgtccaggtcaacgcggtggcgtctctggtcaacctttcgctagagaagcagaacaaggtgaagattgttaggtcagggtttgttccgttcttgatcgatgttttgaaggggggactgggtgagtcgcaggagcacgctgcgggcgcgctttttagcttggctttggacgatgacaacaaaatggcgatcggcgttctcggcgcgttgcatccgttgatgcacgcgcttcgtgccgagtccgagcggacccggcacgactcggcgctcgcactgtatcatttgtcacttgtacagagcaatagaatgaaactggtgaagctcggcgtggtccccacacttctctcgatggtggtggcggggaatctggcgagccgggtgctgctgattctctgcaacctcgccgtgtgcacggaggggcgcacggcgatgctggacgccaacgcggtggagattttagtatcactgttgagagggaacgagttggactcggaggcgactcgggagaattgcgtggcggcgctttacgcgctgagtcatagaagcttgaggttcaagggtttggctaaggaagcgagagtggcggaggttttgaaggagattgaggaaacgggtacggagagggcgagggagaaggcgagaaaggtgttgcacatgttgagaactgtgggagatggagatggtgatgagattgacgagttttacgactcggccgggttgactcggaatcggtaccgagctggtgctgccaggaatagcgacaacctcgtcaacacgaccacgttttag

SEQ ID NO: 43273 - DNA, 123 bp, Glycine max
  Peptide Sequence Number=SeqID_134958
atgaccaaattagctagtttcccaactaaaggttgccagaagcatgagatggctgctagtgacttaattactgactgccatcttttaaaggagcagctggtgcaggtgagagcaatcacgtaa

SEQ ID NO: 43274 - DNA, 273 bp, Glycine max
  Peptide Sequence Number=SeqID_134959
atggtccacaagggtgacttgggttgcaggatcaaaggttttttaggtcaccgtgaccacaactgcatttgtctgcaatttcctacgacccatgaattttatcagttggcatcagtggcattctgcctacttgttgcttgggacttgaacaactttgatagtgagcttgaagagtttgccagaatattctacaagtttgacactggcttctcatggacgagaaaatatcaagttgaggagttccatcattcaagttccttgtttccttgttag

SEQ ID NO: 43275 - DNA, 735 bp, Glycine max
  Peptide Sequence Number=SeqID_134960
atggttacagatgctcataaaagatatggtgggatgggaacaatactagttgtcaaggtttctgcagagtcagcaagtgagttcggggaattagtagctgatccaaccactaatgaactattgcattacacagagaaacccgaaacttttgtatgttcatcctgtgcttatgccttgaattgtggaaccattgagggtgtttctactcagcggaaagacagagctaacctaagacgtgtctcaagctttgaagcaatgcagccagacacaaggagtcttccagtcaattatgtcagattggatcaagatatcctctcacctcttgcggggaagaagcaattgtacatttatgaaaccaatgacttttgggaacaaatcaaaactccaggaatgtccataaaatgttctggcttgtatcttgcccaatttcgttacacatccccccatttattagcaaatggagatggtattaaaaaagccagcatcaccggtgatgtttacattcacccatcagcaaaagtgcatccatctgctaagattggtccaagtgtatcaatatctgcaaatgctcgtataggagctggtacaaggctcaaacattgtatcatccttgatgacgttgaaatcaaggcaggtgaatctgtgaccgttgaggatgaggtagtggttttgaatagcattgttctgccacataagaccctaaatttgggtgttcaagatgagattcttttatag

SEQ ID NO: 43276 - DNA, 1239 bp, Glycine max
  Peptide Sequence Number=SeqID_134961
atgacttctttgtctacccatcacacctatagccgaaagcaaaaatctctcggcctcctctgcaccaattttctgagtttgtacaacaaagaaggtgtgcgcctggtcggtctcgatgacgcagcttcgcggttaggtgtagaaagacgtcggatctacgacatcgttaatgttttagagagtgtcggtgtgctaaccagaaaagctaagaatcagtatacttggaaaggattttgtgcaattcctgctgccttacaagaacttaaggatgaaggtttgaaggagaatcctggatcatttgatgactccaatgacaatgcaaaagtgtctgatgatgaggaggaggaagaagaaacatttcctaatattaacattgggagtcagagtgagaaggaaaatcctgattacactgctactgtcaaatcctccaagaatgggttaaacttccgttcagggccatcccaacccatttccagaatgcatttaaagttcaatggttggattggtttaggtttagatttcatttgtgcattccaagttgacttggctcaaaattcaaatgtcaaagagtcacggaaaaggatgtttggaactgacattggaaacataagttttaaaaggaacaaagttgatttgtccatggatggccagaattctaaaatgcaaaatcaacacgaaaatattagtccacgagctcagttagagaaaatcatcataaaaaaagatgctaagcagacttcagagagctatcagtttggcccttttgctccagcttatgtgcccaaagttggaacctctgaaaataatagtgtgaaaaaggtgcatgactgggacagcctcgcacaggagcatcgtcctcaatatcaaaaccaaggcctggcctatggttgcatggatgatcgggtggcctgccatcagggtggaatgcagctcttgaagagttatttgtctgaaatcgttgacatctgtgttcttttggacaaggggcaagccatctgggtggtgagcatggtaatggtagaggttgataggggaggagttgggtttgaggggaatgtggtgatcatgaggccaatgtgggtggagaggccttttggagtggcaaagactgagatctttgtcaaagacaaggagctttggggtcatgttgacaaaactgattatgcttctgacaaaactatgcacaagaaggcacatgccaaatgggagtacaaggcaaaccttgaggacaagacatga

SEQ ID NO: 43277 - DNA, 690 bp, Glycine max
  Peptide Sequence Number=SeqID_134962
atggatcatggattgatcatagatcatgtgagggagcgtaatagaagagaagcgaatcctatgacagcaggggatgagtgcaacctgcaagaaggggaagaaaggtacacatggcgcaataggaacaagtacgtcgaagagtggaagaacggcgccatctccgataatggtgtgctggtgaggaagaacgggaaccgttacgaagggtgttgggagaacggtgtttcaaaggggagaggggtgtttacgtggcgcgatggaagcacttcttttgggaattgggggaaaaagtttgtgaatgagaaacgtgtgtcgatggatgagtgtaataataataataataagagtgtgagttttcccataatttgtatttgggagcttaatggtgaagctggggatatcacttgtgatattgtggaggcttctatgatttatgatggcggaagagtgtgtgaaagtgatgtacagttgcagaagagcccttgtggttctattgatggggatgttaagaaaccgggtcatacggtttctaaagggcatatgaattatgatttgatgcttaatcttcaattgggtattaggtatctcatctacattgctactttaattagcttttcagttatgagctatctctgccaattgaatgttaccacttacagtgatgctttgccaatagacagaggaaggtga

SEQ ID NO: 43278 - DNA, 1677 bp, Glycine max
  Peptide Sequence Number=SeqID_134963
atggctggaggatcacttggagacaacattggattgaaggaagatgctatcaagagggtgtgtggtttggcctgcaaagctaacaatcacaagtcaacggataagctctacttttacgacaaggttcagatttcttcggaaacttaccatgttttcagcttcccgggatcttgggatcccgctgaatggtttgttaacaaaccctttggggtatcgaagataaattctacccagttcccttctctcagaagtattggtaacgatgaacttgcttgggtgaacgaaggcttcgcaaagagattcgatcgcctattggaaactaactttgaagatgtggctatactagatgggaagcaagtagtgtttacagggcactcctctggtgctgcaatggcaactcaaactaccttttgggtcttggaaaaatatgacatagtgccaaggattttgcttgctcccttggcttctattgaggaaaattttggttctgttctccaattcttgaatcccaagtccaaaacttccacccaagatccaacaagggctattttgatttctgaagtttataaaactgtgatgagaaacgccgcgagtgttacaagccatgctgcttgtattctcatgggcagcacaaatttgttacttgagacagtggcaaattttgttgagttgagcccttataggccctttggaacatatgttttctgcaacggaaatggacagctgattgtggtggaaaactcagatgctgttttgcaactcttgttccacactgccctgttaagcgatttggcagaacttgaagaagttgccgacaaaagcatatcgcaacacctgaactatgtggctgagttgcaggaaagcttgggaatgcagaatgtagtgtacttggagcaacttgagcaacttcccttgtctgctgacggttcaaatagtgatgttgcaacagccttggatggccttggactgaacacaagagcaaggctgtgtctacgagcagctggtgagttggagaagcagaaacgcaaaaacgaggacaaaatcatgaaggagattcaggataaagccttgacaagcatgaaagagcttcaaaattacaaaacaacatgtgagatgcacaaggggaagggctattacgatgccttcaaggtgcaaaaggagtcgaacgacttccaagcaaacgtgaagaggcttgtgctagcaggggtatgggatgaagtcattgagatgctaaagaggtatgaactccctgatgagttcgaaggggacaaagaatggataaagcgtggaaccgaatatcgccgccttgtggagcctctagacattgcaaactattaccgccacttgaagaatgaggacacaggaccttacatgatcagggccaggccaaaacggtataggtacactcaaagatggttggaacatgctaaaaggatgccacctgctcctatcactgaatcaaccttttgggctgaagtggaggaactttatagctggattaacagcaagaagcctcttgatgatcatgtcgagcaaagggttaagcagcttcaaaaagaccttaaaaattggactgatgatgagaaagtactagccaaggatacgttcttgaaggatcctaactttattaggtggaaggatattctacctcaggaactcaaggacacttcttcctag

SEQ ID NO: 43279 - DNA, 354 bp, Glycine max
  Peptide Sequence Number=SeqID_134964
atggatagaagagtgaagcccaagagccatgacatgatgtctgtttgtgagaaatcgatgcatgtagtagcaaatatcttaaccctacccactttgtcttttgcacacaagacactacgaacttctactactggaaaagctatgaagaatctttcaaggtgtagtgaagcctataagaaggggccactactcctccaagtccatgaaagaaggtcacaagagccaccgaggcaaccaaaatccgtggtcaagcatgttgttgagagcaacaatcgtggatcatcaacaacatctaaggtgattcagatagagagattagaagatgatgttaataaaaaggctgaagtgttctga

SEQ ID NO: 43280 - DNA, 1632 bp, Glycine max
  Peptide Sequence Number=SeqID_134965
atggcactctcacgtgatacttggataaccgtattatgcagaaaattgagagattggtggcaatgggttgctgatggggatcttcctattgttgcttcacatggaatggaggttgaagtatataaatcacttgatccaggggttcgtgtggtcatcttaaaagcattatgtgacattcgtgttgagcaagaagatatcagaggttacattgacagatcaatcaaacatggcattccactttcaacattccgtaaggagcgtattggcggtgattcacatggaatttcttattggtatgaagatgaccaaattattggtcataggttgtatcgggaaataaggaaaactgaggtggttcaaatgaagaaagggaaaccaagaggttcccaggagaagcttttcacaagtaaaaacagaacggaggcatctgttgggaagaaggtgaaaatagacatgctccctgaaatcgagaaagttcacaagagaaaggagaagttgctgaaaaaacaacacagacaagctcttcttcttgataatttcttgggtgttgatgggattgcccctgggcgttcacttcgtgatagaaaacctctaacttttgacgtcgctgtcattgcagatgattacgatcgatccatcaatgaagcaattaagataaccaaacggaaaccaccatccccagaacttatacccaggagagaagcaggagcaaaacctgaagctttaaccaatggtaaatggagtggtccttcacatgaccctcaagacctgaattttggcatgccatctccaaaatcacctgactccgatgatatggaggaagagaatcaaactgacatgttggacttggatcgaagcaatcggcgaagacagaagcctaaacggtattcagagaaagactttgttgaagcactgtcggataatgaggctgactatgacagcgatgatgatattgttggagaagccgtgtatgatgaagagtatctccagaaacgtaagcagagaaggaaggcttctagtagctctggctctgaaggagatgaagaatatcattgggatgaagataatgttgaagacgaagaagaagattccttgagtgtcagtgaggatagtgacaagccccgtaaattcaagcgactggcaggccgtactaggagggaaactaaagtcaggtctgtgggtgagattcaatcaggtctaagacgtagtaagagggcaaaaactaaaagccgtataaattaccgaaggtacgagatatctgattcagagacagagttcattaaatctgacaagtccaatgcatcagacgatcactcagatcctactgagaatggggagtatatgatggaaagtgaagactccgacggcaatgacgaggaagaacaagaaaccaaagcagttgagcccgttacttaccctgcagaagaaaataaccaatctcctgctgtagaggagaatgaacaaaaccaaaacctgcctcctgaaaaatctagtagtccaggtcaggaggaagttgagggcaccgcaaagcgacgtttccttgatttgaatgagcttgcccctagctcaggttttgatgatggtccaaatacaacaacactgaaagatgaaggcggcaatgatgataattga

SEQ ID NO: 43281 - DNA, 798 bp, Glycine max
  Peptide Sequence Number=SeqID_134966
atgcgagcacagacggtgatgacacagtggtgcacaagagcagcagcgtgtgggcaattgaggatgagcactaacactaacactcccaaacacgacgatatcgacgccattttcaaacaaaagcgctttcttcgaacgcaggtcagaaaaaccctcaagtccatcgatccctccctcaaatcccaccaagataacaccgttcaagacatagttttgggagctccgtggttcagatccagtcgcaggttgtgcgcgtacataagctgcgctgctcttcgcgaagtcgacacttcaaaaatcttgtcacagattttgcaacataatagtactactgatggaaaaaaactttatgtgccacgcgtggaggataagaatagtcacatgcgtatgcttcacatatcgcgaattgatgatctcattgcaaactcaatggacatactagagcctactccggttgatgctgatggaaatgcgcgtgaagatggactggcatttgacagatctggaagacgtttaggtcgtggtggaggttactatgataccttcctgaagaattaccaagaccttgcaaagacgcgtaattggaagcaacccttgcttgttgcactgtcatattctgaacaaatactggatgaaggagtaataccaatgacttcatctgatcttccagttgatgctctggtatctccagaaggtgtgattcccatcagtacaactgccttaaacagtgaacaattccagcatggatctctgacactggcagtggacttcacagctgatcctgaacacttacaatag

SEQ ID NO: 43282 - DNA, 114 bp, Glycine max
  Peptide Sequence Number=SeqID_134967
atgggagttgctggggaggtcaaaatggaagaaaagagagccacaaagggaagacttgatgggagaggagtgatcaaagatgtaaaaatcacttccacatcggtgaggaagtaa

SEQ ID NO: 43283 - DNA, 561 bp, Glycine max
  Peptide Sequence Number=SeqID_134968
atgaaatcagtcaccaaaactgcagagggaaagccacctcagcatgggcctcagtggattgaagctaagagtcatgttcaaacaggaaattacgagtgtggatactatgttatgcattggatatggtgcatcgtaactggtggattgaaggatgactggattcactggttttctgatcgatcagcgggtggtggtgacaaggactacaaggaggtacccccgcctcctttgtttgaacctgcagggggacacatgaaccaagttgtgaccttcaacagatcttattgcaagcctgtaattgctggattaggggatgaagacaaaccattcatctacacaatggattgtcttggggcaaaattgtatgttgctttgatggtgccttttatgcaagattattcttcccttatagtaaataacctggagcttgcaaaagattttgttgtttctgggactgcatctgagtctctgtatggtgcttgtgaggcaatgtttaagcctgacatggatcaggttcaaattataggacaattgtgcacgtacgataacctcaacagctag

SEQ ID NO: 43284 - DNA, 330 bp, Glycine max
  Peptide Sequence Number=SeqID_134969
atggtgctgagctttgtagtaactagtaacagaagcaatgtgagaaagatggactgggtgggaggactttattgcaatttaacagttattgttttcaaggagagggcgagtcctggtgcagcggtaaagttgtgccttggtgacttgttggtcatgggtttgaatccggaaacagcctctttgcatatgcaaggtgatgagtgggatgacaaggaagaagggaaggaagtgactcaacagtgggaggatgattgggatgatgatgatgttagtgatgatttttctctccagttgagaagggagttggagagcaacaccgagaagaactaa

SEQ ID NO: 43285 - DNA, 867 bp, Glycine max
  Peptide Sequence Number=SeqID_134970
atgctgtggcactctcttcctcggactcaactgaatcgtcttgctcagaatcaccggcatgccagagcagcacccgacaacgtagacctcgatcgacggtgcgaaaatcccgagctgcggcccgaagaacgcagagcaccccgacccgacgaagcctgccgctacgtggcagtccatgcctcactcggaagccgaagccggagccgagccggctccccaatcagcgtcgaggcgctccagcgagccatagaggaagagcttttctttcttgtagacctcgaagtccatgctgccgctaaggctgacggtgtcgatggcgacgtaggtggccttggcggtgtggcagtcgacgcggccgcgctggagggggagggtcctgggggcggaggcggggactggggcagcgttcacgacgagcgagacgacgacgtggtggaggttttcgagagaagctgttgcaagagagaaaataatgagagaatgaaggagccagaggaaatggaaattgtgatttccttgatcatactctttatggggatagcaattttgatggtcatccatgtctgcgtcgtggggagggccttcacagggaataacagcaacaacgaagaagaatttactcatcgcagcatcagtgccatgaagagaatgtttggcggcaacaaggttggtaacctgaaaaaccttccttgctttgagtacgaggagaaagcatgtaaagagaaagggtgttgtggccttgtggattgtgctgtttgcttggagaattttaagattggtgatgtgtgcagaacatgggttcattcacctgttgtgatgagggaacaaagtgctgtttctgaaaatgtagaaatatcgactgcatag

SEQ ID NO: 43286 - DNA, 1188 bp, Glycine max
  misc_feature (65)..(65): n is a, c, g, or t
  Peptide Sequence Number=SeqID_134971
atgactgatcctgtaaccatatcatctggccagacctataacagagcctcaattcagaaatggtntaattcaggaaacctaatatgtcccaaaacacgcgaaaaacttgccagcacagaacttgtccccaacacagcgcttaaaaagcttatccagaaattctgttccgaaaacggcgttatagtcgtgaatccgattgatcataatcaaacagtaaccaaaacaagcgacgcaggcagccccgccgcagcacacgccatgcagtttttgtcatggtttctctccaggaggctcgtgttcggaaccgaggaacagaaaaccaaagcagcgtacgagattcgtttgctggcgaagtccagcgttttcaacagggcgtgtttggtggaaatgggaactgtgccgccacttttggatcttctcgccgcagacgacagaaacttgcaagagagcgcaatcagtgctctgatgaagctctcgaagcacaccagcggccagaaactcataattgagagcagaggcttggcgccgattctcaaagttctcaaaagagggctcagcttagaagcgcgccacgtggcagccgcggttatattctacctttcttcatcaaaagagtaccgaaaactaataggggaaaaccccgatgtgattcccgcgttggtggaaatggtgaaagaagaaacaacttttggaaaaaacaattccgtggttgcgatcttcggacttctcttgcgtcggaaaaaccacgcgattgtgttatcagcgggtgcggttcctgttcttgttaatacgttagcttcttcgggtaacgctaatcttgttactgattccttggccgttctggtggcgttggcggagagtgtggaaggggcttatgctctgttacgagcagaggcgttgcctttggtggctaagattttgcaatctgctacttcgcgctcagggaaggagtactgtgcgtccattttgctggctctctgtgttaatgttggtgcggaagtgaccggtgttctggccaaggaggcttcggttatgccttcgctgtattcgcttctgacggacggtactcctcacgcggccaagaaagcgcgtgcgctcatcaatgttatacttgagttcagcgacaagaggttttctggaaccgtgggttcctctgtctcgcggcaaaggttggttaacttgaactag

SEQ ID NO: 43287 - DNA, 96 bp, Glycine max
  Peptide Sequence Number=SeqID_134972
atggagtttgtggttgttgggttctggcatagcatggctcagccctgtgtcaagaaggcacaatggtcctggcagacttctgaggctattaattga

SEQ ID NO: 43288 - DNA, 381 bp, Glycine max
  Peptide Sequence Number=SeqID_134973
atgaaagtgcgaactcacatgtggaaatctatcaatgaatttagctgcattagcaagttcagtggcagctctgatttcttcatttgttgccccatccttaccataggcaatgttttctttgatgctgcaactgaagagtattggttcctggctgacaaggcctataagctttggttaaggattgaccccaggcctaaaccagcagccactccatcttgcactgcagtcctaacaagattgacaagttccattatgaagattggcatacttgtcgaattgaaccaattgtgcgctctactacagttgctgcttcagaataagctgcttgtccacgggatgccaacttttcaaaagcaaagctcatcatggaaccagagatga

SEQ ID NO: 43289 - DNA, 141 bp, Glycine max
  Peptide Sequence Number=SeqID_134974
atggcgtggtgtgaccagagacgcacaaactctggcatgacaaaggaggttgctacgatagggtggctgagagttgagagattttggcgagcaaattatgttttagggtggctgagattgggcaacaaggagtgggaatga

SEQ ID NO: 43290 - DNA, 387 bp, Glycine max
  Peptide Sequence Number=SeqID_134975
atggttgaaaatgttagttggtttgacaggctagttgttggtgtctcgctaagcgaggcttgtgcacttatcgagaatcatgcgctaagcgagacactcaacccgcttagcgagttgggagaatctgagaagcatcagcgcgtcatcagctcgcccaggcgtagagagcagaacaaaggcgaaaaacagagcaaggaagctaaaaatctcagttttcaagaggatcttaggtttaggaggcttcatggagtgacacttggagagaacttcgacacaacttcgagaaaggtctcaatgaatgacggacgtcagagcagagtgagtcactgcgcgagggagggcagtgtggttgatgatgggaactttgaaaaaggtttagagcattag

SEQ ID NO: 43291 - DNA, 589 bp, Glycine max
  Peptide Sequence Number=SeqID_134976
aaacactgatgagcatgcaacactggaagcatggaatgatggcaagctttttgaacaggcagacaaagttgaattaccattggtcatgcgtctgcttcattactatgctgttggtcctgcactagcatgtggtaatactctggtagtaaagattgcggagaacgcacctttgactggggttccaaatgttgtgtctggttttggtccaactgcaggttcagctcttgccagtcatatggatgtggacaagagcaatcttaagcctgtgacattggaactaggaggaaaatcaccattcatagtgtgtgaggatgctgatgttgacaaggcagtcgaacttgcacactttgctctgttcttcaatcagggtcaatgctgttgtgccgggtcacgtacttacgtgcatgaacggatatacgatgagatttttgagaaagcgaaggcaactgctttgagacgtgttgtcggtgatacatttaagaagggcttggaccaaggtccccagggagagaagggtatctacagccttcagaattacttgcaggttaaggcagttgttacacctctcaaaaatccctcacagttgtaa

SEQ ID NO: 43292 - DNA, 1284 bp, Glycine max
  Peptide Sequence Number=SeqID_134977
atggactactacaacatactcaaagtgaatcgcaacgccagcgacgacgatttgaagaaagcctacaagagactcgcgcgtatatggcaccctgacaagaaccccgtcaacaagaccgaagccgaggccaaattcaaacgaatctccgaagcctacgacgttctcagcgacccgcagaagcgtcagatctacgatctctacggcgaggaggcgttgaaatcggggcagtttcccccacccccgcagtcctcgtcctcgtcgtcctcgcgcgccttccaccaccaccaccaccaccaccgccagaacaacaaccctcccccggcctcggcctcgtcgttccgattcaacccgcgcgacgccgacgacatctacgccgagtttttcggcccggacgacatcggcgccggtgcctcgtcccgccgaggcggcggcccggacgccttcttccggacctccaacggcggaggcgccgcgttcagcgcctccgccgctgcaggacggaaggccgccgcggtggagaacgcgctcccgtgcagcttggaggacctctacaaaggagtcaagaagaagatgaagatttccaggaacgtctacgacgcttttggaggccagtttgccgtcgtcgttgtgcaccagagcattgccgtcgacgtgcgtcgtgcgtcatgcggcggtcgcgtgcgtcggtcgtcggtttcttgtgtgcgtcgtctgctggtctcttgtcgtcgcgctcgagaacgtcgtctgcaattgttgtgtgtgtcgccggcgcccgcgccgccgttcgttgcgctggagactgctgctggtcgcaccgctgaagaggagaaactcagcaaatgtggggatgtggaggagattttgactatcgagataaaacctggctggaagaaaggaacaaaaattaccttcccagagaaaggtaaccgtgagcctggtgtcatcccagcagatctcatttttgtgatagatgagaagccgcatgctctttatagaagggatggtaatgatttggtgatcaaccaagagataacccttcttgaggcccttactggtaaaacgttggatctcaccaccttggacggaaggagtctcatgatcccattgacagatattgtcaaacctggtgctgaggttgttgtccctaatgaaggaatgcctatatcaaaagagcctgggatgaaggggaatttgagagttaagcttgacgtcaagtatccttcaaggctaactccagagcagaagtctgatctgaggagagttttaggtggaatctcatga

SEQ ID NO: 43293 - DNA, 2774 bp, Glycine max
  Peptide Sequence Number=SeqID_134978
atgaacagaacgcactctccatcatgtaacccttcctttctcgactgtggcaccctcgccgaccatgaaaggcaagcttggttcaaacgcaccagagttctcaccgcatgcgatgccctcaatgataaaaacgagtttcagtttggaatgttcgctgatgctttcactgatcacgtctcctcatcaagattcttccagaaatacttttactgcctctggtggggtttgaagaatttaagttcgtatggacaaaatcttcagacaagcacttacagtggtgaaacattgttttcaagtttcatatgcatcgcaggtctaatcctgtttgcgcatctcattggtaacatgcagaattatctgcaatcttcaactgcaaaagttgaagagtggagacttaaacagaaagatacagaagagtggatgaatcaccggcagcttccaccagaactgcaacaacgtgttcgacggttcgttcaatataaatggcttgccaccagaggagtggacgaagaagccattttgcgcgctttgcctttggaccttcgccgccagattcagaggcatctctgtctcgacattgttcgccgagttccatttttcggccaaatggatgaccagcttctagatgcaatatgcgaacgtcttgtgtcatcgttaaacacaaaagacacatacatcgttcgcgaaggcgatccggtgagagaaatgctcttcatcatcagagggcaagtagagagttccacaaccgatggtggaagaacaggttttttcaactccatcaccctcagacccggcgacttttgcggcgaagaattgctaacatgggccttgatgccctcttcaactctcaatctcccatcttccactcagacagtgaagaccctcaccgaagtggaagcatttgccttaagagccgaagatctcaaattcgtggccagccagttcaagcgcctacacagcaagaaactgcaacacgcttttagggcttggggggcacattttatacaagctgcgtggagacggcaccgcaagaggaaattggcgatggagttgttgaaggagaacttgtactacacgaatgtggtggaagatgatgatgatgaagaagaaggtagtgcaggagagagttcaatggcggggcatactcagaattttggggccacatttttggcttcgaaatttgctgcaaacactaagaaaggggcaattaaaaaggtggctattaaacttcctgatgctgataggagaaactctggcaagtggggaaactttaacagattcagcactgcagcagcagttgaggatttaatcactccacaagttccaataacatacactaagcatctgataaatggacaatttgtggatgctgcttcagggaaaacttttccaacatatgacccacgcacaggagaagtgattgctcaagttgctgaaggtgatgcagaagatatcaaccgtgcagtatcggcagctcgcaaggcctttgatgaaggaccttggccaaaattgactgcttatgaaagatgcaagataatactgcgctttgctgatttggttgagaaacacggtgatgaacttgcagctctggagacatggaacaatggaaagccttatgaacagtctgccactgctgaattaccaacgtttgtgcgtttgtttcgttactatgctggttgggcagataaaatccatggtctgacagtgcctgctgatggaaattatcatgtggagacattgcatgaaccaattggtgttgcaggacaaatcataccttggaactttcctctcctcatgtttgcttggaaagttggaccagctcttgcatgtggaaatactgtcatccttaagactgctgaacaaacacctttaacagctctctatgtagcaaaactttttcatgaggctggtcttccaccaggtgttttgaatgtagtttctggctatggtccaactgctggtgcagctctagcaagtcatatggatgttgacaagctagcattcactggatctaccgagactggaaaagttgtgcttggattggctgcgcaaagcaatttgaagcctgtgacattggaacttggagggaaatcacctttcatagtgtgtgaggatgctgatgttgaccaggctgtagaacttgcgcactttgctttgttctttaatcaggggcaatgttgctgtgctgggtctcgtacctttgtacatgagcatatctatgatgagttcttggagaaagcaaaggctcgtgctttgaaacgtgttgttggggatcccttcaaaaagggtgtcgaacaaggacctcagattgatgtggaacaattccagaaggtccttaggtacataaagtccggtattgaaagcaaggccacccttgaatgtgggggtgaccaaattggctcaaagggcttctttgtccagcccactgtcttctcaaatgttcaggatgacatgttgatagcaaaagatgaaatatttggccctgtacaaaccatcttgaagttcaaggacatcgacgaagtaattcgaaggtcaaacgcaacgcactatggtctagctgcaggagttttcactaagaatgtgcacacagccaacactttgatgcgagcactgagggttggaacagtatggatcaattgctttgatgtttttgatgctgcaattccctttggagggtacaaaatgagcggcattggcagggagaagggtatctacagtctcaacaattacctgcaagtgaaagctgtggtttcaccagtgaagaaacctgcatg

SEQ ID NO: 43294 - DNA, 402 bp, Glycine max
  Peptide Sequence Number=SeqID_134979
atggacaaggcagaggcaattcttgctctgataccaaattttaagagtttttttttatgtggtgatgacgaaaatggtgatggtagtgatgtcaacaacaatgacagtgatagagatatcagtggtgatcacagtgacaatgacggcggtggtggtagaggtgatattggtagtggtggcaatgacgatgtggtggtggtaacagtgttagtggtgacaaccaatggttgtggtggaagcaacgtcggtggtgttggtgacgataatggtggcaatgacggtggtggggtggtagtggaagcggtgttggtggtggttgtggtgacagtgataatggtgataggtggtattattggtagtggtgatggtgacaaaggtgatctagttggtagtggtggctga

SEQ ID NO: 43295 - DNA, 236 bp, Glycine max
  Peptide Sequence Number=SeqID_134980
tgaaagatgatgatgacaaggccatcccagtggacgaatctgaacactcagatggggatgccaaagcagtggccctttcaaagtacgaattcggggcatatttctcaacgttgcgtcaccttgatccctcggcaacctcgcaagtcacttttcccgaaagagctatggcggggcagagcttggagcacttagtcgaagcatcttcaccacgcgggtacgggcatatcataatctaa

SEQ ID NO: 43296 - DNA, 186 bp, Glycine max
  Peptide Sequence Number=SeqID_134981
atgggacaccttagtgatcaaggggttcccatgaaccctaagagaataaaggtcattcctgagtggcccactccactaagtgttgagggaaggagcccagagtatgaagaacctcaagatttgaggtcaaatcctttccaaggtggagggaatgatgtaatcctaccccgcaagggcattggatag

SEQ ID NO: 43297 - DNA, 552 bp, Glycine max
  Peptide Sequence Number=SeqID_134982
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatcgatgaagaacggcatctcctgcaccggaccgcgttcgaccagcgtcagaacgaactcgccctgctccatgctgatgaagtagttggtgttttcgctacatcaagcttatcgataccgtcgacctcgagggggggcccggtaccagcttttgttccctttagtgagggttaa

SEQ ID NO: 43298 - DNA, 369 bp, Glycine max
  Peptide Sequence Number=SeqID_134983
atggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcacaccttttttctccaagaaggagtcaagaacttccccgattgctagccaatttctatagcagtggcggacacctactcggggcgggcgggggagatccacggacttctcagctattgtcagcatatgatagacttaatggaccatatgattggaaaccgctaggaagtttgtattgtcgctcagatcttgactag

SEQ ID NO: 43299 - DNA, 318 bp, Glycine max
  Peptide Sequence Number=SeqID_134984
atgttagctatcatcagcaagtaccaagaagaactaaatctagctacggcccacgagcatagagtgatggacgagtatgcccaaatgtatgcggagaaggaggctaaaggaaggctgatcgacttgttacatcaagaggcaatgatgtggatggaccggtttgctcttaccttgaacgggagtcaagaacatccccgattactagccaaggccaaagcaatggcggacacctactccgcccccgaggagatccacaaacttctcagctattgtcagcatatgatagacttgatggcccatatgattagaaaccgttag

SEQ ID NO: 43300 - DNA, 676 bp, Glycine max
  Peptide Sequence Number=SeqID_134985
cctctccagcagcaggtacaatcccggatggagaaatcatcccaaccttagatggtcgaatccttcacaacagcagcaacaacaacagccttattttcaaaatgttgttggcccaagcagaccatgcgttcctccaccaatccagcagcaacaacagcaacagccccagaaacagcaaatagttgaggcccctccgcaaccttcccttgaagaacttgtgaggcaaatgactatgcaaaacatgcagtttcaacaagagaccagagcctccattccgagcttaactaatcatatgggacagttggctacacagttaaatcaacaacagtcccagaattttgatagattaccttctcaatttgtccagaatcccaaaaatgtgagtgccattacattgaggtcaggaaagcagtgtgaatctaaagagaagcaacatatccctctctcattccctccaagagcaatttccaacaaaaaaatggaagaggcagagaaggagatcttggaaacatttagaaaagtagaggagttgtgcactaataagcggaagcttaaaggaagtgaaagaattagtatgggcagaaatgtctccgcattgattgggaacaacaagtttgacaatgccatgctagatttaggagcttctgttagtgttatgcctctgtctattttttaa

SEQ ID NO: 43301 - DNA, 279 bp, Glycine max
  Peptide Sequence Number=SeqID_134986
atgaatatcgaggaatccattcatgttacctttgatgaatctaatgctatcttgtcaagaaagaatatgctagatgatattgcagattctttagaacaaatgaatattcatgaacaagattccaaaggaaatgataaaggaaacaatgaagatcctccagaagaagtcaaatccaatgatgaacttccaagagaatggaaagcctcaagagatcatcccctcgacaacattattggtgatatctcaaaagggaaaaacctgaaaattatcctgtcatag

SEQ ID NO: 43302 - DNA, 273 bp, Glycine max
  Peptide Sequence Number=SeqID_134987
atggacgtgtggggtgctaataccttccccgtgcgtaaatacaactctcgaacctttcatttaaagttcgtagaccacgtcttttttggtttttccgacgtttttcctcaaataaacgttggtggcgactccgcacgtgttcctttcttggaagacgcttcccgcgagtctcgcgtcgcgctcccgccgaagggtaggttgcgacaccgggttaatggtatcataggaagtggaggtgaatctatggtcatgctaagtctccgacttgcttga

SEQ ID NO: 43303 - DNA, 129 bp, Glycine max
  Peptide Sequence Number=SeqID_134988
atgtggagggtttcagaaactaaagcgactgtacctcggaaatttggatcaattgaacgcatagctcctgatggaggagaagaccactggatcatccaagatgtgccccatgtacttatctgtagatag

SEQ ID NO: 43304 - DNA, 906 bp, Glycine max
  Peptide Sequence Number=SeqID_134989
gatggaccctcgggtactagtaccctggtcttcagaggactacacgtcctcgccaacagagggctgcacaccctcaccttaagaggactgtgtgtcctcactttcagaggactacacgtcctcgccttcagaggactacacgtcctcgccttgagaggactacatgtcctcaccatcagagggctgcacgccctcacctctagaggactacacgtcctcgccttgagagggctactcgccctcgccttgggtactagttaccctcaccttgagaggactaaacgtcctcgccttgagaggactacatgtcctcaccatcagagggttgcacgccctcacctccagaggactacacgtcctcgccttgagagggctactcgccctcgccttggggtactagttaccctcatcttcagaggactacatgtcctcaccttcgtagggctacacgccctcacctttagaggaccacacgtcctcaccttcagagggctacacgccctcgccatcagaggactgcttgtccctcgccttcgaaaggcgacacggctacacgccctcacctttagaggactacacgtccttgccaacagagggctgcacgccctcaccttgagaggactacacgccctcacctcgagaggactatacatcctcgccttgagagggtttcacgccctcacctttagagggctacgtgtcctcatttgcaggaccagtagtttccttttaacggttcctgggccaccccctgatattggaggaggaccaactgtgcaagcacaaccagagagggaggctatcacacagctaatatgcataacggggcaagatttcacccgtgccgctgcaaagagacgagtgcggatcatgcgcaccaacatgaccactcttacacagatatag

SEQ ID NO: 43305 - DNA, 185 bp, Glycine max
  Peptide Sequence Number=SeqID_134990
atgactttgttgttccccggaggaaacaaaagaatgaccaaacttggtctctgcgtgccatcggacacgactgtgtctgaatggcaaaggggtgcggataaccgtaagaatgaccaaacttggtctctgcttgtcatcgggcccgccgcctctggagtgacaaaaggggtgcgaataaccataag

SEQ ID NO: 43306 - DNA, 147 bp, Glycine max
  Peptide Sequence Number=SeqID_134991
atgaagaaacaacaatggaagagaagtggaagacaaaggagaagaggtgagaggaggtgccatccattaaggaataagccatggaagaaagagcttcaccaccaagatgagccttggataagaagcttggagaggatgcttcaatga

SEQ ID NO: 43307 - DNA, 127 bp, Glycine max
  Peptide Sequence Number=SeqID_134992
atggcacgcaaaccgaggcaggattttagcgtttcaaaggtcagatttttccccacttttgtgactgagtatgggtcacagtcaaaaagagaaatgcgtggctacgagtgggacttcgaaaattcag

SEQ ID NO: 43308 - DNA, 177 bp, Glycine max
  Peptide Sequence Number=SeqID_134993
gggagaagcttgccgcccagctcgcccaggcgagcaaggttgcttcctccagaagcaacagccctctggaggaatcttttggagggcccaggcaatcatgaaactcagctccaaactcgaaagtggaggacacatgaacagccctaagcaagaacattcatgtggctccgaaaaagg

SEQ ID NO: 43309 - DNA, 252 bp, Glycine max
  Peptide Sequence Number=SeqID_134994
atgaggcgggtcattacattagtggtatcagagccagtcaaaccttttcggccatgtatattgggagtgatggctagacgaaatgatcgtgcgatagctgatgctctccaagccttagctcaggctataggaaatccaaataggggagaagctgctggagctgttgagtaccaagggttggaccacttccaacgaaacaatcctcctgctttcaataaggatacaaccctgatggtgctcagaattggataa

SEQ ID NO: 43310 - DNA, 282 bp, Glycine max
  Peptide Sequence Number=SeqID_134995
atgaaacaagtaacaactcaaatgatatgtatgtacaaaacaaaagtcaatcaaaacgaaacaaacgttaacaaattgggaatcccacggtcatgtggctccgcatgccaccagacccttgggtcacgcatttcgtttctaaacgaccatttagaggaaacactgggtccaacaaagataggagaaaatcactcaaagtgtatcaatctcacacggtgcgtggcgagaaagtcgctagcgcacaggattttgtcggcaatcaaagggagaggaccactttag

SEQ ID NO: 43311 - DNA, 824 bp, Glycine max
  Peptide Sequence Number=SeqID_134996
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcgtgtgagccatcccatcttttctggggatccgtcgtcgacgacgccgttttgaatctcccacgtgtcgcctgtccagtcctccaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43312 - DNA, 222 bp, Glycine max
  Peptide Sequence Number=SeqID_134997
atggctaaagagccaagaagagtaaccctggaggattattcaagttctactgttccacaatttttcactagtattgcacaaccaaaagttcaagctcgtacaattacatatcctcattctttgatacaactgattcaaaataatctgtttcatggtctgcccaatgaagacccttatgctcacttagccacctatatagagatatgcaatactattaggttg

SEQ ID NO: 43313 - DNA, 213 bp, Glycine max
  Peptide Sequence Number=SeqID_134998
atgcagactcgccagctgttctgcactcttgtggggataagctcatccctctcattcttgatcactgtagatgggctaatactaggaatgcctgctaaagtccatccaatgactttcttgtgcttcttgagcactaacaacaacttctcctcttactcaacagcaagggaggcagagatgatcactgaaaatttttccttttcttctaagtaa

SEQ ID NO: 43314 - DNA, 575 bp, Glycine max
  Peptide Sequence Number=SeqID_134999
tgctacacgccttcacctttagaggactacacgtcctcgcctttagaggactgcacgtcttcgccttcagatggctgcatgccctcactttcagagggatacacaccctcaccttcagaggactgcacgtcctcatagggctacacgccctcacctttagaggactacacgtcctccccttcaaagggctacatgccctgacctttaaaggactgcaaatcgccgtcttcagagggcgacacgtcctcaacttcaaaggaaggcacgtcctcaccttcagagggctatgcaccttcaccttcagaggactgcaagtcgtcactttcagaggactgcacgtcctcgtcttcagagggctactcgtcctcaccttcaaaggactgcacattctcaccttcagagggctacacgccatcgtctttagaggactccacgtcctcgccttcagaggactgcatgtcctcgccttcagagaactacatgtcctcccctttagagggacacacgtcctcgcctttagaggacttcacgtcctcgccttcagaggcctgcacaccgtcgtcttcaaagggtga

SEQ ID NO: 43315 - DNA, 655 bp, Glycine max
  Peptide Sequence Number=SeqID_135000
atgcagccgggcattaccctgcgcgacctggttcacgccattccgctgtatgctatcaagcagggcctgctgaccgttgagaagaaagggaagaaaaacatcttctctggccgcatccttgaaatcgaaggtctgccggatctgaaagtcgagcaggcatttgaactgaccgatgcttccgccgagcgttcagctgcaggttgtaccatcaagctgaacaaagagccgatcgttgagtatctgaactccaacatcgtcctgctgaagtggatgatcgcagaaggttacggcgatcgtcgtacgctggagcgccgtatccagggcatggaaaaatggctggcggatccgcaactgctggaagccgacgctgatgcggaatacgcggcagtgatcgacatcgatctggcggatatcaaagagccaatcctgtgcgcaccgaacgatccggacgatgcgcgtctgctgtcagacgtgcagggcgagaagatcgacgaagtgtttatcggttcctgcatgaccaacattggccacttccgtgctgccggtaaactgctggacagccacaaaggccaactgccgactcgcctgtgggtggcgccgccaacccgtatggatgccgcgcagttgacagaagaaggctattacagcgtgtttg

SEQ ID NO: 43316 - DNA, 639 bp, Glycine max
  Peptide Sequence Number=SeqID_135001
cggcgtggggctggaagggtggatcgatcgcctggtcagcgcttcgggttataaagggcaggtgatcaccgcttcacagggcatcagcacccgtcagatggaagaggacggcaaagcgattaccgatcctcacgcctggaacagcatgaaaaacggcgtgcagtacgccaccaacgtgatgaacgccctgattgccgccgatcccgaggatgccaactattttcgccagcgcggggtcgaatacattcagcaactgcaaaagctggacctgtgggccaaaacccagttcgccgcagtgccgccacagaaacgtaaagtgctgaccagccatgatgcttttggttactttgggcaagagtatggcgtcaccttccttgccccggtcggattttccaccgaggccgaagccagcgccagcgatgtggccggcctgatcaagcagatcaaacaggaaaaggtcaacgcttactttatcgagaatcagaccgatccgcggttggtgaaacagattgccgccgccaccggcgccaaggcgggcggcgagctgtaccctgaagcgctttcccgcgcgggcggcccggcggccacctatgaacaggcgttcaaacacaatgtcgacgcgctgctgagcagcatgaa

SEQ ID NO: 43317 - DNA, 235 bp, Glycine max
  Peptide Sequence Number=SeqID_135002
atggaggattgccttgagcgtccgcatttaggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 43318 - DNA, 345 bp, Glycine max
  Peptide Sequence Number=SeqID_135003
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattccaaactcgaacgtggaggacacatgaacagcgctaggcataacattcatggggctcctaaaaagggggagaatggaggattgccttga

SEQ ID NO: 43319 - DNA, 766 bp, Glycine max
  Peptide Sequence Number=SeqID_135004
gcgggtttcgcggatgcgctgcaacacgccttcggagtggccgtgcgaggagtcgatcagcagaacgtcaacgcctgccgccaccagcgcgtcaacgcgctcttcgttgccggcgccggcgccgaccgccgcgcccacgcgcagacggccgtgctcgtctttacaggcgttcggtttgcgttccgctttttggaagtctttaacggtgatcatgcccagcaggtggaagctgtcgtccaccaccagcgctttttctacgcgcttttcgtgcatcttctgcagtaccacgtcgcgcgcttcaccttctttcacggtgaccaggcgatctttcggcgtcatgaccgcggtgaccggctgggtcagatcggtcacgaagcgcacgtcgcggccggtgatgatgccgaccagctcgttgtcttcggtgacgaccgggtaaccggcaaagccgttgcgcgcggtcagctctttcacttcctgcagcgtggtggatggggtaacggtctgcgggtcggtgactacgccgctttcatgcttcttcacgcggctgacttcttcagcctggcgctcgatggacatgtttttgtggatgaagcccaggccgccttcctgcgccagcgcgatggccaggccggattcggtaacggtatccatggctgcggacagcatagggatgttcaggcggatggttttggtcagttgggtgccgagctctgcggtgttaggcagaaccgtggagtgggctggaaccaggaggacgtcgtcaaac

SEQ ID NO: 43320 - DNA, 511 bp, Glycine max
  Peptide Sequence Number=SeqID_135005
atgggtgaagtagaggaggtgcaagagcagatgaaggccgacatggaggccgtgaaagagcaaatggccacaatgatggaggccatgatgagcatgaagaagataatggaagccaatgcggttgcagttgccgctaccagggctgctgctaagtacggacgaccccatgatgtgcaaattcaaaacgagcacgccttcccgccacatggcttgcctcccaactatacgccacccaatgtggcgtacactcccaatgagaatgtcaataactccaccttgctcggatatgccactgaagggcaagcagttggtggtatacccccaaacactttggagggccctcagtttcgcccacaaccacaacccttgcattttgcggtgggaagagcccctcctactatggctgaaaagggaaaggtggatcatctaaaggaaaggctcagggccattgaaggaggtgaagattatgcctttgctaacctagaagagttgttcctaatacccaaacatg

SEQ ID NO: 43321 - DNA, 342 bp, Glycine max
  Peptide Sequence Number=SeqID_135006
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcacttccttggtttttgctagttgccagttggatagcaagatcgcttga

SEQ ID NO: 43322 - DNA, 200 bp, Glycine max
  Peptide Sequence Number=SeqID_135007
ggttcccggtatcaacagggacaccaggacttatttttttgcgaagtgatcttccgtcacagtggcttctgtttctatcagctgtccctcctgttcagctactgacggggtggtgcgtaacggcaaaagcaccgccgaacatcagcgctggcaagtgtagcggtcacgctgcgcgtaaccaccacacccgccgcgcttaa

SEQ ID NO: 43323 - DNA, 220 bp, Glycine max
  Peptide Sequence Number=SeqID_135008
gggcaggatcatcttgagctaccttctggggtggggacaaaatgtggacagcagaaaccaatcaaggtacttagggacggatgcaagtggggatggggtcacgaccgaccaatcgttgccccttctctgcgagaaacaagcagagaacgtcgctgcaaggcagccccgtatcctttgtattcgcggttttcttttactatttgtttgttttaaaaagtaa

SEQ ID NO: 43324 - DNA, 300 bp, Glycine max
  Peptide Sequence Number=SeqID_135009
atggatgacgttgctgctcagcaacatcctgcccagcgatcacaattccgacctccctctgccgaagtgtcagctggtatgccgcctaccaggcaacctctagacccagataagcctaacagggccctgggttttccagcattaatcataggtctctgccagtcgttcggggttcctgtcacacctagtaaggtgattcgactgtcgatcacccgagctttcatagagaagtattgcacgcctagacaggcacagggtggtgacctgcaggccccaaacgcaccaccgccacctccttag

SEQ ID NO: 43325 - DNA, 402 bp, Glycine max
  Peptide Sequence Number=SeqID_135010
gggggcggagcctatggaaaaacggctttgccgcggccctctcacttccctgttaagtatcttcctggcatcttccaggaaatctcgcgccccggtttcgtaagccatccgctcgcgcatcgaattccgcagcccgaggaggagtcagttctagagcggccgccacgcggtggctccaattcccctatagtgagtcgtattcacatattcatgctggcccgtcgttttttctcctgccacaacgctcactggaacaccctgccagttacccaacatagtaatcgccagttgcacacatccccctttacgccagctggcaatagcgaagaggcccgcactcgatcgcccttgcccttaacagttgcgcaggttcctgaactggaaatgggacgcgccctgtag

SEQ ID NO: 43326 - DNA, 911 bp, Glycine max
  Peptide Sequence Number=SeqID_135011
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccatgacttcaggtggccaagtgagcataagggtcttcattgggtagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43327 - DNA, 275 bp, Glycine max
  Peptide Sequence Number=SeqID_135012
gtgaattagttcctttggacctggaagttgaagcaacttgccaaaggaacagagccgaacgaagacaaaaaatattacaaaacagaacagtagtttccattttggcagacgagtcccaatcctctgaatcttcatcatcctattctccatcattaagggaatctgcaaccaatttgcccgaagccatcattatggccaatgaacaaccgggacgtgtgacccttgaagactattccagtagttctgtgccgctattctttatcagcattgcgtga

SEQ ID NO: 43328 - DNA, 1314 bp, Glycine max
  Peptide Sequence Number=SeqID_135013
atggagcaggatattcttctgctagggggaattatgcagtccttccaggacatatattataaggcttaccaggcagacatagtaaataagcttacaatagcctcactggctctaagtctatttcgtgaaaaatattacgattacaataagcatcgtatccacatccctaatcagaatgaggatacatttattcggcgtggatattacggtgggcataccgacgcatacttaccatacggtactaatttatactattatgacgttaactctctctatccttttgttatcaaggaattctcaatgcctgggggtacaccagtctggcattctgatttagaatatatgacattagataacatgtttgggttcattgaagcatatgtagaatgcccaaaaagtataaataaaccatttcttccctatggggataataaggatggcactcttatctttcctacaggcacctttgttggggtttactatagtgaggagctcaagtatgctagagacataggctacactataataccaatttgtggatacctcttcgaggagatggaaagtccattcaaggactacattaattctctctttgaaagcagatccaatgctaaaaagaagggaaataacgccctatcttttgtatataaattactaatgaactcgttatatggtagatttggcatcaatcctcaaagcacaaaaaccgagatgtgcaataaatctaaacgtgaccgtatatttagacgccctgagtttatagacgatgtctttattagagaggatctatacatggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaatccacttccggaggaagatgtttcctcttctgtattaggtaaatttaaattagaagataagatcttggagggattctttttagcacctaaatgctatagctataccacagaagagtcagatggcaataagaaggtctataagtacaagggaccgggtagaaatgttataactccagaatggtataaagaacagtacgccgacccttcccgaagtctgataaagaaggtaacttatcaatttcgacccgattggaaagaactctcggttaaaaagaaagagagtacaaccactcttagaactctcagtaactccaagagaatacctttctttaatgaaaaaggtaagtat

SEQ ID NO: 43329 - DNA, 612 bp, Glycine max
  Peptide Sequence Number=SeqID_135014
atgtggggtgctaatcccttccccgtgcgtaaatacacctcccgaccctttcacttaaaagttcgtagatcgcgtcttttccggtttttccgacattttcttcaaataaacgttggtggcgactccgcgcgtattcctttcgtgcaacacgcttcccgcgagtctggcgtcgccctcccgccgaagggtaggttgcgacaatgcttacccaaggttttgggaaaatttacggaagccccggaaaccatttttcaaaaacgtggaggagttttccgcctagttgcttcctccttaagcaacccaacttccaaaatgttccggaagggcctaggcaatctagttcctctggacttggagattaaagctacgttaagaaggaacagagccgagaggagaagaaaattgctgcaaggcaggatagtagtgtccattcttgaggaagaaactcatttttctgattctacatcatccgattcaccatcatcaagggaatccacgacttatttacctgaagtcgtttccatggctgatgaacaccagcaaagagttacccttgaggactattcaagcagttcagtgccgcaattctttaccacgcattgcacgtcctga

SEQ ID NO: 43330 - DNA, 189 bp, Glycine max
  Peptide Sequence Number=SeqID_135015
atgggtcagattcggtttctctgcagtgtggcgattgggctcgacggtgctgtttcggtgttgtttgcggctgataggaggagaatagcggtgctcggtagtgatgggcggccgcaggccaatgcaggggtcattggaaacggtggagaggaagggagagtaaaatttggtggggaaggtgtacaatag

SEQ ID NO: 43331 - DNA, 189 bp, Glycine max
  Peptide Sequence Number=SeqID_135016
atggtcattctgggccctttgtcattcaggagcagccagtcgagtgataaacgcgcagagacaaagtatggtcattctgcaccctttgttattcaggagcagtgtgtcgagtggtgggcggagacaaattatggtttcgctggtggggagattgaccggccgaatggtgtttcgctcgaacaaaattag

SEQ ID NO: 43332 - DNA, 108 bp, Glycine max
  Peptide Sequence Number=SeqID_135017
atggctcaacgcatcaatgaaggaagaggtgtagaaaaaggtgctgcttgggtaagcccagttcaggtggtaccaaggaaagggggcatgacagtcgtttgggaatga

SEQ ID NO: 43333 - DNA, 198 bp, Glycine max
  Peptide Sequence Number=SeqID_135018
atggttgtgaatgagtgtgtgattgatatttgtagtgatattacttgtcatgaaggtgaggcccaaacggattcttcggagtctaggccttgggatactcggtttgagtgctcctttaagcccatgttgatcccatgtggttggggcattctcgcaaaacagagtaaccctgactggtcaccttatgatgttacttag

SEQ ID NO: 43334 - DNA, 246 bp, Glycine max
  Peptide Sequence Number=SeqID_135019
gctgttatcaaagctggtcagtacgcttatcgtgaccgtcgtcagaaaaagcgtcagttccgccaactgtggattgcgcgtatcaacgcagcagcacgtcagaacggtatttcttacagcaaattcatcaacggcctgaaaaaagcctctgttgaaatcgaccgtaagatcctggctgacatcgccgtattcgacaaattagcgttcaccgctctggtcgaaaaagcgaaagcagctctggcataa

SEQ ID NO: 43335 - DNA, 743 bp, Glycine max
  Peptide Sequence Number=SeqID_135020
atggtgaaagttggaacctcttacgtgccgatcaacgtctcattttcgccaaaagttggcccagggcttccccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttattgtgcaatatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43336 - DNA, 693 bp, Glycine max
  Peptide Sequence Number=SeqID_135021
atggcttccaacttccagcagtttagcgccagaaatgatgctatagtcatcagagaagtgcatgaggtagctacaaactcagctgcatcatccgaaactaagaatcttgaaggcaaactagatgcattggttaacctggtaacccagctggccttgaatcagaaatctgtacctgtcgcaagagtctgtggtttgtgctcctctgctgaccaccatacagacctttgcccttccatgcagcaacctggagcaattgagcagcctgaagcttatgctgcaaacatttacaatagacctcctcaacctcagcagcaaaatcaaccacaacagaacaattatgacctctccagcaacagatacaaccatggatggaggaatcaccctaatctcagatggtctagccctcaacaacaacaacagcagcctgctccttccttccaaaatgctgctggcccaagcagaccatgcattcctccaccaatccaacaacagcaacagccccaaaaacagccaacagttgaggcccctccgcaaccttccctcgaagaacttgtgaggcaaatgactatgcaaaacatgcagtttcaacaagagaccagaacctccattcaaagcttacctaatcagataggacaattggctacacaattaaatcaacaacaatcccagaatcctgacaagctgccttcttaa

SEQ ID NO: 43337 - DNA, 2143 bp, Glycine max
  Peptide Sequence Number=SeqID_135022
gtcagtgtggcggcgaactggtggtgatgtcaccgggcggcggtgcacaggacagcgacggcaacgtgctgatcggtaactttgcgctgttcggctcgaccggcggtcgtctgtttgttcagggccaggccggtgaccgtttcgccgtgcgtaactcgggcgccaccgcggtggtggaaggcgtcggcgacttctgctgtgaatacatgaccaacggcgcgattcttaacctcggcacctttggtaaaggtttcggtaacggcatgagcggcggcttcgcctatcagtacgatccgtaccgttccctggccgcgcacgccgccggtgattcggtgctgttcggctccatcgctgacgaagacgaaatggcgcaggtgcacaagcaggcagtgctgaccatgctgcactggcacctggaagccacccagtcgccgcgcgcggcgtggctgctggagaactgggaaaccgagtgtcagcacttcgtttacgtcatgccgcgctcgctgctgctgtatcaggacggcggcgagatcctgaaagcgaaaacgcgtaaggatctgctggaagagctgtccacgtcgctggccgcgcatcaggttgccaagttcaaatcagcctggcgagcgggcaaaaccatcgccgacggtgcggtaccggcctacggcgcgaccgatacgcaggagatgtttgttctgctgaataattacaccgttctgagcttcgcgcagcagctggcgctgggcaaactgccgaaaggcacagcggtggaagatgcggcagtcgagaaagcggttcgcaacctgctgatgaccgaagatttcgcgctggtcagcaagctgcagcgtcatgcccgtgcggccattgagaactacagcgatgatgagctggcaagcctgatcgccgccaagcgtatgtcggattacaaagccgcgctgacgcagcgcaacattcgctccatggacagcctggcaacctatggctggatcatttatcaggacgcctgcaaccgtgaggtgctgggccatctgcctgattttgaagagctgtttgcacgcgctgcactgccagagattgccgccgcgattccttacattcctgaagacgcgccgtttaacggcgaacagaaatactggctggcggggtttctcgccggtctccactcgcgcctgctggtattagaagataagcagaccgcaccggcagcgggcgccagcgccaccacccagctgcatattctgtttggttcccagaccggtaacgccgaagcgctggcgcagaccgcagccaaagcggcgcgcgctaaaggcctggtgccggtagtgcaggcgctgggtgaagtggatctggatgtgttcgccaccatgcgtcatgtactgatcgtcacctccacctacggcgaaggcgaaatgccagacaacgcacagctgttctggcaggccatctcagccagcaccgcgccgcgtctggagcagatgcactttgccgtgctggcaatcggcgataccggctacgacggtttctgccaggccggtaagttcattgatatgcgcctggagcagctgggggcgaaacgcgtggtggatcgcatcgactgcgacatcgattacgaagagccttccagcgagtggattggcagcgccatgccacagtttgccgcgagcgcgggcagcagcggcacggtgctggagagcgcgccggaagcgccggtgatcccgggcagcaacaagcaaaatccgtacgcggcggcgctggtgaccaataagcgtctgtccggcgagcagtccgccaaagatatccgtcacttcgaatttgacctgagcgacagcggcctgaaatacgaagccggtgatgcgctgggcgtgatcccggtgaacgatgccggtctggtgagcctgctgctgagcgagctgaaagccgactacgaaaccccggtgccgggctttgaccgtaacctcggcgatctgctgacctatcagttcgagatttctgagccgtcgcgcaagctgattgagtgggtcggacagcacaccaccaaccaggaactgctgcacgtcctgcagcacgacgataaagacacgctggccaactggctgtggggcaaagatacgctggatctgctgcagctcgagctgaagcgcagcct

SEQ ID NO: 43338 - DNA, 441 bp, Glycine max
  Peptide Sequence Number=SeqID_135023
atgaccatgcataatatgcaatttcagcaagagataatagcctccattcaaagtctgacaaatcagatggggcagatggctactcagatgaaccaagctcagtcccaaaattctgacaaattgccttcacaaactgtgcaaaatccgaaaaatgtgagtgccatcaccttgaggtctagcaaccaaattcaagtgcctccaccagtagcaacacctgcacctgaacctgtcaagcttcattctacacctgaaaaaaaggatgagacagttgcacaaaagagaaagcttcctaacaaaaaatttcatgcaggtggaccttcttctagtaattctgacttacagcagcctcctatccctcttccattcccacctagagaatttccaaacaaaaagatggaagaagcggaaaaggaaatcttggagaccttcaggaaagtagag

SEQ ID NO: 43339 - DNA, 540 bp, Glycine max
  Peptide Sequence Number=SeqID_135024
atgggaagttcgggttccggaaagtctaccctccttaatattataggcattctggatgaaaaggattccgggatttatgagctggacggtgttcccatcgagcatttatccgaagtaaaggctgcagaatacagaagatataaaacggctttagaaaatgttgctctccctttatattatcagaacgtaccccgaaaagaacgtaatcagatcgccatggaatatctggagaaagtaggactcgcccaatgggcaacccatcttcccaatgagctctccggtggacaaaaacaaagggtggctattgcaagggcgctgatcacaaatcctaaagtggtattggccgatgagcctacaggtgccttggattcaaaaacaacccatgatatcatgaaattgctacaggatattaataatgaaggaaaaacgatcattgtagtaacccacgaacctgatgttgcagcacaaacaaaaagaaatgtgattttaaaggatggagttatcgaaagtgatgaatttatcaaacaggttgttctataa

SEQ ID NO: 43340 - DNA, 495 bp, Glycine max
  Peptide Sequence Number=SeqID_135025
atgtttggagctttaatgggcaacaatggtggaggagaaagggagaagaaaagcaacgtgggagtgaaaagaagagcttttgaattttctgctgaaggaagagagagaatcacttgccacttgtcccattttgagtggaacaaaaaggggcccactttttctcttggtgtgacttcatactcagccacaaggagggaaaaatttgaccttttgaattctaaaattctgcctcggtctgcgtgccacttctctggtagaaatttccaggatgtcacatcgcaacctacccttttacgggcgagcgaggcgaagctcacgggtgcgtctcccaaaggaggaaaatgcgcggagtcgccaccaacaattatttgtggaaaacgtcagaaaaaccgaaggaaaccggtcatgaagaatattccagattcgggagttgtatttacgtttgaggaaggtattagcacatctcacgtttgtcccaaaggacaacagccttag

SEQ ID NO: 43341 - DNA, 314 bp, Glycine max
  Peptide Sequence Number=SeqID_135026
atgtttggtcgaaggtatagtctgcaagcttacccctatggcttgcctccggacttcactccccgcgccgccccggaagatttaagccaagcccctactttcgaggggcaactcccaccttatgacgactatcccgggcaagactatgaggaacgagatacccatcttggacccctgctccacctcaaagatccgtccccccatgaactaccccaaccgaacatagtctgccatatcccggattcacccacacccgtaaaagaatctgttaccttcgcgaaagataagggaacgattgaggcgcttgaagagag

SEQ ID NO: 43342 - DNA, 243 bp, Glycine max
  Peptide Sequence Number=SeqID_135027
atggcccgcacgaagaaaactgatcagatgacatttgaggcagcaaaggaaattgctaacaagattgtaaaacaccccggttgtgtgcgtgctgctggagccggtgcgatgatcaagcaatactttggaccagctccaaggacctcccgcatgttttcctccatggctcctgaagacctagagcagctgactcaacaaatcaaggaccagctggaggagtcgatcatagaaaaagtgacttga

SEQ ID NO: 43343 - DNA, 434 bp, Glycine max
  Peptide Sequence Number=SeqID_135028
atggagagaagtatgatagatgctgccagtggtggagcccttggagacatgacccctgctggagccagaaatttaattgagaagatggcttcaaactcccagcaatttagttccagaagtgatgatattgtcattagaagagtgcatgaagtagtcacgaattcatcaggtgagactaagaagcttgaaggtaaactagatgccttggttaacctggtaacccaactggccatgaataaaaaatctgcacctatcgccagactctgtggtttatgctcctctgccgaccaccacacaaacctttgcccttctgtgcaacaatatgaagcaattgaacagcctgaagcttatgctgcaaaaatctacaatagatctcctcaacctcaacaacaaaatcagccacaacagaataattatgacctctccagcagcag

SEQ ID NO: 43344 - DNA, 115 bp, Glycine max
  Peptide Sequence Number=SeqID_135029
cctttgtttgaccgcttcaaggtactgggcaccctttgttacacaatacgtgaagttccgtgacatgccggagatcaaaaggaagcattgttacgcaatccgtgaggttccgtaa

SEQ ID NO: 43345 - DNA, 309 bp, Glycine max
  Peptide Sequence Number=SeqID_135030
atgacacggcagattggggggtaccttactttattacaggagcactttccgagtgtgcatcagtgcgtcatcgatgatgcgtatgaggagacgtccccacgtgcctcccggtggctgacgacaaaggcatatatgaagggaattgcaggagtgccatactgggcatgttgtgatgctttgatagtcacaaacgtatctgcggattacatggagtggtttttccaaatatctcacccattcatcataccgacccaggcaggtgatcagcccagacatccacctgccccagaccatgaggactacatctag

SEQ ID NO: 43346 - DNA, 369 bp, Glycine max
  Peptide Sequence Number=SeqID_135031
atgggtgaagcagagaaggtgcaagagaagatgaaggccaaaatggaggccataaaagagcaaatggccacaatgataaaggccatgatgagcatgaagaagataatggaagccaatgcggcacatatctctcaaaccatgggaaagacacatgaaattccccaccacaatctagctgacttcgagccttggctcggatatgccactgaagggcaagcagttggtggtataccctttgaaaacactttggagagccctcagtttcgcccacaaccacaaccattgcatttttgcggtgggaagagcccctcctgctatggccgaaaagggaaagacggatcatctaaaggaaaggctcagggccattga

SEQ ID NO: 43347 - DNA, 366 bp, Glycine max
  Peptide Sequence Number=SeqID_135032
atggacagagctaggttgatctttggcctagtctctcgcatggacatgaacataggagctcttattttttgccagatgacttctatagcccagtctaacacttctagacttgggtttcctgctctaatcactgccctatgggctagaaaggagaggacgaggccagctgagcttccttccatatctgcagctcctactccagcatccacttcagcagctccttcagtcccagctcagagtttacaggtggtggcacctccaggatccattccttccattgagcagtttttagaaagggtagcctggcctggggcccaaccttctcttcacagggaagacgaaggtcccacagcccaggtgccatag

SEQ ID NO: 43348 - DNA, 813 bp, Glycine max
  Peptide Sequence Number=SeqID_135033
atggttagaacgagaggtttacctcgttcattaggtaggggtataggcagaggccgaggtggacaggatgagcatcatccagatgatgttccccggcggagtaggcctactgcatccgtccataggcaacaggtacgtgttgctgaggaggttgttgatatgactgagaatgttcctccgatgactacggacgtacctgcagctggtgtagagggcttagttgctaatgatgttgctacgggatcagttgttgatgatgctgttgtgggattccctggtgggccacgtgacccatcaatgctgacttcctttcctgatcatgttgcacacaacatatggactagagaggcgtacatacgtcctcacttcgaagggctagttgctgccacaagattaagccctttgatcgggtgctcagtagtcaccgacgatccgagacttatatatgcgcttgtggagaggtggcacggggagaccaacaacttccaccttcccgtgggagagctgacgatcacactagatgatgtggaggaggtggaggaggtgatcatcttgttgatggagttgctcgaggtcttgggtcaggaggctagagctgagactgcacaggcgcgtgggacatatgtacgcctgtcatgggtatgggatatatatttgagtagatgtgaggcccgacggtggattgtagtagctcgtgcttatctcctccacttggttggttgcactcttttcgctaacaagagtgcaacacatgtccatgtagtgcatctggaggcttttcgagacctgggtgagagtgggaggtatgcctag

SEQ ID NO: 43349 - DNA, 195 bp, Glycine max
  Peptide Sequence Number=SeqID_135034
atggaatgtgatactcatttcccgtgtgttgtaagttgtgtttacaataacccgaccagtgttgatcttgagaaatgtgttggcagtgttaaagagaaagttatatatgtgaggggtagagggtgtcacagtgactcttcggagtgtaggccttgggggtcaccgggtttgagtgctcctttaagcctatgctga

SEQ ID NO: 43350 - DNA, 405 bp, Glycine max
  Peptide Sequence Number=SeqID_135035
atggctgctagtgacattgccattttgagagaccgagcccacatttctaccaagaagagcttattggagctaacctcacaggatgctctgttggcacaaaacaagttgctatctaagcaactagaggcatttacaaaaacactcagatgtacaatttatggtggagctcatgaatctggatgttgtatccctaatgaagagaaaattgcacatgaagtctattatatgggaagtcagcccagtggcaaaatcaccctgggtggttcatctacaaggccacaacagcagatgccaagtctctatgaccgaacaacgaagctggaagagactctagctcaattcatgcaagtgtcaatgtctaaccaaaagagcaccgagtttgcaattaagaatctggaagtccag

SEQ ID NO: 43351 - DNA, 413 bp, Glycine max
  Peptide Sequence Number=SeqID_135036
gtatgccacctaccaagcaccctctagacccgaataaatctaacagggccttggggtttccagcattgatcacaagtctctgccagtcatttagggttcccgtcacacctagtaaggtgattcaaccgccgatcacccgggccttcattgagaagtattgcacacctagacaggcgcagggtgatgcaccgcaggccgcaaacataccgccaccacctcgtcaggctgatccagctgggtcatttggcatggagcggtatttacagcacttggttcgccaacaagcggccaaccacaggggtaaggtgcagatcaatgagtgtctttaccagctcagcctcagtcagcagagccagggtttcgctccttttgcatgccctactccagatcagttcagggctgaggttgcatga

SEQ ID NO: 43352 - DNA, 279 bp, Glycine max
  Peptide Sequence Number=SeqID_135037
atggtccatgacatcttcgtcaaggtgaaactggaagtaacagggacatcgacagccctaaatgtgtttggcagtagacgaaacagcgatgtaacacgatccatcttttgccccaatttttttaagatggtcacttccatacttcaacttgactcgatgaaccttttcgtaaaagcacgagcatggttcaaccccataacccagggaatgaaatgggtttatgatcccaacatggttggctcatggtacctaacacatgcaactaagaatgcatcatga

SEQ ID NO: 43353 - DNA, 548 bp, Glycine max
  Peptide Sequence Number=SeqID_135038
ggtttgtagctcgggatttcgggtttgtccacgatccctggatcggagatcaccgcgtagaccatcggcgccgaggggaggaacgtggtggtcaagcgtgccatcggcgatggatgcttcgacagggacaccaccctgtccttcccgaagtatatgcgcttggagagcttcagcccatcgtcgaccactttggagaaatcctcaggccatcgcagagagaagaaaattgcagttttgtgttgtgcccattgaatgtccttgatgttgataccttccttgacaaattcataaagtggactcatttccctcaacttctccacctgttgaacagtgagttcaaccatggagcaaatcatctactggtttctttgctgatggcgaaaatgcatattcctttgggtcctcgggtttctactctctgttcttcgacaatgacaacattctctgtcttctttacgatggtcttgaagtttctgccattactggccacatccatggctggcatcttggaaagctcattaggacgcagtgcatgctcgacggagtag

SEQ ID NO: 43354 - DNA, 183 bp, Glycine max
  Peptide Sequence Number=SeqID_135039
atgccacttcaaggagaagatgagtcaagaagaagctcaccaccattggaagccatggataagagtttgaaggtaggagaagatgagtacagggagagggagagaagaggcacaaaattttgtgcctctaatgagcccactaatccaaaatcaagtccaagattctccactaagtgtgcttag

SEQ ID NO: 43355 - DNA, 540 bp, Glycine max
  Peptide Sequence Number=SeqID_135040
atggagaggagtatgattgatgctgccagtggtggagctcttgattcatctttatctgctgaaaataagaagcttgagggaaaacttgaagccttagtcaacctagtaactcagcttgccataaatcagaaatctgcatctgcacctgttattgttgcaagagtctgtggtctatgttgcaagagtgccatcaccttgaggtccggcaagaaaattgaagtgcctccaccagtagtagcacctgcacctgaacctgtcaagcttcattctacatctgaaaaagaggatgagctagctaaacaaaagagaaagcttcctgatcatgagggagctaacaaaaattttcatgcaggtggaccttcttctagtagttctgacttgcagcagcctcctatccctcttccatttccacctagagcaattccaaacaaaaagatggaagaagtggataaaaagatcttggcgaccttcaggaaagtagaagtgaacatacctctactagatgccacaagcaaattccaagatatgtcaagtttctaa

SEQ ID NO: 43356 - DNA, 141 bp, Glycine max
  Peptide Sequence Number=SeqID_135041
atggaggctgccgagttctgtaccaagtccgggattgaagagttaatttgtgagtttttgggacttgagtcttttgtgagccaccttgatggtaccctaacatcaagtgttggacctatgagtgtgagtgagagggagtga

SEQ ID NO: 43357 - DNA, 421 bp, Glycine max
  Peptide Sequence Number=SeqID_135042
atggcggaaccatcaaagaagcgaaagggttcttcgagtcgaagccaacgacattccgagactcaagaaacgcaaattccctcctccatttcctcttcctcattgttctcatctgaagaacaacggatacggtacacaaatattttctcttctcattccattattgatccaaagttcattgacatggatttcttttccaatgagagttttgaatgcattcaggcatttgagaactccaatctcattcctttcatgtctttaaaattgcctgtttattatgaattagttaaagccttctattctaatcttaaaattcaagaaggcactttgatttctgaagtttatgggataaaaatggtcattgaccaatccctattctatgacttgacccaattatctagtgaaggtgtaccatttgaag

SEQ ID NO: 43358 - DNA, 243 bp, Glycine max
  Peptide Sequence Number=SeqID_135043
atgataccgcgagcgcacgctcaccaaggcggtaatacggctccgccccccgagcatcacaaaaatgcgggaacgctcagagtcaaggtggtcgaaacccgacaggactataatagatattgccaggcgttgttcccccaagctccaggcatcgtggtgcgctctccgtttccgaccctggcttaccggattcagcctccgcctgttctcccttcgggaagcgataaggcgagctttacatga

SEQ ID NO: 43359 - DNA, 375 bp, Glycine max
  Peptide Sequence Number=SeqID_135044
atgcgggggtccggggaatttgtccccttcttagatacggcgtctaggggtaacaaaatgccccaacgcacgtttttaagaaggcgacacggaccctccgttggtttgtttacagaagggatcaagacagaacccatatgcaatgcctatgcaaaagacacaatgcgggaattggagtcgccaactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgttctacgaacttttaagtgaaaggttcgggagttgtatttacgcatggggaaggtattaa

SEQ ID NO: 43360 - DNA, 192 bp, Glycine max
  Peptide Sequence Number=SeqID_135045
acttatcaaggtaatccttgtggcgtctaccctgacttatcttccttcaccggaagtggcgtcatccaaaaactctacagcctgtatcaagtgatccgccctgtaagattcacatcatctggtatcagagcttcggctcttgatacagtgggcctcaaacagacaatcgtagcaaaagttatgagcatttga

SEQ ID NO: 43361 - DNA, 276 bp, Glycine max
  Peptide Sequence Number=SeqID_135046
atgacttgtcgttcccggaatttcacaaattgcctaatgatgggtgccaagcacctcacaaggaccaaagaaaggtcgcatgtcatcaagcaaagaatgaccaaacttggtctctgcttgtcatcgggcccgccgcctctggatgacaaaagggtgcggataaccgtaagaatgaccaaacttggtctctgcttgtcatcgggcccaccgcctctggatgacaaaaagggtgcggataaccgtaaggtatctccgcgtatcatgggtgcagaatga

SEQ ID NO: 43362 - DNA, 491 bp, Glycine max
  Peptide Sequence Number=SeqID_135047
atgaggagaaagcgcaacaacgggagtagtgctcacaagtacacactcaccaagaaaataatctccaagttaacacatttcctcatcaaccgattaccaaaggagaaaggcatgaagaccatgagttgtgtattagacatgggtaaaggtaaattggaactaagtgtagaggatcagaagatctcctttgacttatttgaagcaatgaaacacctagatgatagtgagccctgttttgaagaagaaatgttggagcaggagatagaagtaacagcctcgtccatggtattacagactcttgtgcagaaagaatttgactatgagacaaaatgcctagtcagtaaagatggaggggaaattttggcttgtattgaaaagctagatgatccagacgatgagtctattggtcatgtgatgtttgaagaagtggaaaacaatagaccaaaagaaaagcccaaagtagaattgaagacccttctagcgcatctaaa

SEQ ID NO: 43363 - DNA, 207 bp, Glycine max
  Peptide Sequence Number=SeqID_135048
atgaatagcctcctgataccacatgatgtaagctccattggagcttcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctccaaatga

SEQ ID NO: 43364 - DNA, 222 bp, Glycine max
  Peptide Sequence Number=SeqID_135049
atgtcatttttgtggaaatggccccaaggaagcttgcctcaaagagatacaggaaggataaagcggctgaaggaaccagttccgctcccgaatatgacaaccaccgttttaagagcgctgagcaccagtagcgcttcgaggccatcaagggatggtcatttctccgggagcgacgcgtctagctcagggaagacgagtataccgacttccaggaggagatag

SEQ ID NO: 43365 - DNA, 543 bp, Glycine max
  Peptide Sequence Number=SeqID_135050
atggctccgaaaaagctttcctcaaagagatctaggagggacgctgcggctgaagggaccagtgccacccccgaatttgatagccaccgtttaaggagcgccaagcaccagcagcgcttcgaggccatcaaaggatggtcattccacaaagagagacgcgtccagctcatggacgatgagtacacagattttcaggaggagatagctcgccgacattggacatcgctggtcactcccatggctaagtttgaccctgatatagtcttggagttttatgctaatgcttggcccacagaagagggagtgcgggacatgcggtcatgggtgaggggtcagtggattccctttgacgtagacgccctcagccagttcttgggtgacccgctagtgttagaggaaggccaggagtgcgagtttagtcagaggaggacagggacgatgggttcgacgaggaggccattgctcagctattatgcatcccgggtcaggattttgcccggaccgctgcagggaggcgggtgcggatcatgcgcaccagcatga

SEQ ID NO: 43366 - DNA, 225 bp, Glycine max
  Peptide Sequence Number=SeqID_135051
atggaaaccatatctaaaatatttgaggaacttgatgtttgtggtaaagtaactctcaagagtaaacttcgagaaattgcataccctgatcaaaactctatgtgccctcctccgtcaaaggtcaacactaaaggtgcaccgaagaaaccgatgaacaataaccaaagatcaacaaagcatgatccgtcttactgggagtatgttgatgcttttcattctatgtaa

SEQ ID NO: 43367 - DNA, 229 bp, Glycine max
  Peptide Sequence Number=SeqID_135052
ggcacttgataaaatttgatgttgattccctcaacaacttcttggagactctagtggttgtggagcaaggggagagcttaccttcttactccaggttttctagactaaggcctgatcctcaggagcttgcagcccagttgtgtatccctgggaggggatttgttcttaccctaatttcgtccggggacctttgcttgatggcatgcgacctttctttggtccttgtgag

SEQ ID NO: 43368 - DNA, 689 bp, Glycine max
  Peptide Sequence Number=SeqID_135053
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccgggtaactatcgtcttgaggtccaacccggaaagacatgcaaaagcaccactgggcagcagccactggccaggttacctcggttcaaaggagttgggtag

SEQ ID NO: 43369 - DNA, 159 bp, Glycine max
  Peptide Sequence Number=SeqID_135054
atgactaacattgcaaatgtgtcctcgcaggaaatggctccgaagaagcttcgagccaaaaggtctaggaaagatgtcgttggagagggttccagtgcggcctcacaggtagatgtggagttttatggacacagcttccggagtgaggaacaccagtga

SEQ ID NO: 43370 - DNA, 627 bp, Glycine max
  Peptide Sequence Number=SeqID_135055
atgggtcagctcctgcggcaagcttttcgcaaagcttacggtaaaatctgggacctagccacggtagaagtctccatagaggccatttcctccctcgcccagtattatgatcagccgttgaggtgcttcacctttggggacttccagctatcacccatggtagaagaatttgaagagatcctgggatgtcctctagggggaaggagaccatacctcttcttagggttctatccctcattagctaggatttctaagatagtccaaatctcggcgcaggaattagaccatagaaagcaagtcgaaaatggggtggttggaataccgataaaatatttggaggcaaaagcaagaatcttggaaggtaaaggcgaatgggccccattcatagacattctcgcactgttgatcttcggaggagtcctctttccaaatgtggatgggttggtggacctagcagcgatcgatgcttttcttgcctaccatgaccacaaggaaagcccggttgtcgctatgctagctgacctatatgacaccttcgaccgaagatatgagaagagcagtacgaggattgtttgttgtactccagctctttatgtatggttggtttcacacctttttcgccaagag

SEQ ID NO: 43371 - DNA, 276 bp, Glycine max
  Peptide Sequence Number=SeqID_135056
atgacagatgtcgtaccggatgtcacgacatcacgcttcagaacatgcagtattttcgggcaggatgtcctggacattgtatccgacatcgtggatcctgcagcttcaattcttcatttgacttttatcttgccttgtgcattgtgcagcaactccagtattttcgggcaggatgtcctggacattgtatccgacatcgtggatcctacagcttcaattcttcatttgacattttatcttgccttgtgcattgtgcagcccgatcttattccttga

SEQ ID NO: 43372 - DNA, 471 bp, Glycine max
  Peptide Sequence Number=SeqID_135057
atggtggcgcgtgttatgctcaggaacggatttgagcccggaatgggtctaggcaaggactgcctcgggaatgccgacgtggtcgatatcaagggaaatccatacaaggtatggcccggccgtattagccagtgtttcaccagcgctggaatggtgtccgaggaggaggtggccacaatagaggaggagttccctcaagacccaccaagttttgtgcaaccatgtcaccctgattcccaagtggggaactggcgcatgataagccagtcagaagtctataccgctgatttaatatatgagggtcgattctttgaggatcctgacaacgagggtttgacaatcgatttcgatcgagatataagccaaacaataaatgaggaagaggaagaggacgtcctgacaccagagttggagaggctggtcgctcaggaagaatgtgaaatgaagcctcaccaagaagaaaccgaattg

SEQ ID NO: 43373 - DNA, 429 bp, Glycine max
  Peptide Sequence Number=SeqID_135058
atgaagaacatggttaattgttctgatgcgttcaatacttctcaggtgtttgctacccatgatgatgttttgcattgggctcaatatgttgtttatgaaattggatttatggcggtaattatgagatcagacacaaatgatggtattagaggaaggacctcatttgttttaattgattgtgaaaggagtggtcgatatagggctaagaaaaaggatttggatgagaagatcattgttgctgatatgacaaagtcaatggtgaaaccaagaaatattcttttgacgttgaaagagcacaatgtcaatatttatacaacaatcaagaaaatatacaatgcaagaaatgcttaccgttcttccataagagacaataatattgaaatgcaacaactaatgaagcttcttgaacgagatcagtatattcattag

SEQ ID NO: 43374 - DNA, 825 bp, Glycine max
  Peptide Sequence Number=SeqID_135059
atggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgtagggaagctaagtgtgaagtatgcaatcctgcacaggattggcgctgcaaactgggtacccaccaatcatacttccactgttgccacagcattcagaatcctttgctgtcaaattacccattgccttcccaactgtattgtgtggcattatgttgagtcaacatcccaatatttaaactacactgactctgtgaagaagagagaatctcctctatccctgcattacaaactgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagagaagaaaatggagctggaacgcctgatcaaaaggctctcagacagtggcattgatgatggagaagcagctgaggaagaagaagcagctgaggaagaggaagatgcagcagaggatacagaatcagatgatgattctgaagccaccccatga

SEQ ID NO: 43375 - DNA, 192 bp, Glycine max
  Peptide Sequence Number=SeqID_135060
atggcttcagagttatcgactgactcaacggacacaagcaccagttctaactcatcatcagctacaagcaaggacatgatagaagtgccctctttttaccaccaacaatgggcactagaataccctgagtttgtcaacttcagatatgatggaacaacataccaaatcaggctaagacagcatcgagcaaaa

SEQ ID NO: 43376 - DNA, 705 bp, Glycine max
  Peptide Sequence Number=SeqID_135061
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcatgttcatcatgccgtttgtgatggcttccatgtcggcagaatgcttaatgattacaacagtactgcgatgagtggcagggcggggcgtaattttttaaggcagttattggtgcctagaaatattttatctgattaa

SEQ ID NO: 43377 - DNA, 819 bp, Glycine max
  Peptide Sequence Number=SeqID_135062
atggccgagaaaacaaagtcaagagtgaatcaaggtgatggtactgacaatacagatgtggtcggcgaccctccatcccctattgcaagacatctgaagtggaagaaggctagaactaacaaatttgggcaaatggcatctgctgcaactcaagaaatcgcaaacaaaattgatgatttgcaggaacaatcaacacagggaacttttgtcccgcatggtcgtgaagacattctgaacactgccattggccgtccagagcacccaggttgggttcgtgttgctggacatggtgtcactataggtaattactatggaccgcgtggtagtggctccaacacttcttcggcaacgatgaccgcagataaattggtggaaatcataggaagtataaagcaagagttgaggaaagagttggatgcgatcaagagtgagttatcacaaattcaaacgcaacaatcagctccttttagaccgtctatccctaatgtattggttgcacgtgtcagcaccaaagaaagttgtgccgaggctgctgcaaatgttgttgctaacgaccagtctacacttgatgcttctattgtggggttatacattgtgtgtggcgatagtacacaggtggtggctgcgggaaaaatgtatggagttggtggcattatacacaatgttgcttacgcagatgatgtagtaaggatttgtgttgagacaatttatgatggtgacgctagtgtcccatttccaacttccgagattcagtatgtcagggacgcgagtagcacattcattgcatggcccagacatctagtgaagcctataactgat

SEQ ID NO: 43378 - DNA, 644 bp, Glycine max
  Peptide Sequence Number=SeqID_135063
atgggatcaagtcaaaagccttcgcttaaaaagaggttctatcaagtcaaaatcaagagcttagaggtcactagtttacgagagttggggcaattaatgggtcaacttcaacagcaagccttccgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccatatcttttctctgggttctatccctccacgacaagagttgccaaggtagtgaaaatttcagcacaagagttgaaccaggcaaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagcagcgcaagaattgtttgttgtgcactggctctctatgctctggctggtttcacacctttttctccaagaag

SEQ ID NO: 43379 - DNA, 251 bp, Glycine max
  Peptide Sequence Number=SeqID_135064
gcccacttgggccctctggaatattcctccagaaggcggttgcttctggaggaagcaaccctgctcgcctgggcgagctgggcggcaaccacctcccctattttgctataaataggggaggaaagcaagaaggaagagccgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 43380 - DNA, 159 bp, Glycine max
  Peptide Sequence Number=SeqID_135065
atgggattgaggagcagaatcgtcttaggcgatggtcaaataccgggcaaaatccaaagacagagaccaatcaaggtaaacggtaacgcggtcacagtttgttgcgcaatgtcatttcctactttaaagtacttagggacggacgcgagtagagcctag

SEQ ID NO: 43381 - DNA, 264 bp, Glycine max
  Peptide Sequence Number=SeqID_135066
atgggtgcatcatcattcttcgattcggttgctcagaggatgatgcaatacgtctcaccgacgaattgctattttgttgtgattcaaaggcatctacatactcctaataacccttggtctgaaaaactgagtctcctccagaacatatggattgaatcaagtgggatgaaaccaccaacatatttggatagctcacaagcacaaggaagaccaagcatggttctcaccacgcaaacacaacttgagggattcttgccagcatag

SEQ ID NO: 43382 - DNA, 141 bp, Glycine max
  Peptide Sequence Number=SeqID_135067
atgaagcattggatgtcttcaaagtctttaaggatgaagttgagaaccaatgtgaaagaaggaactgaacattattgcgcatggtacggagtatgcttagcaactccaatcttcctaaatctttgtgggtcgaagcattaa

SEQ ID NO: 43383 - DNA, 357 bp, Glycine max
  Peptide Sequence Number=SeqID_135068
atgcaagaggaaaatgaagatgaggaagacttcttactctatgtgaagaagtttcataaattcgtcaaaaatagaagaattgagaggcatcaaaatttcaacaatgggaagagatctcaagaaggttccctaacacttaaatgctataagtgtaatcaacccggtcacataaaggcacactgccccacaaatgagtcatggcccgagaagaatgagaagaaaagtcatgaagaaagaagatctaagaaggcgtatattgcttgggatgacaatgactcatccgatggttcggagaaggagatcaaccttctatccaaggactatgagagcaatgagaacatctctcaagaagattaa

SEQ ID NO: 43384 - DNA, 597 bp, Glycine max
  Peptide Sequence Number=SeqID_135069
atgaggggcaccgtgcatgagcctcaagtgaacataggggccgatcaaaagttctcacccatcgatgtttttaacaaaaaaaggggacaaaccctaggatttcaatggattgatcaaacatcaaacgcctccattgccgtcactccaaaatgggtgaacccttgggtactagtaccctcacctttagaggaccacacgtccttcaccttcagagagctacacgccctcgccatcagaggactgcatgtcctcaccttcagagggctacacgccctcgccatcagaggaccacacgtcctcaccttcgtagggctacacgccctcacctttagaggaccacacgtcctcaccttaagagggctacacgccctcgccatcagaggactgcatgtcctcaccttcagagggctacacgccctcgccatcagaggaccacacgtcctcaccttcgtagggctacacgccctcacctttagaggaccacacgtcctcaccttcagagggctacatgccctcgccctcagaggactgcatgtcctcaccttcagaggagctacacgccctcgccatcagaggaccacacgtcctcacctttag

SEQ ID NO: 43385 - DNA, 199 bp, Glycine max
  Peptide Sequence Number=SeqID_135070
atgcgattgaacacttggagcaaggcgctgctgccgctggtggtgttggcctgcgtctcggcgactcaggttcgggcggcggagagcgataccgggccgatccccatacagctgctgggcaactggcgcgtcagtaaaattgtgccgactcagaccaccggctgctgggatcaacagcaggcgcagagcctgatcggcg

SEQ ID NO: 43386 - DNA, 350 bp, Glycine max
  Peptide Sequence Number=SeqID_135071
attttagagctcttttagagcacaaaatttcgtgctcttctcttcctctcccttcaatcatcttcttcttcctccaagctcatatccatggcctcctatggtgtggcttctcctctctctcttccttctccattctgctgccattcatcttccaagaagcaaaggaatccattgatgaagaagatcctaggcctacaagctcaaatggagcttacatgacaaaagaattcaggcggttagtccttccttcttttggaaaagggagaagagagacacaaaaagaattcaggcgattagtccttattgaattctttttggcaaagggaaaagagaatgaaaaagatgaatag

SEQ ID NO: 43387 - DNA, 477 bp, Glycine max
  Peptide Sequence Number=SeqID_135072
atgattgagttgcgaaaacttctggataggtatcctacatctgaactgaattctttctggttaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaatcctgggtcttgaacagtaattcgattgatgataaagaaagagaattcttggttcagttttctaccttaacgacagaaaaaaggattgatcaaattctattgagtctgactcatagtcatcatttatcaaagaataactctggttatcaaatgattgcgaacaaccgggagcagccaaaaatttga

SEQ ID NO: 43388 - DNA, 330 bp, Glycine max
  Peptide Sequence Number=SeqID_135073
ctcaagaggaaaagtgcaataaaaaggaactcatccaataatttcaaccagaactggatcaatagatccaagaagaagggaggcaactcatccagtccgcatggaaagtcagcagtgtccagtgctggaaccaagcataattctacctcatcatccaacactggtaccagaaacataaaatgcttcaaatgcttaggtagaggacatattgcttctgagtgtgcaaccaggaggaccatgatcatgaaggcagatgaagaaatcaccagtgaatatgaaattagtgaagaagaagaagtggaagaagaggttgaggaggaagctatgtag

SEQ ID NO: 43389 - DNA, 753 bp, Glycine max
  Peptide Sequence Number=SeqID_135074
atgaaccgagtgcgtcattccggcatacagcatcccactccctacttcaacgaagcggaaggcctcaagcgcaaggccaagatcgaccgctacctggacaagaagatggaggagtggcggcagaccatcccgtacgcgtcccacatgaaggacaagaacatcaacatggcgtattaccgccgcacgctgatcgagcacatctggcgcatccgcctgtcgcgcgtcagccagtccaaggcgatctacaagatcgcccagatctcgccctcggcggcgcaggactacgcccactaccaggccgacgagatgctgcacgacaagctgtacatccacgactgcgaggcggccggggtgacgatggaagaagtgctcaagaccgagccgtacctgtcgacgcggctgttcgagggctttttctactacacgctggaacacgagcatcccatggcgccggtggtgtcgaactacctggtcgaatacacccaggccaagctgcagcccgacatcgtcaagaacctgcgcagcacgcttggccatgacatggtcaaggggcaggaagcccatctgacggtcgatacgcgcgacgaccattcgatggagatgtggaagatcctgaaccagctcatcctcagcgaagacgactacaacgccgtcttcaagtacatcgacgacatccaggccatcctggcgatgttcttccgcgagatctacgaggacacggtgcagcggccggccgagaaggcgagcgcctga

SEQ ID NO: 43390 - DNA, 337 bp, Glycine max
  Peptide Sequence Number=SeqID_135075
atggaacatacgaatctggggatcccacggtcatatggctacgcatgcccccggactcttgggtcatgcatttcatttctaaacgaccattttagaggaaacactgggtccatcaaagataggagaaaatcactcaaagtgtatcaatcttgcacagtgcgtggcgagaaagtcgctagcgcacaggattttgtcggcaatcaaagggagaggaccactttaggtcgtgggcaaggattgacatcctcaccctgggtcaaggtttatgataagttgggattttggctcaaggcttgtagaacggctggtcatgatatatgtcagggtttggccagcg

SEQ ID NO: 43391 - DNA, 411 bp, Glycine max
  Peptide Sequence Number=SeqID_135076
atggtcttaaaggaggagttagttgcgtgcttgagatccaagaggagtttggcccgacacttagaagccacagagcaaagcatgctagctataatagggcagtacaaagaagagttaaaccagtctttgactcatgaacaaaaactagtagaggacttcgcacaagcgtacgccgagaaggaagcaagagggagggtgattgatgcattgcatcaagaagcgaccatgtggatggataggtttgccttgaccttaaatggaagtcaagacctcccgcgactactagccaaagcaaaggccatcgctgaaataaaagctttattcccttttataaaaagagaagttctgaaactcatcacattgtctaaaataggccttgaggtggatccaagtgctctgatcattcattag

SEQ ID NO: 43392 - DNA, 270 bp, Glycine max
  Peptide Sequence Number=SeqID_135077
atgaatcgaaagcaaatattcacagttgtcgcaacctacccttcggcgggagggcgacgcgtggctcgcgggatgcgtgttccacgaaaggaatacgcacggagtcgccaccaacgtttatttgaggaaaacgtcgaaaaaaccggaaaagacgcgatctacgaacttttaagtgaaaggttcgggagttgtatttacgcacggggaagggtgtttccctttgctcctacgtattcctcaatttgtgatgaggaaataagacctacgtag

SEQ ID NO: 43393 - DNA, 390 bp, Glycine max
  Peptide Sequence Number=SeqID_135078
atgaccatgattacgaattcgagctcggtacccgcttgttttgactgtgtagactttgcgcctaggactctctctcgaggttatgctttctttgttgccccgggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 43394 - DNA, 312 bp, Glycine max
  Peptide Sequence Number=SeqID_135079
atggttaaagaggaggataaggaggtaagtgtctcctccaagaggttagctaagaaggaaagtcatttttcaataaagacaaacattaaagaaacttcctctcttagacaacctccacatcttctcctttgtaaaaagacacttgttagcattgccacacctattgggcttgaggttattcctcaagtaaaggagttattggacgaaggtttggtttgtaagagcttaaatcattgtgctctgctggtgcccaaaatagcaccactcattgagttggtgaggaaccatgttccttcatgggaagatgcttag

SEQ ID NO: 43395 - DNA, 198 bp, Glycine max
  Peptide Sequence Number=SeqID_135080
atgaagaagatgaagattggtggcttccccctagaactaaaaagaatggtcgagcaggatgaccgagaaatgaagccacaccaagaagagacgaaaatcataaacttgggtgcgaacgaggacaagaaagagccaacattgtttcagtccccaagaaggatgggaaggtgcaaatatgcgtggactatcaggatctaa

SEQ ID NO: 43396 - DNA, 489 bp, Glycine max
  Peptide Sequence Number=SeqID_135081
gtcgacgtgacatacaagacctggaaggaagtccctgttgctcagaaggacttgatatgggaggatattcaggcagaatttgaattccctgaagcttctgacagtaggacaaagaagaaaattcttcagattatcggcgagcagtggaggcagtttaaatctgtgaaaaatacggcattagcaaagagaaatgggcctagttttgtcagacccgcagagacccctcgcgggagatatgatgtgcaaaaaaaggcacaggccatccagaagcaaaacactgccccctacgtgttgtctcgtgggggttatgaatatttagaacaaaagctcatggctgcccagtccggaagcactgagggcgtcattgaccctccatctctcatcagacgccacgtgaagtggaagctagcccgcaccaagaaaactgggcagatgacatctgaggcagcaaaggaaatagctgagaagattgattctttggacgagtag

SEQ ID NO: 43397 - DNA, 279 bp, Glycine max
  Peptide Sequence Number=SeqID_135082
atgtttgatgagttcaaggaggaactcgagagacgccactgggatgaggagttgactgattttgctaatggcaacatcgatgttgccattgtgaaggaattctatgcaaacttctatgacctcgaggacaaatcacctaagcaggtgagggtaagaggtcatctgattaagtttgatgaggatactctcaacacattcttgaagacccctgttgttgtggaagagggggaaacactttgtgcatattctagatttgcactcctgaggccagacccttag

SEQ ID NO: 43398 - DNA, 300 bp, Glycine max
  Peptide Sequence Number=SeqID_135083
atgagatgggttaatagagtgggtcctcattccatagatccaaagaatcactttttacaattcacccagtggaatagcaaagctaggacaaacaaaagatgggaatttctgtggctaaccctgtccttctccatttggtatcatagaaatgccatgcttttcaagaaccagccgttcactcctgaaaaggtcatggatgatgccttgttccacacctggtcctggctaaaatgtgtggagaaggacttcaatatgcattttactttctggtcaaccaatctaaaggatgttttttcctag

SEQ ID NO: 43399 - DNA, 232 bp, Glycine max
  Peptide Sequence Number=SeqID_135084
taatcaaggggttcccacgaacaccaagagaataaagctcatttctgagtggcccactccactaggtgtggagggaagaagcccaaagtttcaagaacctcggcatttgaggtcaaatccttttcaaaaggggggggggggaatgatgcaatcctaccccccaagggcattgggtagaaactctaagaagattgagccagaaatgcacgagaaggccctagggttctcatga

SEQ ID NO: 43400 - DNA, 288 bp, Glycine max
  Peptide Sequence Number=SeqID_135085
atgagttgtacaggttcgctgagcgcaccgctttatctcactaagcgaaccgctttagttcacctgctaagagagaaagcggtccataagtgtgctaagtgcacgagcacgaacaaggccatcaatttaagcttgaaatcaaattttgtgaagagtttggactgggattcagagctttgtatgtctaggatttctagagagagaaaggtccaagttccagagagttttgagagattctgctgtgtgaagatctgcagagaccagagcttgaagcaagagccggtttga

SEQ ID NO: 43401 - DNA, 213 bp, Glycine max
  Peptide Sequence Number=SeqID_135086
atgcagtcctaccccctaaaggtattggatagaagactcaaagaggattgggctagagtggctaaagaaggctctagggttctcatgaacctcaagcctagccttctactgatcaagcctcgtccacagatccctcttgtaagactaaactcaaccaagaccacattaagacacacatacacaactaagttcttgtgccccgatccctcgtga

SEQ ID NO: 43402 - DNA, 654 bp, Glycine max
  Peptide Sequence Number=SeqID_135087
atgattatatcatcattttcactgccaacatcactatatttatcatcctcatactaccaccttatcggcaccaacttccacggttaccatacaggcacgttcgaaactgcagaagaagcagcacgagcctacgaccaagctgcgatattgatgagcgggcgaaacgcaaaaaccaacttcccaatagtccaaaccccagagggtgacccaaagacaacgctaacaccaaccgatcacgaaaccccatcgtcgtccatgaccacctcgaaggaactggaagagattcttcacgccaagctcagaaagtgcgggaagcttccgtccccttccatgacctgcctgaggctcgaccccgagaattcccacatcggagtgtggcagaagcgcgccggccagcattccgactccaactgggtcatgatggttcctcccctcggaaagaagggtggtgccaacgaaggaggtactggagatggttcttgttctaataatccctcttcgttctctaagtgcgatcctgccccgcaagtggtgagacaggagcttctaaggacagagatggacgaggaagagagaattgcgctacaaatgatagaagaactcctcggcaggaactgccccatcactagcccttctttcaacaacttatattaa

SEQ ID NO: 43403 - DNA, 291 bp, Glycine max
  Peptide Sequence Number=SeqID_135088
atggagctaatccttttgagagttgggcttagggaggaggaaagaacaagtattgttaggttccttagtggacttaatatggaagtgagggacaaggttgagctccttccatataggaacctagatgatctagtccaactttgcataagggtaaaacaacaacttaaaaggaagcctacttcaaaatcttatggctctcactcttatccaaaggaagaccaaggtcaaggaatattatgggctacaccttctaagcccaaagatgataagagggatgaggaagaaaaataa

SEQ ID NO: 43404 - DNA, 182 bp, Glycine max
  Peptide Sequence Number=SeqID_135089
aggttgggcttccattcactacaatagatatagaggctgatgtgaggcaccccttattccatccaatccatctatcatgggaagcgtattttaacaatcctagaccattggagccagagagattaaaggcgttgcggatccagtgggcacagtattatctccgagttagagatcagacttag

SEQ ID NO: 43405 - DNA, 150 bp, Glycine max
  Peptide Sequence Number=SeqID_135090
ctagcttctgcaaatttgaagtttgttgatgcaatccttcctaggaagggaccagtaactagaaccatgagcaagaggctccaagaagattgggctagagctgctgaagaaggccctagggttctcatgaacctcagggtagatttctga

SEQ ID NO: 43406 - DNA, 663 bp, Glycine max
  Peptide Sequence Number=SeqID_135091
atggttaggactagaggattaggtcgtgccttaggtcaggttactagcagaggtgtgggcagaggagatcgtgatgattccgatgatgctccgcagcgtcgacggcctactgcatccgcacagaggcagcgagtcgctgtgactgcaacacacgctgagccagtcatccctgcgccagatgttcaggatgaccggatggaggcaccagctgctgtggaggacattgtggcagacattcgtgtggacacaggcgcaaaggctgctgaggacgcgcatgagggatttccgggtggtccgagcgacccatccgtgttgaccctgtatgcggatcacgttgcttgcagcgtatggacgggagaggacgctcctgaattgaagctatcctctcatgggaggaaggtccacagtttaggcacgcctatccctgccattgagggacttgttgctgacaccaacgatcggggacttttgtccgcgtttgtggagcggtggcaccgagagacgtctaatttccatctccaggtgggagagctcaccatcacattggacgatgtctcctcgcttctccatcttcccgtgattggcgacttacacacttttgagcccttgcacgtggacgatgcggttcaaatgctggtggacttgttgatggtctctccagag

SEQ ID NO: 43407 - DNA, 630 bp, Glycine max
  Peptide Sequence Number=SeqID_135092
ttccatttgctgggaagtggcaacgctttacagtcaggaatgatggagaaaaggtggttccagaaccatatggtgacacagaacagacagaaacctgggaatcagagggattacctaccttggcttgatcaagtcgaacaagcgtatgaggatttctggaagacatatggcatcttcgatttgatacaattctctcgatctggtcctgaatatcgaccagaaatgctgatagcagccatgcacttcttcgaatcttctaccaacacctttcagtttaagtgtgggatgatgacccccactctcttagatgtggccgcccttacaggtcttagacctagcggagaaacttacgaccccactaattctagtgataatatcaaactagtatataaggagaacaccttttccaaatatatagctgaacacaaaggacccgtcgaagaagaggtttctgatgaagagcacgtagccttcttaaccctgtggctatctcactatgtcttctgcacgaaatccttgcaatgctatacgaatccgcttggtgaggcatgcgatgatctgaagaaatcgaaggatgggtcttccttccttagtgtctgggcccatgtggcttctccagttgtggcttaa

SEQ ID NO: 43408 - DNA, 681 bp, Glycine max
  Peptide Sequence Number=SeqID_135093
atgattgatgctgccagtggtggagctcttggtgatatgacccctgttgaagctaggaatttgattgagaagatgacttccaactccaaacaattcagtgcaagaaatgatgctattgtccttagaggagtccatgaggtggccacggattcatcttcatctactgaaaataaaaagcttgaaggaaaacttgatgccttggtcaacctagtaactcagcttgccatgaatctgaaatctgcacctgttgcaagacctgtccctcatttccagaatgctgctggtccaagcaagccatatgttcctccttcaatacagcaacaacaacaacagcggtcacaaaaaagacaacaagcaactgaggctcctcctcaaccttccttagaagagttagtgaggcaaatgaccatccagaatatgcaatttcagcaagagacaaaagcctccattcagagtctgacaaatcagatggggcagatggctactctgttgaaccaagctcagtcccaaaattttgacaaattgccttcacaaactgtgcagaatttgaaaaatgtgagtgctatcaccttgaggtctagcaaccaaattcaagtgcctcgaccagtagcagcacctgcacctaaacctgtcaagtttcattctacacctgaaaaagaggatgagatagttgcacaatag

SEQ ID NO: 43409 - DNA, 438 bp, Glycine max
  Peptide Sequence Number=SeqID_135094
atggttaaggaggagtgtaaggaggtaagtgtctcctccaagaggttagttaagaaggaaagtcattttacaataaagacaaacattaaagaaacttcccctcttagacaacctccacattttctcctttgtaaaaagacacttgttagcattgtcatacctcttgggcttgaatttattcctcaagtaaaggagttgttggatgaggatttggtttgcaagagcttaaatctttgtgctttgttggtgcccaaaataggtattattaggcaccaaatccctaaaataggtggtatgatgaatgttttgaatgatgcaaccctcttttataaaatcactggtgcacccaacatcttcatgatttgtgtactcatatgggacaccttaggtttgtcatactttttgataggaataatcaacatgaaaatacagaaaaag

SEQ ID NO: 43410 - DNA, 278 bp, Glycine max
  Peptide Sequence Number=SeqID_135095
atggtcctaggcaaaccatggagtctcacaacttccctaaaaaagagttttgagatgtgggaagcatcatccaccttgtggcatggtataaagtgtgccatcttgctaaacctatccaccaccacaaagatagagtctacacctctttgggttctagggagcccaaggacaaagtccatactaatgtctacccaaggtgcagatggaatgggtaaggacaagggtcttgtctatcccaaagtggcccatgagcccaccctcatggctctccttcacaa

SEQ ID NO: 43411 - DNA, 165 bp, Glycine max
  Peptide Sequence Number=SeqID_135096
atgcatcggctgaaatatgggaggaaaaaagaaaagttgaggaaatgcttctcaactggggcaaggaaaaatgaagaagggagctctctatatatagcaaaggttggaagttacatggaagttacatggaagttattaaaacttccatcaacggttggaagttag

SEQ ID NO: 43412 - DNA, 285 bp, Glycine max
  Peptide Sequence Number=SeqID_135097
atgaccacattcaagattcccaacaaaacactcactatcctaaaagaaaaattgcctaaaattattacacacaaatggaagtttggtaacctattagaggctcccaacacacttccaataaaaggcctttttgttacaaaacttgaaagcaatgaagtgcttcttagtccaatagctcttaaggtgtgtcgcaacctacccttcggcgggagggcgacgcgtgactcgcgggatgcgtgttccacgaaaggaatacgcgcggagtcgccaccaacgtttatttga

SEQ ID NO: 43413 - DNA, 105 bp, Glycine max
  Peptide Sequence Number=SeqID_135098
atgaggaaggcatcgagcagttcttgcaatttgcttctatcataccctaatttcgtctggggacctttgcttgatgacatgcgacctttctttggtccttgtgag

SEQ ID NO: 43414 - DNA, 362 bp, Glycine max
  Peptide Sequence Number=SeqID_135099
tcttggaagtcaacactcaggagcgcaggtcgcttgagcaaacagaccaatggcttgcacccacattctggtggaagttgaataagcaaagatgtgttcgtgagaggatgagagaggcaaggatgtccattttatccatatcatttagcattgtaactgtggattcaacaagcgattctcctcaattttcagccagcccgtatcaattagacttcacactttatgctttggggtcatacaatgctcaatggaatgcctcggggctcctccatgataagcacacgttgcgttcgagtcgtattctcggagaaatagaggttgatgaaccttggctagggttatggctaccattgaattatcaa

SEQ ID NO: 43415 - DNA, 348 bp, Glycine max
  Peptide Sequence Number=SeqID_135100
atgtaccctctcttgttctcagtcaacccaagtagatgtaccctctactttgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43416 - DNA, 402 bp, Glycine max
  Peptide Sequence Number=SeqID_135101
atggagcaggaagtaattcataaccttgccatggagcacttcaaaaaattttatatagaagagggtgagtatgaacaacttctatgccctaatagattccttattctatgtgagggggatattcaatttatccatttgccttttacaatgagggagctaagtatctcgaaagtgtgggatcatgttgtgaaaggttgtagatggctggtgggtggcggtgcatctattcagttttggtgggataggtggctacctacaagtgtgattattgaggagctagatgttacggtgaatgggatggtgacagatgagggggaatggcaacatgggttgtttgttaatcgggtcctggagtggttagttgttgagattatgggaatgctacctccttgtgttgcttaa

SEQ ID NO: 43417 - DNA, 635 bp, Glycine max
  Peptide Sequence Number=SeqID_135102
atgatggggacaaatcaaaacggaaaaagactttatcaagtcaagattaagagtctagatgtcaccagccttaaggagttgggacggttgatggaacccctccaaaggcaagccttccgcaaagtgtacggaaagatcttggatttgaccgcagtgcaggtatttacggaagctgttgtatccctcgcccaatactatgaccagccgttgcggtgctttacgtttggggacttccaaatggtaccgactgttgaagagtttgaggagatattaggatgccctcttagggtaagaaaactgtatcttttctccgggtttcttccctccttaagtaagattgcagctgtggtcggagattcggcgaaagaattggatcgcatgaagcaaactcagaacggcgtagtgggcctgccacggaaatacttggaaggcaaggcaagggatatggcaagccaagagaagtgggtcccgtttgtggatatactagctttgctgatctttggggttgccctctttctgaacgtggacggtttggtggacctagccgcaattgatgctttccttgcatatcaccatagcaaggagagtccagtggtggccatcttggcggacttatttgatacctttgaccgaag

SEQ ID NO: 43418 - DNA, 90 bp, Glycine max
  Peptide Sequence Number=SeqID_135103
atggcaggggatggccttaggcctagggtgcatcctaaagaaatggggcatgccacattgcccccactctctttgctatttcatgcctaa

SEQ ID NO: 43419 - DNA, 156 bp, Glycine max
  Peptide Sequence Number=SeqID_135104
atgaaccctaagagaataaaggtcattcctgagtggcccgctccaccaagtgttaagggaaggagcccagagtatcaagaacctcaggatttgaggtcaaatccttttcaaggggcagggaatgatgcaatcctactccgcaagggcattggatag

SEQ ID NO: 43420 - DNA, 258 bp, Glycine max
  Peptide Sequence Number=SeqID_135105
atggagtcgccatctgtcacaacctacccttttgcgggcgagcaacgcgagggctcacgggtgcgtcttccaaaaggaggaaaatgcccggagtcgccaccaacgtttatttgtggaaaacgtcggaaaaaccgaagaaaaccggtcatgaagaatattccagattcgggagttgtatttacggttgaggaaggtcgacaaaagagagactcttgctcctacgtaccctccatcgaagaggaaatcagacatacttag

SEQ ID NO: 43421 - DNA, 573 bp, Glycine max
  Peptide Sequence Number=SeqID_135106
atggcccgagttatgttggggaacggttacgaacccggaatgggtttaggcaaagacaacggcggcataactagcctgataaatgccaaaggaaattgtgggaagtatggtttaggctataagcccactcaggcggatatgaagagaagcatcgtgggaaggaagagcggtggtcaaagctcgcgttggagacaagaaagtgaaggaagcccgccctgccacataagtagaagctttataagcgcgggtctgggagacaaaggtcaagtggtcgcgatatgcgaagatgatgttccgagtacattggatttggtacgaccatgccctcctgatttccagctggaaaattggcgagtggaggaacgccccggcatttacgcaacgagcataatattcgatgacgagtcccccgaaggtactaatacctgggacccgtctatcaacttcgagcaagaaatgaaccaaacggaagatgaaggaaacgaggaggtggggacttccttcagaactagaaaagaatggtcgcccatgaggaccaagaaatggggcctcatcaagaagagacagagctag

SEQ ID NO: 43422 - DNA, 353 bp, Glycine max
  Peptide Sequence Number=SeqID_135107
atgaccggaaggcttattgccggttcattggcttttgaaagccgcatccttcattatctaattgttcgcatcttgcttccaagatcttcaaaccttgcacaagcattgcgattgaatgctccattgccatatccacacctagtcaccctcttccttcaacacttcaacatccctcttgattctgaaccctatgttccaatcaagagatcctttctaataggcgcttttgtcattgcatcttttggttatcaaaaagagcatgatggctcttgggtgaaaaagggtgctcgacatgttggtgaagaaggacatgatggagaagattcatctcttctttcaaagattttggatat

SEQ ID NO: 43423 - DNA, 435 bp, Glycine max
  Peptide Sequence Number=SeqID_135108
atgggatcaagtcaaatgccttcgcttaaaaagaggttctatcaagttaaggtcaagagcctagggaccaccagtctaaaggagttagggcagttaatgggtcagctccaacggcaagcttttcgcaaagattacggtaaaatctgggacttagccatgctgataaggtgcttcacatttgaggacttccagctagtgccgactgtgaaagagtttgaagaaatcctgggatgcccactaggaggaaggaagccatatcttttctctgggttctatccctccacgacaagagttgccaaagtagtgaaaatctcagcacaagagttggaccgtgtaaagcaaaacaggaatggggtagtcggagtaccaaggaagtgtttggaggaaagggcaaaggccttggcaaatcaaggtgaatgggctttcttttattga

SEQ ID NO: 43424 - DNA, 504 bp, Glycine max
  Peptide Sequence Number=SeqID_135109
atggcacaacctccaccccgtgagaggactctaagggaaatggctgcacctgatttcacctacgaaagcttatttcatgtgctttgtcagggaagacttccgcacaaacatttgaaggaatttcatattgttgctcctatccatgaaacctcgcaatgtcaagaggatcatatatttggggtagaaaaaaagcttttcctcatgtctgtggcacaggcctggctgtattaccttgctccaaaaggtccatccgagctgatctctgtcaagaagttttttatttttcaagttttaaaaaattttccctgcttccagaccacaaccatcaagaaggatatctcagaggcaatcctctacgacttacaaccctttgatcctgagatagataggacatttcatagattagttaggcatcattttataccttttgatcatcctgagcattccattactggtgaatctgtgcattccgttattggtgattttgaacatcctgatttttga

SEQ ID NO: 43425 - DNA, 86 bp, Glycine max
  Peptide Sequence Number=SeqID_135110
caaaggaatccatgatgaagaagatcctaggcctacaagttccaaaggagcttacatcaccataggtcctccaagtccttctaaag

SEQ ID NO: 43426 - DNA, 714 bp, Glycine max
  Peptide Sequence Number=SeqID_135111
atgtttgcacattcgattaaaggctgccgtcccttgggacggacgtgtggggtgctaataccttccccgtgcgtaaatacaactcccgaaccttttcacttaaaagttcgtagatcgcgtcttttccggtttttccgacgttttcctcaaataaacgttggtggcgactccgcgagtattcctttcgtggaacacgcatcccgcgagtcacgcgtcgccctcccgctgaagggtaggttgcgacaggtagctacaaacccatttgcatcatctgaaactaagaagcttgaaggcaaactggatgcgttgatcaacttggtaacccagctggccttgaatcagaaatctgtacctgtcgcaagggtttgtggtttgggctcctctgctgaccaccatacagacctttgcccttccatgcagcaacctggagcaattgagcagcctgaagcttatgctgcaaatatttacaatagacctcctcaacctcagcagcaaaatcaaccacagcagagcaattatgacctttccagcaacagatacaaccctggatggaggaatcaccctaacctcagatggcccagccctcagcaacaacaacagcagcctgctccttccttccaaaatgctgctggcccaagcagaccatacattcctccaccaatccaacaacagcaacaaccccagaaacagccaacagttgaggcccctccataa

SEQ ID NO: 43427 - DNA, 159 bp, Glycine max
  Peptide Sequence Number=SeqID_135112
atgtgtggtctacgaactttaagtgtgaaaggttctggagttgtttttacacacggggaaggagagaaactagcattcttttatctttttgtggtcgacaagggtgtttccctcgctcctacgtatcctcactgcgatgaggaaatcagacctacgtag

SEQ ID NO: 43428 - DNA, 273 bp, Glycine max
  Peptide Sequence Number=SeqID_135113
gactctagaggatccccttccaaattctacaaggagaagaccaagaagttccatgacagcttgatagctaagaaggcattcgtggttggacagaaagttctattgcataactctaggctcggactcatgagtgttgagatcaaaagtgaatccacagataagggcttcaaggtcaatggacaccagctaataccattcctcacaaatccctccttagtggatgtagtggtggaggagacctccttacttcactctacttctcttccgccatga

SEQ ID NO: 43429 - DNA, 384 bp, Glycine max
  Peptide Sequence Number=SeqID_135114
atgacaggcagagaccaaatttggtcattctgcacccttgtatcatccagaggcggcgggcccaatgatacgcggagataccttacggttatccgcacccttttgtcatcccgaggcggcgggcccgatgacaagcagagaccaagtttggcggcgggcccgatgatacgcggagataccttacggtatccgcacccttttgtcatccagaggcgggcgggcccgatgacagcagagaccaagtttggtcattctgcaccccttgtatcatccagaggcggcgggcccgatgatacgcggaaatacccgagtggttatccgtataaacattcttttgctatctgtaagacagaacgcttgatagcattgcagaggctgacataa

SEQ ID NO: 43430 - DNA, 417 bp, Glycine max
  Peptide Sequence Number=SeqID_135115
ggtatactcaaggaggattttcaggctttcagcagggttcttataatcaacaaggacaatggaggtcgctccctagtaacaatgtcaaatcataaaagcactgagtcagcactgaagaaccttgaaatccaggtgggacaactggccaagcagatagctgacaagttgtccaacagttttgcagcaaatacagaaaagaatcccaaggcggaattcaaagatgtgatgacaaggagtaaaaggtttatggaggctgaggaggaggagagtattgtgcacaaagagaaaactgctgaaaagaaaggtactgatggcaagaaaaatgagaagtcactgtgggaaagaccaatccaacaagggcctaacatctttcagaggactactaagctagaggagactttgactcagtttatgcag

SEQ ID NO: 43431 - DNA, 489 bp, Glycine max
  Peptide Sequence Number=SeqID_135116
atggatgagctcatgaatccggctgttgtataccccaagatgattcatccaaagagtttttcaggttaccagcaaggagggaatttcaatcaaaatcaagggcaaggatggaggtcacatcaagggaatcaattcaacaaagatcaaggaggaccttccaacagacctcctaatcaagggcctaacttgtatgagaggaccaccaagctagaagaaactttgtctcagtttatacaggtctcaatgtctaattataagagcactgagtcagccatcaagaacctggagatccaagtgggacaattggccaagcaaataaccaagagttcttctggaggttttggagctaacactgagaaaaatcctaaggaagaatgcaaggctgttatgaccagaagtaaaagagagattgttgtggagaatgagagtaggattagtgaggagaaggagttaggagctgagggagaaagagaaaaagaaggagattag

SEQ ID NO: 43432 - DNA, 258 bp, Glycine max
  Peptide Sequence Number=SeqID_135117
atggcttgtaacaaatcaggttcgaggacgaatcctttcaaagagggagggaatgatagaggtgcaaccagcccgtctaatgatccttttcattcgattggagttcctatgataaagtccaagactaagagaatgaagcaaactttgcaaggcctgattctaaagatcaaagagaaagaagaccaatgtgaattaagggttgcacctaattgggtcgctctccaacaaattgatgaagatgctttgtggccaacttga

SEQ ID NO: 43433 - DNA, 816 bp, Glycine max
  Peptide Sequence Number=SeqID_135118
atggtgcgcagccctttggcgagggcgcatggcatttgccgttgccccgtcttccgcgggctctggtgttggggggcggtcccgaaacgcccttcctggttccgttgctgcggagcctggggtggcgggtcagcgtggccgaacggagagcgcgctgggcctcagccgggcagtgcgcggatgcgcatcttcagaccagcccggccgaggctccttcatggcgacccgtgcgacgcggcactggcgcgaggacctgttcaagctgctgacaccggatcagcgccaccgcctgtccccgagacttcgatcaccggtcggcctgaacatcggcggccgagggccagaggcgatttcgctcagcatcgccgcgcagctgcagcaatggcgaagcgcgcacggcagcacccggctcggccagcccaagcagcttctgacccggcagggcgagaccctggtacgtcgcgtggtgcggttggccttggagttcgcgccagcgcaggtcctggtcgtggtgggcgcgaacgcacaggccgtgacatccagcattgccgggctggaggccactccggtaaccaaccaccactgggaacgcggcctggcgagcagcctgcaggttgccggcgcgcacttgctgcccacggtgaccgaggtgatggtttcgtggcatgcgaccgcccgcaatcgagcgctccagcaggcgctgctttcgggtgcccgcgcctcggcatggtgcgctggcacccgtcatggagacgcgcttggcattcctgcagtagtgccgcgcgcatggttcaatcaagtgggtgcaagcggtga

SEQ ID NO: 43434 - DNA, 449 bp, Glycine max
  Peptide Sequence Number=SeqID_135119
gtatgccacctactaggcaccctctagacccagataagtctaacagggccctgggttttccggcattgatcacaggtctctgccagtcgttcggggttcctgccacacctagtaaggtgattcgaccaccgatcacccgggctttcatagagaagtattgcacgcccaaacaggcgcaggccccagacgcaccgccgccacctcctcaggctgacccagctgggtcatttgacacggagcggtatttatggcatttgagtcagggtttccctccttttccatgccctactccagatcagttcagggcagaggttgcatggctcggggattggcctgaggcccaggcaggggaggcacccgcagaggctcccggcgatgcagatgaggcccgcatggacaaggagatgaccgatttgctcgatttcttgggagggagcggagccacatga

SEQ ID NO: 43435 - DNA, 165 bp, Glycine max
  Peptide Sequence Number=SeqID_135120
atgtttctgtccgtgggagggccaccctcgacagtggaaggaaaggggaaactcgatctcatcgaagagagattgagggctattgaaggattcggcgattattcgttcgtagacatgaccgacctttgcttagtgttggacgtcgtcatccctctgaagttcaag

SEQ ID NO: 43436 - DNA, 208 bp, Glycine max
  Peptide Sequence Number=SeqID_135121
gaaatggccccaaggaagcttgcctcaaagagatccaggaaagacaaggcggttgaaggaaccagttccgctcccgaatatgacaaccatcattttaggagcgctgagcaccagtagtgcttcgaggccatcaaaggatggtcattccttcaggagagacgtgtccagctcagggacgacgagtatactgacttccaggaagagatag

SEQ ID NO: 43437 - DNA, 315 bp, Glycine max
  Peptide Sequence Number=SeqID_135122
atggatcgcgcccgcaagacactcgttggacctgaagaagtccaacagggtcttggggtttccagctctggttacatgcctctgttagtcctacaaggtgcccgttccccccagcaagggatcgcgcccgtaagacacccagtggacctgaagaagtccaacagggtcttagggtttccaattctgattacgggcctctgtcagttccacagagtgcctaccgcccccagcaaggtcataaggccccctactaatcgaactttcatcaagaagtactacgcccccaggcagacgcagggcaagacaccacagtag

SEQ ID NO: 43438 - DNA, 458 bp, Glycine max
  Peptide Sequence Number=SeqID_135123
atgcaagataagagggatgaggaagaaaaactagaagaacaaaagaaaaagaaggatagtaaggccttgtcttcaaaggccaaggggaaggaaaaagaggaaaaggattcctccaagaagattgttaagaaggaaaatcatcttgcaataaaaggtgatgtcaaaagagcacttcttcttaaacaatctttctaccttctcctatcaagggaaacatcccttaacactgccataactcttgatgttattcctcaagtaatggagttgttggatgaaggtttggttcgtaagagcttaactctttgtgctttgttggttcccaaaatagatattatgtggcatcgaatccctatgataggtggtatgatgaatgtgttgagtggtgcaaccctctttcgtaaaatcacccatgcatcaaacatcttcatgattcacttacatagggactcattaggtag

SEQ ID NO: 43439 - DNA, 222 bp, Glycine max
  Peptide Sequence Number=SeqID_135124
atgacgctgccaactgttgcgcgaagggcgatcggtgcgggcctttgcgctattcccagcggcgctaaagggcggatgtgtgcaactggcgattactatgttgggaatttcccggaacatgagctgaccagcccacacttaacaggaagaagcctgcagagggccgcggcaaagccgtttttccataggctccgcccccctgacaagcatcacgaaatctga

SEQ ID NO: 43440 - DNA, 895 bp, Glycine max
  Peptide Sequence Number=SeqID_135125
atggtgaaagtcggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcttatgcctaaacgacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataagataccaggcgtttccccctggcggctccctcgtgcgctctcctgttcctgcctttcggtttaccg

SEQ ID NO: 43441 - DNA, 523 bp, Glycine max
  Peptide Sequence Number=SeqID_135126
ttgctacttagcacattctgctcagcgaccgtattgccaatctccccctgcaaaagtatcagttgggatcgcacccacaaagacacccagtggacctgaaaaagtccaacagggccctggggtttccagctctggttacgggcctctatcagtcctacagggtgcccgtacccccccggcaaggtcacgtcatcatagggatcgcgcctgcaagacacccagtggacccgaagaagtccaacagggtcttggagttttctacggagtacctgtcacctccagcaagggcatcaggccccctactaatcgagctttcatcaagaagtattgcgcccccaggcaggcgcagggcgaaacaccacagcagcctggggatggccggcagcgggcaacagacgcaccgccatcacctctagagttcacctctgctcatccacgaaaaggtttgagtattgcctacaccacatggccgaccaataggcgaccaagtccaaagccaaaggacgcacctagttgctcatga

SEQ ID NO: 43442 - DNA, 988 bp, Glycine max
  Peptide Sequence Number=SeqID_135127
tcgccgacagcgcctcgtggtgcgacagggtcccgggcacgaacggaggctctcaccctctctggcgccccctccaggggacttgggcccggtccgccactgaggacgcttctccagactacaattcggacgccgagggcgaccgattttcatggtgggcttttcccgggtcgtcgatgggtccagaactcgaccgggctcgctatccgtgagggaaacttcgagcgggtcaaccatttgctacacggcgatagtcttcgccatacccagattcagacgaacgatttgcacgtcagtatcgctgcgggcctccaccagagtttcctctggcttcgccccgctgcagcaacattagttcaccatctttcggagtacccagcaggtatgctcctcaagctcgcaacccgttcaaagactcagaggttcacgggtcggcggtgcaattccacagggggatcccaccagtatcgcattccttgcgccttacgggtttactcgatgcaagagcgagccgttgactcgcagagcatgtcagtactccttggtccgtgtttagaccgggacaccgaatctccggggggagtcgcacttaacagatttgagccgacgccggaagcgccggggtttgtgtttgtcgcgaggcacgccgggcgcgcgctgcctcccaatccgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtg

SEQ ID NO: 43443 - DNA, 646 bp, Glycine max
  Peptide Sequence Number=SeqID_135128
atttcctacatctaatatccagtcgtgtggatttgggatgaccgatcctctcgatgagtcgatctcttgctttctcataagggtgaacccttggggctacccgccctcaccttgggtactagttaccctcaccgtcagaggactacacgtcctcaccttgacaggactacacgtcctcaccatcagagggctgcccgccctcacctccagaggactacatgtcctcgctttgagagggctgcacgccctcaccttcagaggactacacgtcctcgccttgagaggactacacgtcctcaccatcagagggctgcacgccctcacctccagaggactacacgtcctcgccttgagagggctacacgccctcgccttgggtactagttaccctcaccgtcagaggactacacgtcctcgccttgagaggactacacgtcctcaccatcagagggctgcccgccctcacctccagaggactacatgtcctcgctttgagagggctgcacgccctcaccttcagaggactacacgtcctcgccttgagaggactacacgtcctcaccatcagagggctgcacgccctcacctccagaggactacacgtcctcgccttgagagggctacacgccctagccttgggtactag

SEQ ID NO: 43444 - DNA, 413 bp, Glycine max
  Peptide Sequence Number=SeqID_135129
atggtgaaagttggaacctcttacgtgccgatcaacgtctcattttctgggccaaaagttgagcccagggactatatcgctcatggcgttcatgtttctatcagctgtcctcctgttcagctactgagggaattggtgcgtaattcgcaaaagcataccagccggacatcagcgctggcaagtgtagcggggtcaacgctgagcggtgttcccagtgaacgtgcttcatgtgcagagaaaaaaggcgcaccggtgccagcagaatatgtgaatacgactcactataggggaattagctccaccgcggttggcggccgctctagaactgatcctcctcggtcggaattcgatgcagcgaaatggacgaacggggcggaagtttcctggaagaccaggaagaacttaacagggaa

SEQ ID NO: 43445 - DNA, 968 bp, Glycine max
  Peptide Sequence Number=SeqID_135130
ggcgaattgggatcaactcttagcaagcaaagaaggagcatctgtcaactggttccctcgatggaaggaaggaagaaccagagttcttatttcatgcggaggatttccaaatgttcccttaatggggacgaggggttgcatcagctacaatctcgttcttgctacaagacaacttggctaccctatgagaggggcgccactagaggatgagctcacgcctgtcatttcacgaggtttcaataagaccaacatggagacacttcagaaggtccgcaaggcatgggaggtggtaaaaaagaaggacaaagagctcagaggtaataacaatgggcccattggtggctaccatgagtggttgaaagcccacgtgcaaggtttggattggctcccaagtctgagaaccgctaagagggaggaagatgaggcaccggaggaagacgaagaggtgcaggcccttaggacggaactcaagcaagctcaaacagtcaaagaaaggttcaaatcagaagctcttaaaatccgaaaggagaatgccgaactgagagttataaatatagctaccaccaaggctttggaacaagagaccaagaggggtcatagggaagagcacggccagaacaagttccgaggggctctatggggtagtaacaacgagcttaaactccggagggaggaaagggatcaatcgcggaccaacatgttagtcatcatcagcaagtaccaagaggaactaagtctagccacgacccacgagcatagggtggcggacgagtatgcccaagtgtacgcggaaaaggagactagaggaagggtgatcgactcgttacaccaagaggcaaccatgtggatggaccgatttgctcttaccttgaacgggagtcaagaacttccccgattgctagccaaggccaaagcaatggcggaaacctactccgctcccgaggagatccacggacttctcagctatt

SEQ ID NO: 43446 - DNA, 315 bp, Glycine max
  Peptide Sequence Number=SeqID_135131
atggacatagactatgctagtaggaaagacgaatcacctgcaattactaatgaaagtagtccatctaatgttgcgctatatgagcggtgggagcgatccaactggctcagcgtgatgtttattaagatcaaaatctcggcttggatacgtggttctgttaaccaacatgaaaaggttcgagacttgcttaaggtcattgatgaccagttcatcacttcagataagactttagcaagcaccctgatcatgaagttttcctctcttcagctcactagtgtgaaaggaagaagaaaggcttgtaatgaagatgggtga

SEQ ID NO: 43447 - DNA, 162 bp, Glycine max
  Peptide Sequence Number=SeqID_135132
gccaaacaactacttaaaggaataattaacagttctttgaaaggacttgatgatactccacaacctaaacccaaggctagtgctaggtggattgttgttaagtattttaatgatgttagacaattggaagcagacagattgaaggcgcttcgcatccagtag

SEQ ID NO: 43448 - DNA, 936 bp, Glycine max
  Peptide Sequence Number=SeqID_135133
agaccagccatgggtgcatggcatgatcttaaaagaagagttagctgcttgcgcaagatccaagaggagtttggctcaacacttggaagccacggagcaaagcatgctagctatcatagggcagtacaaggaagagttaaaccagtctgtgacccatgaacaaaagctagtagaggatttcgcacaagtgtacgccgaaaaggaagcaagagggagggtgattgacgcattgcatcaagaagcgactatgtggatggatagggaattcaccataactaagaaagcacaaaggcacccctataacactcgatccagaaaaatggacaatgaagagggcgtgcaagaacagatgaaggccgatctatcggccttaaaagatcaaatggcttctatcacggaggccatgctaaaactccagaaaactatagaggataatgccatggcgaccgcctccaatgcagttagggaagcggaaccggtgctacagcctgcaataaacttgggccgagatagaaacacaacggtgtttggtcggagtgccgccccgaaagttttgagccaagcccctaccttcgaggggcaactccctccttatgccgactaccccctgcaagaagatgatgaaggagatgcccatctaggccctctgcttcccttcaaggatccggccccccatgaattaccccaaccaaacatagtccgccatgtcccgtcttcacccgcacccgtaaaagagtcccttcccttcgcggaagataagggaaagattgattcacttgaagagaggctaagagcggtagagggcctcgacaattacccgttctcggatttagcggacctatgcttggtgcctgacatcgtcatccctcctaagttcaaagtactggattttgataagtacaaagggatgacatgtccgaaagggcatcttcggat

SEQ ID NO: 43449 - DNA, 532 bp, Glycine max
  Peptide Sequence Number=SeqID_135134
agagctatacgccctcgccttcgtagggctacacgccctcaccttcagaggactacatgtcctccccttcagagggctacatgtcctcaccttcatagggctacacaccctcaccttcagaggactacacgtcctcgtctttagaggactacatgtcctcccatttagagggctacatgccctcaccttcagagggttacgtgtcctccccttcagaggactacacgtcctcgccatcagagggctacatacccttgccttcgtagggctacacaccctcaccttcagaggactacatgcccttaccttcagagggctacacgccctcaccttcagagggctacaggtcctcgccttcagagggctacacgtcctcgcctttagaggactgcacgtcctccccttcagagggctacacgtcctcacctttgtagggctacacgctctcaccttcagagggctacgcgtcctctccttcagaggactacatgtcctcaccatcagagggctacacgtcctcgccttcagatga

SEQ ID NO: 43450 - DNA, 261 bp, Glycine max
  Peptide Sequence Number=SeqID_135135
atgaaggtaatctttcgatttcaagatgtgacagaagtggtgctagaagggtgtgtagatgcagataattttcagaaaattagatctgctaatactgcaaagaaggcatgggatattctaaagaaatcctatgcaggggatagcaaactcaagaaggtattaagaaccttgacaccaagattcgatcatatagaggtggcaattgagcaaggccagaatcttgaagaaatgaagattgaagaactgcaaggaatactttga

SEQ ID NO: 43451 - DNA, 707 bp, Glycine max
  Peptide Sequence Number=SeqID_135136
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggtcactgccatcgcgagtgtcaatgcaatcgctgttccagaatctgaccacgttttgcaagccagaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43452 - DNA, 393 bp, Glycine max
  Peptide Sequence Number=SeqID_135137
atggcgcctaccaggcaccctctggacccagataagtccaacagggccctgggatttcccgccttgatcacgggactctgccagtcgttcggcgtccctgtcacacctagcaagataattcggccgcccatcacccgagcttttatcgagaagtactgcacacagagacagatgagtctcagcctgcagagtcagggctttacttcttttccgtgccctaccccggaccagtttagggcagaggtcgcgtggcctggggattggcctgaggcccaggcagcagaggcaccagcaggggcaccagcagaggctcccgatgaggcggatgaggcccacgaggatgaagagatgacagatttacttgatttcttaggagggagcggagccgcatga

SEQ ID NO: 43453 - DNA, 956 bp, Glycine max
  Peptide Sequence Number=SeqID_135138
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcagctaagacaaagattacttcaacaactcggatatccacagtcagagcatgatttccaacaactggtgttgctacaaagacagcttggacttcaatttcagcgagctatgcagcctgtgccttcagttcaattgatgatgacaaaaatttgtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43454 - DNA, 543 bp, Glycine max
  Peptide Sequence Number=SeqID_135139
atgcatagatctcccacaggcaatttagttcctctagacttagaaattgaagctacattgagaaggaacaaggtcaagaggagaaggaaacttttgcaagatagaacagttgcatccattcttgaggaagaaactcattttttttattcattatcacctaattcaccatcatcaagggaatccgctactcaattgcctaaaaccgctagcatggcagacgagcagcaccataagatcacccttgaggattattcaagcagctcagtaccacaattctttactagcattgcacgtcttgaagtgcaagctcacaacatcaattactcgtattctttaattcatttaatacaggggaatttattccaaggattgcctaatgaagacccttatgcacaattggcaatgttcattgaaatatgcaacactgttaagattgccggtgtgcttgatgaagttattagactcagcctattctcattatcattggcaggagaggccaaaaggtggcttcactcatttaagggtaacagtctaaaaacctag

SEQ ID NO: 43455 - DNA, 854 bp, Glycine max
  Peptide Sequence Number=SeqID_135140
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattcaagtgatccccctgcttcagcctcccaaatagttggaactacaggcgtgcactaccacacccatcaagcttatcgataccgtcgacctcgagggggggcccggtaccagcttttgttccctttagtgagggttaatttcgagcttggcgtaatcatggtcatagctgtttccttcgggaaacctgtcgtggcagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43456 - DNA, 46 bp, Glycine max
  Peptide Sequence Number=SeqID_135141
atgaccgaacctgtgatgccacatccagctttcatcacttatagaa

SEQ ID NO: 43457 - DNA, 694 bp, Glycine max
  Peptide Sequence Number=SeqID_135142
atgaagaacatcccagtctgcaccaacaaattaggaagggtaaggaaagaatgtaatagactaagggatatcaacatgtcaacgactgaagcattggagcgagaaatgagaaaggctaaaggggaagagacgaatagaaaaaggtaccaaggagctttgtcaggcaatagtaacaaactcaagctgagaagtgcagagagggaccaagcaataacggaaaatgtggcattgagagatgagttgaaggattattgggtgtcaaaggaaagcttgaaggagaagttaggcatgatggaaaagaatatgctagtaattgtcgatcaatatgaggtaaagatgacgagggagaggcaagatctggctactttacatgggcaggctttgagaagcaaggaaggaagtgatagaactactacatcaggaaagcaggaagtggatgaatgggtggattacaagcccaccaatactgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaagggcccaattggcaacctaggcatcagccttttgggagaccaaatggtggctgacttgttggctgttgggg

SEQ ID NO: 43458 - DNA, 249 bp, Glycine max
  Peptide Sequence Number=SeqID_135143
atggagcagttcactaagatggatgagtcatttgaggccaccatcccagagccatttgttataggagaagaggcaaaggagacacagcctacagcagacccctccactcctcttctagagatgcaagaggacccgactacatcagttctggctatgggcacttctcctccagctactctagtatttcatctgatagatgaggaggatgttcagacacaggacacccaggaccaatcacaggaattttga

SEQ ID NO: 43459 - DNA, 351 bp, Glycine max
  Peptide Sequence Number=SeqID_135144
atggtcatcacggttcgaccggagagggtggtacgccagttcggctacatccagagcatccctccgccgcctattagtgcacgattgtcacacgatcagatagatgacaagtggatgcagtttgtagatcacttattacatgcgggtcagctttgtctaatgcctgggcaggatgattacgagggatatgaggcgattgcacagaggttggagcgtgtgctcaaccttaggatagtcactgcaggcacaaagttatatgacattatgcaggactgcctgacgatcgcgagagggggacccagtgctgatgggactgtcagggctcgtcagagacgccgcacggaccattga

SEQ ID NO: 43460 - DNA, 384 bp, Glycine max
  Peptide Sequence Number=SeqID_135145
atgactatgcaaaacatggagtttcaacaagagaccagagcctccattcagagcttaactaatcagatgggacagttggctacacagttaaatcaacatcagtcccataattctgatagattaccttctcaatctgtccagaatcccaaaaatgtgagtgccattacattgaggtcaggaaagcagtgtcaaggacctcaaccagtagcatcttcctcatccgccaatgaacttgccaaacctcactccactccagaaaaagatgatgacaaaaatttaaagaagaagcagcatatccctcttccattccctccaagagcaatttccaacaaaaatatggaagaggcagagaaggagatcttggaaacatttaggaaagtagag

SEQ ID NO: 43461 - DNA, 421 bp, Glycine max
  Peptide Sequence Number=SeqID_135146
atggcacgtattgctgacaagataaaaaccattgatggatctaaagaaactctaaaacttgttgtaaggataactgagctctggtttattgggacgtcgggcaggtctgaacaagctgagatggtcattgttgactctgacggtgatcaaatccatgtggtctgtaagcaagaccagttaaaggcatggaaaatggatttgaaggaagacatcattggtgtggttgacgaggttgtctttcgtcatatttcacccagaagtaagagagttgtttttaagcttatgaatttgagtaaccaattgctgtcttgcactctatgggatgattattatgtccaatttttggaatatttggatcaccatgagagtgaagggcctattattgtgttgttgaccaatgccagaattaaagagggccagg

SEQ ID NO: 43462 - DNA, 961 bp, Glycine max
  Peptide Sequence Number=SeqID_135147
atgttttctgacaactttagcattgataaggaaacccttaggaaagatttttattctccggcgaatgagcctcaaaggagatggtttttccagaattacaagggtacaaatagaaaacaagtccaagacaagttctacgaatttttcgaaagggtcaaagttaatgtccttttctttgattggttccatgcttacaacatcaaaaaagatatagattacccatggaaacaagacatcataggtgatccatcaacaaatgttataaccaactggcaagtaagagatggtgagatgatccaatcggaattacctcccacgaccaaatatcaacttccaaatatcaaagatagcaacaacaaacttgtaatggcaaccccatttaaaacaaaagatattaatgaggaagtaacctctgacgatattaaaagcctaatggaacaggcaaactacaccaataaatatttacaaattttaggagaaaccattaaaactaaggtagttcctaagcaaaaatcggttgaagaagccttagttgaaggagtaggtgacaatcatagtgaattaccaaacaagattggtagtttacttaaggtcattctggaaactccccaaacctcagaaaatacttccaaaatggtaacaagaagtacctccaaattaattaatgttattaatgaagatagtgaccaaaacttagataacacaactgagataagatcagtgtcagaaaagaatataaattcaattaattccaaacattggaaaacaccttccaaattatattatcaacgtccaactgcccctgaccttctattagaagaaagaggagaaaacaatttcaagagttttagtgcaaacaacatctatgaatggaacatagatgcacaaacggagtataatatcatgaatacactccaacatatgaccatggtggctacggcttaccaaacctcccacgaat

SEQ ID NO: 43463 - DNA, 93 bp, Glycine max
  Peptide Sequence Number=SeqID_135148
atgcctctatcagcagcagccgatagcttggcggtgttgtctatcaaaaacaccaaattacatgcgttaactaacttcactgcatcagggtga

SEQ ID NO: 43464 - DNA, 48 bp, Glycine max
  Peptide Sequence Number=SeqID_135149
gattttggctcaagacttgtagaatggctaggcatgatacatgtcagg

SEQ ID NO: 43465 - DNA, 718 bp, Glycine max
  Peptide Sequence Number=SeqID_135150
ggttgacccttgggtactagtacctatcttcttcagagggctacatgtccacgccatcagagggctgcacgccctcgccttcagagggtcgcacaccctcgccttcatagggctacacgccctcacctttagagggctgcacgccctcgcctttagaggactatacgtcctcacctttagagggatgcacaccctcgcctttagaggactatacgtcctcaccttcagaggactacacatactcgcctgcagaggactacacgtccttgccatcagaggactacacgtcctcaccttcaaagggctgcatgccctcaccttaagaggactacacgtcctcaccttcatagggctacatgccctcacctttagaggactacacaggacgcttcctcaccttcaaaggactacacgtcctcgccaattcagaggactacacgtcctcgcctttagatggcttcacgtcctcgccttcagagggctgcactccctcgccttcagaggactgcacgtcctcgtcttcagaggtctacacgtcctcatcttcagaggtctacacgtcctcatctttagaggactacacgtcctcgccttcaaagggctacatgtccccacctttagagggctgcacgtcttcgccttcagagggctacgtgctcttgccttcagtgggatccatatccgcaccttaagagaatttaaggtcctctacccttaa

SEQ ID NO: 43466 - DNA, 324 bp, Glycine max
  Peptide Sequence Number=SeqID_135151
atgtgcctgatcagattgaggttattggttctcaatgagtatcggagtggagttattgagattttcattgagagtgtatgccacattgggtggtgtatagttgggaggccagataggagcatcgggttcaccttagcgacagcgctagtagcggcaactataaccgcattgacttacattatcttcttcatgctcatcatggcctccatcattgtggccatttgctctttcatggcctccatgtcggccttcatcttctcttgcacctcctctgcttcaccccattactctagctctagcacgagttcggtgagggcaccgtaa

SEQ ID NO: 43467 - DNA, 238 bp, Glycine max
  Peptide Sequence Number=SeqID_135152
gcatgttgcacgaaacctaagagaatttgctttcaagaaaacttcggataatgaaagaattcagatccacaccgagatcgatctcgggagtgtattcctagagattatcacaaaggagctattctcgaacaaggaaaaaaggtttatgcaggaagatgacagtccggggaacttccatgctaagggagacaagatttaccaactcaggaaaaggaaattggaaattggaagcagttaa

SEQ ID NO: 43468 - DNA, 393 bp, Glycine max
  Peptide Sequence Number=SeqID_135153
atgggtcacacaggaggtactgaagaaagtggtgatatgacgatggatgatagaaagggtgagcgagatgtggggttcgatgaacaagttgttactctacaaaatatggacacacaagatacaatgcttccatctatatcaccaaccaagtcattattgggtagaggacatagaatcaaacaaccttctactcgcttgcaagattatgtgacaaataccaccagaagattgagttcatccaactgtttgccctttccaaaggcagactcaggtgcaccctatcccataacgaattatgaccatttttatcttgcacatcgtgcttttcttgcatccatttcacaggaaaaggagtctgtcacttatactgacgtggtgaaagatagtcggtga

SEQ ID NO: 43469 - DNA, 573 bp, Glycine max
  Peptide Sequence Number=SeqID_135154
ggacttgcactacctccggagcttgaggttggtgcctcagctgctcgtgtcaacacaaaggggagttgtgttgatccctcaatgaccgatccagacggtgactcagacaaatgcgggttgtacatcaaagaaaatcctcttcgcctagttgcccttggaagagtttatgagggatccacaatggaacacaacatccctttgttgcttggccaagtgaaggttggtgatgaggaggttaaagatgtagaggctcccgttcctgtacccattgacgaggttattttagtggggcagacacttaacacttcccttgcttggccgacacatctcgcgaagcgtttatcagaccaggttatgtgggatgataccgtgttcgaggtgtttaatgaagacttcccgttgtacataaagcacgaagatctctctgaaattgcacacggtggtcaaaatctcaacatatctgttatacaattatggattctgcatctgactgagacaagtatgcgagcagggaatgccgatgtgtatggattcctcgagccacagtccattcagagatctgggcaatcgtaa

SEQ ID NO: 43470 - DNA, 563 bp, Glycine max
  Peptide Sequence Number=SeqID_135155
atggtgaaagttggaacctcatacgtgccgatcaagggacaccaggatttatttattctgcgaagtgatcttccgtcacagtggcttctgtttctatcagctgtccctcctgttcagctactgacggggtggtgcgtaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43471 - DNA, 357 bp, Glycine max
  Peptide Sequence Number=SeqID_135156
atgggagacactacaatacaaagagttgaaaaggaaaacccacctccagcttttgctgaacacaatcaaatcaatctctccaacaaacacaacacagcaactcacagatctgaacttgaagaaggggcaagggaccaaagcaaggagtggcaatgcactatgaatgacaaaaaagacaacaacttagctaagtttgtgataaggaatccagagaaaaatactagaaaatcagagatgtcaccaaaaatgggctctttcctgaataaacaaacaaggaaatcagaacatgggtgtggttggaaacagattggaaaagttgcatttcatctgtgcttggttttgtatcttttacaataa

SEQ ID NO: 43472 - DNA, 309 bp, Glycine max
  Peptide Sequence Number=SeqID_135157
atggcgatggacggtgaccgaaggcggcgaccggcggcgacaaacggtggccggaggtggcggacggcagtggcggcgacggacggtggcgacggcgacgatgacagaataagacaaggcagcaaaggtcacaattggccagaaacagtgacaaattcgccagaaagtggcctcagaggtctcaggatgatcaaactaaggagaactgaggttggggatggacaactgtcgcagctagccagaaaatgcagagaaatgccggagaagggtgggtgcttgtcacagagaccagtggatgatacttcataa

SEQ ID NO: 43473 - DNA, 1053 bp, Glycine max
  Peptide Sequence Number=SeqID_135158
atggtgggaatcgatgtcttagttaaacattgtgggtgtattcccagaaaccgagggaccatttcctccaacactcatacttcaatctggtgggtattaggttacagcgatggcagacttggtggatctccctggcatggtgtatttggcatcatagaaaaaggattgttttctcaaatgacagcttcaaaggatgtctattttgatgatgaatctgcagaagttgttatatcttctttgcggttgggagatgaccatgaaagtgggtctctattcacaaattccaactggtttgctttcgaggagggtagagatcgagtaggcaatgaacgctcaacaggttcccttgcttctccatcacctactgctgatgaggtttttgtaaaagccagtggggatgatgttattgctggtgaagatgaggagttagctgacactgcaacatctccagaagcaggactaaaattagaacatggtgggaccgataaaccagttgagtgggttgaatggagggaatcttcagatgccaatgacccttctgatgttcttcccaacggagtacttgagatagaacctgggagcaataatcctggtgtagctgaatcatcatctccatcatccagtgttgcattaacaaaggatgagcagatagctactgatgagccatcagcatctctcaatgactcaagcattgaaacctctgacagaaacaaggacaaaactgagccaactcaaggagttgaaactccaagcacacgtgcatctgccacttctgtggatgacccagtcaccgaggttggaggagaccgtaacaaggacacaactgacaacaaaaaagctgtggataggcctgtcactgcggtggaaggagacagtaacaaggacacaactaacaacaaaaaaacagtggatgagtcagtcactgtggttggaggagacagtaacaaggatacaactgacaataaaaaagctgtggatgggtcagccactgaggttggagggaacagtaacaaggacacaactgacaacaaaaaagaagtcgagcatgagtag

SEQ ID NO: 43474 - DNA, 1197 bp, Glycine max
  Peptide Sequence Number=SeqID_135159
atgaggttttttacagtgaaagtagctctgtgctgtgtggtggttatgctactaaccctctcagatgcacagctagataactctttttacaaggacacgtgtccaagagtgcattctattgtgcgtgaagttgtcagaaatgtttccaaatctgatccccgcattcttgccagtctcataaggctccactttcatgattgtttcgttcaagggtgtgatgcatcaattctgttgaacgacacagctacgatcgtgagcgagcaaagtgcaccaccaaataacaactcaataagaggtttggatgttgtgaaccagatcaaaaccgcggtggaaaatgcttgcccaggcatagtttcttgcgctgatatccttgctcttgcagctgagatatcttctgttctgctatctcccgacgaaaaaacttttacccctgttcaagtcccatcgcaaaggattacccagttccaggagaatccaacgaaacatgtcccatgcgatggcgataagatactcacttacccagataatatcattttgatttgggctgaggctcatggccctgactggaaagttccactaggaagaagagatagtttaaattcaagtttttctcttgctcttcaaaatcttccgggtttcaatttcacccttgatcaactcaaatctacatttgatagacaaggcctcaatacgactgatctagttgctttgtcaggtgctcatacaattggtagatctcaatgtagattttttgctcaccgaatatacaatttcagtggcaatggcaacagtgacccaactctcaacactaccctctcacaagcactacgagcaatatgtcccaatggtggacctggaaccaatctcaccaatttggacttaactactcctgatagatttgactccaactactactcaaatcttcaacttcaaaatggcttgcttcggagtgatcaagtgttattttctacaagtggtgcagagaccattgccattgtcaatagtttcggtagtaatcaaactcttttctatgaacattttaaggtgtcaatgataaaaatgagcatcattgaagtgctaacggggtcacaaggagaaattcgaaaacattgtaactttgtcaatggggattcttctaatctggctactctagccaccaaaaaatcttcagaggatggtatggtgagctcaatctag

SEQ ID NO: 43475 - DNA, 1173 bp, Glycine max
  Peptide Sequence Number=SeqID_135160
atggccaacattggagtgctaacgggatcagatggagaaattcgaacacaatgtaattttgtgaacggaaattcttctgcccttaccaccaaagaatcatcacaagatggcatggttagatgggcaaaggttatgctggaaaatgctgggattaaaggagtgcttggagcactaccacacttctcatttgcacagctagatccttcattttacgatagcacttgttcaaatgtaagttcaattgtacgtgaggtgctctcaaatgtttctcaatctgatccccgcatacttgcaagtctcatcaggctccattttcacgactgttttgttcaggggtgtgacgcatcaattctgttgaacgacacggatacgatcgtgagcgagcaaagtgcagcgccaaacaacaactccataagaggtttggatgttgtgaaccagatcaaaacagcagtggaaaatgcttgtcccggcacagtttcttgtgctgatattcttgctcttgcagctcaaatatcttctgatctggctagtggtcctgtttgggaagttccattgggaagaagggatagtttgacagcaaatcaaacccttgctaatcaaaatcttccagctcctacttttaccattgatcaacttatcaactcatttggtaatcaaagcctcaacattactgatctagttgcactttcaggtgctcatacaattggtagagctcaatgtagattttttgttgatcgattatacaatttcagcaacaccggcaacccagatcctactctaaacacaactctcttgcaatcattgcaaggaatatgtcctaatggtggacctggcactaatctcactaatttggacttaaccactccagacacatttgactccaactactactccaatcttcaacttcaaaatggcttgcttcagagtgatcaagagctgcttagcgcaaataatacggatatcgttgccattgtcaacaatttcattatgaaccaaactcttttctttgaaaactttaaggcgtcaatgagaaaaatgggcaacattggagtgctaacgggatcacaaggagaaattcgatcacaatgtaattctgtgaatggaaattcttctggactcactactactgccaccaaagaatcatcacaagatagcgtggttagctcaatgtaa

SEQ ID NO: 43476 - DNA, 561 bp, Glycine max
  Peptide Sequence Number=SeqID_135161
atgaattcccttcgtctcactttatgctgtgtggtggtagtgcttggagcactaccctacttctcatatgcacaactagatccctcgttttacgatagcacatgttcaaatttgagttcaatcgtacgtgaggtgctcacaaatgcttccctgtctgatccccgcatgcctgccagtctcatcaggctccactttcacggttgttttgtacaagggtgtgacgcatcaattctattgaaccaaacggatgagatcgatagtgagcaaactgcttttccaaatgacaactctataagagggttggatgttgtgaacaagataaagaccaggttggaaaatgcttgtcctggcatagtttcttgtgctgatactcttgccctagcagctgaagtatcttctgagctggcttgtggtcctgtttgggaagttccattaagaagaagggatggtttctcagcaaatcagacccttgctaatgaaaatcttccagctccttctctttgcattgatcaacttatatccgcatttgctaatcaaggcctcaacattacactgatttag

SEQ ID NO: 43477 - DNA, 1537 bp, Glycine max
  Peptide Sequence Number=SeqID_135162
atgacatccagaattggtggttctgttgctggggggaattggaaatatgctcatggaactgcacattatggacgaaatttctctgttaaatggttgaagataagtagagattgtcaggagctggagccctctattggagagcagctggcatccttgctttatcttgagccagatagtgaacttatggctatctcggttgcagccgaatctaaacgggaagaagagaaagccaagggagtgaatccagataatggaggagaaaatccagatattgtaccatttgaagacaatgaagaagaggaagaagaagagagtgatgaagaggaggagagcttcagtcatggtgtagggccagctggccaaggcagaggtaggggaagaggtatgatgtggccgcctcatatgcctcttgggcgtggagcccgacccatgcctggaatgcagggctttaaccctgtaatgatgggtgatgggttatcgtatgggcctgttggtcctgttggacctgatggctttggtatgccagatcttttcggtgtgggaccccgtggttttgctccatatggtcctaggttctctggtgattttggaggtcccccagcagccatgatgtttcgtgggcgaccatctcaacctgggatgtttccaagtggtgggtttgggatgatgatgaatcctggacgtggtcctttcatgggtgggatgggggttggaggtgcaaatccaccaagaggtggtaggccagttaatatgcctccaatgtttccaccacctccaccgctaccacagaacgcaaaccgtgctgccaaaagagatcaaagaactgctgatcggaatgataggtttggttcaggatccgagcagggtaagagtcaagacatgctcagtcaaagtggcggacctgatgatgacgcacagtatcaacaaggatacaaagggaaccaagatgatcatcctgctgtgaacaacttcaggaatgatgatagtgaaagtgaggacgaggcacctaggagggatagcttaacagcaaaccgaactcttgcaaatcaaaatcttccagcacccttcttcacattggataaactcaaagctgcctttgctgttcaaggtctcaacacccttgatttagttacactctcaggtggtcatacgtttggaagagctcgttgcagtacattcattaaccgattatacaacttcaacaacactggaaaccctggtccaactctgaacacaacttacttagaactattgcgtgcgagatgcccccagaatgcaactgagaataacctcaccagtttggacctgaccacacctgatcaatttgacaacagatactactccaatcttcagcagctaaatggcttgcttcagagtgaccaagaacttttctccactcctggtgctgatactattcccattgtcaacagcttcatcagtaaccagaatactttctttgccaactttagagtttcaatgataaaaatgggtaatattggagttctgactggggatgaaggagaaattcgctcgcaat

SEQ ID NO: 43478 - DNA, 874 bp, Glycine max
  Peptide Sequence Number=SeqID_135163
atgtggtgtcagcaacgacgacagtaaaaacactaatgatgattacattaacaatgacgataaagataatgatagtgatggtatcgatagtgttggtggtggtgatgatagagataatattggtggtagttatagtaataatatcagtgacatcgaccatggtgatgatagtgataatagtgacaataacaagatcgaggggaacggtgacaaaactctgcgaaagatcgcagacgcattcaatgaccttgcaaacgttttcaccgattctcagagcgcagaagcagaggtcaaggttgctcccttctctcatgcctgctctctcgtctcccctctcttcggttgcttgggcgtcgccttcaagttcgccgaaatggattacgtcgccaaggttcatgatctggcagaggcgtccaagtctattcagaatctgcagtctctgattgagctggatgtgcaagctaacactgttaggaaaggaggtagccatacgcggaatctgctcagagtgaagcgcggacttgacatggtcagagtgctctttgagcagattctagttacagagggtaattcccttagggatccagcttccaaagcttacgaacaggtgtttgcacctcaccatggctgggcgatcaggaaggctgtttctgcgggaatgtatgcccttcctacaaaggaacagcttctgaagaaactcaatgaggatgggtggcagacagggagagagatgatttatgtgaaacctatttatgatgaatgtggaatggcatcggcaaaagaccacatgcaaagttatgtcactgcttccgcacctctaatccaatacattgacaaactctttgtttctagagacttgggaatagattggtga

SEQ ID NO: 43479 - DNA, 1812 bp, Glycine max
  Peptide Sequence Number=SeqID_135164
atggcttattcagccgaaccctcatcatctttgagctttacctcatcttcccatctatcaaatgggtcggttagtcacaacatatgctcttcttatggctctgaccctggacctaaccttgaggctctcagtttgagtaagcttagctccaattttgagcagcttttgattgaaactgattgtgattatagtgatgctgacatcgttgtggagggaatttcggttagtgttcatcgatgtattctggcctctaggagtaagtttttccatgaattattcaagagagagaagggttcatcagaaaaagaagggaaattgaagtataacatgagtgatttgttgccttatggcaaggttggatatgaagccttcctcatattccttggctatgtatatactggtaaactcaagccctctccaatggaagtgtctacttgtgttgacagtgtgtgtgcccatgatgcttgtagacctgccattaactttgctgtggagttgatgtatgcctcttacatttttcaaataccagagtttgtatcacttttccagtacatgaacttcacttgtgctaatgcttgggaacttcacttgatcaggcttaaggatcaagggaaggctcttgtggaagatgtcatcccaatcctcactgttgctttccattgtcaattgagtcaacttgtcaatcaatgcattgatagggtggccagatcagaccttgaccagatttcaattgaccaagagcttccaaatgaactctcacaaaaagttaaattgctccgccgcaaccctcagcgagatgttgaaaacgatgcttctatagtggatgctttgtctctaaaaagaatcactagaatacacaaggcattggattcagatgatgttgagcttgttaaacttcttttaaatgaatcagacattactttagatgaagccaatgctctccattatgctgcagcctactgtgatcccaaggttgtttctgaggtacttggtttgggactcgctaatgtcaatcttcgaaattctagggggtacacagtgcttcacattgctgccatgcgtaaagagccttccattatagtatccctacttacgaaaggggcttgtgcatcagatttgacttttgatggtcagagtgctgttagtatttgtaggaggttgacaaggccaaaggattatcatgcaaaaacagagcaggggaaagaaacaaacaaagatcggatatgcatcgatgttcttgaaagagaaatgtggaggaatccattggctggggatgcctgtatgtcttcccataccatggctgatgatctccacatgaaactactataccttgagaacagagtggcatttgcaagacttttcttcccttcagaagccaaactagccatggacattgcacatgctgagacaacatctgagtttgctggtctttctgcatcaaactcaaaaggttcaaatggaaacttaagggaggttgatctcaatgaaactcctatagttcaaagtaaaagacttttttctagaatggaagcccttatgaaaacagtggagatggggcggcgctacttcccgcattgctcggaagtgttggataagttcatggaggatgacttgcctgacttgttttaccttgaaaagggtactaatgaagagcagagaatcaaaaggacacgtttcatggagcttaaagatgacgtccacaaggctttcaacatggacaaggccgagtttagccgctctgggatttcatcttcatcatcctcatcatccctcagagattctgttgtacattacaaggctaggaaagtgtaa

SEQ ID NO: 43480 - DNA, 807 bp, Glycine max
  Peptide Sequence Number=SeqID_135165
atgattaagttcttatataacaggccacctccttatgaatcgttttttaagggaatcttgcggatgtctgatgaattggcgtggagcggttgcggtgctcgtttatgccaccgcattgtggtacctcttcgagcgttacatgcatctggtgactcacggagaatcggtacagttaagtatgtggggcctgtagaaggctattcagacacatgggttggagttgactgggacaacggagaaggcaaacacgatggatccatcaatggtgtccagtactttcatgcaaagtcagaaagatcagggtcatttgttcgtgcccacaatctgaaccaagggatttcgttgctggaagctcttgaaagtagatataaaagtgaatctacaaaagatgaagatgaagaggatgatatgtatgtcctttcaacaagcaaccagcgagtatctgttcaacttttgggtaaagataaagtttatgataagctaagtcgatttgagaagttaaccagtgtatcattgtcatatatgggcattagttcccctggaatcccatctcacattaataatacagtgccaaatataaaagaacttgacctgactgggaaccttcttttggagtggaaggatgttggcacaatttgtgaacagttacctgctctgaggacaatcaacttatctaacaacttaatgtcaccgtataaatcagagcttccattactgaaaaacatcaaagttgtggttttaaataatactggtgtagattgggagcaggttccctctatcttttgtcgacttgtgtttctagcataa

SEQ ID NO: 43481 - DNA, 258 bp, Glycine max
  Peptide Sequence Number=SeqID_135166
atgggatgcaatagtggcaacaatgacgacaacgacaatggaggcggcgaaatggtgtatggtggcaacatctgtgacaacgacgatggagacgacaaaatgatgacaatggcaatgatggtagaggcagcaaaggcaaggtgtgatggtggtggtagaatgacaaaggcaataatggagaatggtgacaataatgacagtaacaacagtggtggtggttgtggtggaatgatgacaggaaaaatggtggtggaatga

SEQ ID NO: 43482 - DNA, 552 bp, Glycine max
  Peptide Sequence Number=SeqID_135167
atgccaaacccaacaacaacgacaaaaaaaccatctcctctctctcttctcgctcttcacacattgcacttcttggtcctatgtacctggttctccacatcctcagccaaagcaacctcctacaacgtggtggacttcggggccaaacccgacggcgcgacggacgcaaccgcggcattcctaagcgcgtggaacaaagcttgtagttcgaacaaacccgcaggcattcacgtgccgcaagggaggttcctgatagcacgtgccgttacgttccatgggcaatgtgcgaaccgtgctatctccataaccattcgtggaaccttggtggctccttcccaatacacgttcgtggggaattctttgtattggttgacctttgaccaagttagtggggtttccattcatggtggggtgcttgatgcccgaggcagtttcttgtgggattgcaagtacaaagccacccctaattgccctattggagctgcggacttagatgcagtaaatgggctgtggaaaatttggggtattaagcgtcttttcaatgagtattag

SEQ ID NO: 43483 - DNA, 1536 bp, Glycine max
  Peptide Sequence Number=SeqID_135168
atggcagcaaaactagaaaactgcacggcggagctcgcgttgagatccggctgcagaagcggccctaaacacgtcgccgggagaaccgccacaacttccacgccgtcgaacgcccacgccgccctctccgcctccgtcttcgccaccgggtaccacttcccccttcccttacagtactccacgtccgtccacgacgcctcgtccgcggcccgccccgccggccaccccgggttcggcaccatcgcggagatcgaggaggtgagcaccacgcgccgcacgcccacgcgccttgcggcgggtgcagggggaggccacgtggaagacgccggagcaggcggtgatggcgcgggagagggcggcggcgtcgaggaggtcggcggggaagagggtgaggcggctggcggcggaggggtggaggttgaagaggtgggaggcgtcggagccggggaagatggtggcgtggatggtgtagcgtgggttctccttctccaagagggttcggaccagccacgaaccgatgaaaccgttggcgccgccattggaaatggaaatggtttttctatcaaacggattgatccctacgccaccgttgatgaagaagacgctgcctctcaactctcatctcaagctacaatctactacttcgtttgcatcgttgacggacaaggctctacgacattcgttgttgctggacaaggccttgcaaccttcaccgtcaccggcaacagcttctgcggcctccatcttgcttttgctgacctttcaagcacccaatctgctttgtcttcctcttccatagaggcagtgcatgctaacagtgggctgggtcttagggaggctgaaaaagtgaagaaggaatgggatgaaacatacaagaaaacgcaagagcacattgaggcaattgcagagtatggaaaaccaggaagagcaaaagaggagaaaaattctctcgccagattgaatgggattgctcaagatggcttggctctcctttcttccttcctcttcaccctcgatcttcttgctcctcaattgccctctgagccagagaactacttctgggtggcggagaagagtccacagttcgcagacgcaatttacagtatgacctttatgtctcatttggctgggacaaaagctggaatgacatctgctgcagagagcatcacggaaagccttcgtcgtactcgtcaattgatggttcaggctgaaagtgaatataaagggcaccgctcgttgttgatgagaacacgaaatctcctctccacaatgcaacgtcaagatgtcatagacagggtaataatcggggttgggtttttgttgttctcccttgctgttctttatgttgtttacaagcgaatcggactacttacgttgcagagaaaggtaactgaggccataaaagccggtatggtgggacaggcagagctaagaccccaagctgttgcagatgacttgaatcttcatcaagtcagaggcgactgtgttcataatgcagaggctcctttagaacaaagaatacatgatgaactatga

SEQ ID NO: 43484 - DNA, 1662 bp, Glycine max
  Peptide Sequence Number=SeqID_135169
atggaaaccggcgccggtggcggtggcaaaggacaacaaggcggtaaaaccggaataggaattccgcaaaaaccgccagaggaaccgaatctgcgaccagaatggcggcgcccaaccagaaccgagcaggatgtggttctgcaacctgaatggcggcgaccaaggcctagtgctcctctttcagaaccttccaatcgtgtcgtcgaagaggagttgctattccaaccggaatggagacgctcaaagccaagtgcgagtgctattgcgaatgccaatgcgagtgtttgggaacctgaacggaggcgatcgagaccaacggcaacggcgtttccgtggaaccagaattacggcgttcggaaaggtatggcgtcgagttccggcggcggcggcggggttgaaagacgcggagaccctaacgacctttggcgacgacctgctcctccggctacagattctgtagttcccaaactggaaaaattacagatatcgaaacagttacctgcctcaacttgtacccttgaaaaaaaggataaaatttcacctattcagagacctgacaatggtggcacgttagcaattctaacaagcagacttcgtgtcaatcatttcccagttaagtttgatccagagagtataataatgcattatagtgttggtgtcaaacctaaggtttcttcaaaatttggccagcctcagaaattatcaaattctgatctgtccatgatcagagagaaactgttttctgatgatcctgagaggttgcccttggagatgactgcacatgatggtgcaaaaaatatttatagtgctgtacaattaccagaagagacctttactgtggagatctctgaaggagagaatgaaaaggccatttcatatagtgttaccttaactcttgttaataaactcaggctttgcaagttaatggactatcttagtgggcataacctctccattcctagggacattttacaagggatggatgtggtggtgaaagagaatccagctagacgtgctgtttctgtaggacgacacttctatcccacaaatcctcctgtcataatgaaggatcttcaccacgggataattgctattggagggtttcagcatagtttgaagcctacatctcagggtctgtccttatgtgtagactactcagtattggcttttcgaaagcaaatgtcagtcttggatttcttgcatgagcgtattgataactttaaattggatgaattcgaaaaattcagaaaattcattgaggaggcacttattggattgaaagttaatgtgactcatcgtaaatgcaatcggaaatacattatttcaagattaacacctatgattactaggtatgtcacttttcccattgacaatactggtggatggaactcaaatgatgttagtcttattaccttttttaaagaaaaatatggcaaggatatcgtgtacaaagatattccttgtctagatttagggaaagacaggaagaagaactatgtacccatggaattctgtgttttggttgagggccaaagatatcccaaagagcgtctggatggtatttctgcgaatacattgaaagcaatgtcactagctcacccaaatgagagggagtgtgcaatacaaaagatggtgcaatctagtgatggaccttgcaggtaa

SEQ ID NO: 43485 - DNA, 942 bp, Glycine max
  Peptide Sequence Number=SeqID_135170
atggcagttgaagctagttacatgaatctcttgccttctcagttactcactaacagagaaaccatcaaatccaatcaacaattacagcatcaattgaactctgattacatgtacaacactacccagatggattcttcttcagctttgcctctaccagcagcaacaatgcctgaatcactcttgtccttctatcaatccaacttttgtgatccaaacaaggcagatagtggtctcacctaccatattcctctccagagaaaacgttcaagagatttcaccaccgagttaacctctctcccagctcaccagaagaacaaaatctcctctgagtcttcctttctcaaccaagagattctctaccaatttcagaaccaacaatcagaaattgatcgagtccttgctcatcatactgagaaagtgagaatggagttggaggaacaaagaatgaggcaatcaaggatgttggtgagcgcaatccaagaggcaatggtgaataagctgaaggaaaaagacgaagagattcagcgtatggagaagctgaattgggcccttcaagaaagagtcaaaagcatgtgcatggagaaccaaatttggagggaattggcacaaacaaacgaagccacagccaactacctaagaagcaatttggaacaagtcttggcacatgtcggcgaggaacgcgccaccgcggccgaggtggccgatgatgctcaatctagctgtggcagcaatgatgcggcagacgccggagacgacacggcggcatccacggtggcgaccggtcgtggtaggttgtgtaagaactgtggggtgagggagtcagtggtgttgttgttgccatgcaggcatctttgcctttgcacaatgtgtgggaccacaataaggaattgccctatttgtgactctggcatggatgctagtgtgcatgttaatctctcttag

SEQ ID NO: 43486 - DNA, 939 bp, Glycine max
  Peptide Sequence Number=SeqID_135171
atgatgacaccggaatcattggaggagttggaaaaacatgcaatctcgggtcatcatgtgagggggaatagtgaatatgttagacttgccatatcggatgaaccgagggctgttgaaactgaaatgctacagcctctagcagactcaagaatgaaatctttcatgtggtggattaaagtctttttatggtgctttatcattgttatacttggtcttgttatattgaaatggggagtgccatttacttttgaaaaggtcctttatccaatcatggagtgggaagcaactacctttggccgtccagttcttgcccttgtacttgttgcttctctggctttattcccagtattttttatcccttctggcccttccatgtggttggctgggatgatttttggttatggccttggctttgttataataatgattggaacaaccattgggatggtcctcccttacttaattggactaattttccgtgaccgcattcatcaatggttaaagagatggcccaagaatgctgcaatgattaggcttgctggggaaggaagctggttccatcaatttcaagtagttgctctatttagagtttcaccttttccatataccatattcaactatgctgtagtagtgacaaatatgaggttttggccgtacttatgtggatcaatagcaggaatggtgccagaagctttcatttacatctacagtggtcgattaataaggactttggcagacgcacagtatgggaagcaccaattgaccactgtggaaatcgtgtataacattatttcatttattgttgctgttgttaccaccattgccttcactgtttatgcaaaaaggaccttaaatgaactcaagattgcagaggccaatcaggaagctgcctctgtatctgggagtggtaatcttgagatggagaaaggttcccattga

SEQ ID NO: 43487 - DNA, 1716 bp, Glycine max
  Peptide Sequence Number=SeqID_135172
atggtgcaggtgcaggtccagatcatgccggaacacaattccgatcccgccgcccctccgcctcctcctccgccgccgcacaaccgccggccgagggtccgagaggtcagctcccggttcatgtccccatccgtgccgcgccgcccgcggacgacggagccggaccccgatgagaattccgaaaccccgttcccacttgggtgttctatttctcagagaaaacaaacacaaacaccacaacaacaacgttcgatgaagcttttcaaagagaacaacaacaacgagcatgttccaccgcaccctcacccttcaaagtcatgttctggaagaattggtacgccttgtgtttctaggcctggcactcccactccctcggtttacgtgtcttctaggtatagacaaacacaacaacaccatcatcatcataataataatcaccatcatcatagatttgttaatggcatggcctctgctgctgaaaaattaatgcaagccagtggattgaatcaggctaagtccagtgctgcttgctccagtgataattctggagtgaattgtagtattcagtcacttcctgaattgggggagagagagatgttgctgcaatccaatttgtctgcgggtgagaaaattgggagtggcaatggtggtggtggggacttgaagtttcgccacccttcgcctttgtcgcggtcggttactttgccttcttcggggggtgagaacaaacctccggcttctgtctccaagcagcatgggagtggtaatcagttggctaagtcaggggggcttagtttgccgccggtacctcctcagtgtggaaagccagcagtggatgtgaggaaagggaagaaaggatctagtcatcaggaagatgtgcattctcttagattgttgtataatcgatatttgcaatggagattcgccaatgcaaaagcgcactccgtgatgaaagctcagcaaacagaaagccaggtggttagttctatgatcatagttctctggctgaatagaacaagaggatactatggagggttgtttgatcatgagttagaaggttttaaattgtgtccgttgttaccttgcggttgttgtgactggatgcggttggatgctgccattgcaatggcagcaatcaagaaagcactatattctcaagcaatgagaatatcagaaatgcgtgattctgtgaacaagaaacgcatagagctggagcttttgcggagatcaaagactctgtcaacaattcttgaagctcaaattccatatctagatgagtggtctacaatgatggaagaatattcagtctctattacggaagcaattcaggctttagtgaatgcctcagagcgacttccagttggtgggaatgttaggacaactgggggaggcactgaattcagcatcgaagatgatggaaacaatgatttccaatatacaaagattcatgccaaaggtgaaacaaataagagaatggagtttcatgcttgcttttttaacatggatattaaaattggactagtcattaaactggcagaagaaacagacgtttccatttcagaattagccagagttgctggtggggaaagagctcttgttggagaatgtggagatttattatcaaagacatacaaatcacagttggaggagtgcagcttaaggggtcagctaatccaactgcattcagttcgcgacaagaataagaatgaagaataa

SEQ ID NO: 43488 - DNA, 1821 bp, Glycine max
  Peptide Sequence Number=SeqID_135173
atggctatatctgctattgaaacatcttacaatgacttgaactctgagacattctttgagttggctgttgcttctcatagtgctgaggattattgtcaagctactttcaaaggatgccatcattgccctcttgacttcatgaacaatgctttaaaggctacaatttccaccgacccagaaaaaggtttggtgaaaaatgccaatggggttctcgtttcaaacaaaggaacccccttaatacccaagaatttgagtttaaaaccaaggtcttcggatgatgcactccacaaacgcaacgcggagataacgattcacggtcgccccggcaagctcgaagaagcaaagaagctgttcgacgaaatgcctcaacgagacgacgtttcttacaactccatgattgccttttatttgaagaacagggacatacttggagctgaagcagtattcaaggcaatgccacatagaaacattgttgccgagtctgcaatgattgatggttatgttaaagttggtcgtttggatgatgtccgtaacgtgttcgacagtatgacccatagcaatgcattctcctggacaagtttgatttctgggtattttagttgtggaagaattgaggaagctttgcacttgtttgatcaagtgcctgagagaaacgtggtgttctggacttcagtggttttgggttttgcttgcaatgcattgatggatcatgctcggaggtttttctatctcatgcctgaaaagaatatcatagcttggacagctatggtcaaggcatatcttgacaatggctacttcagtgaggcttataagctcttccgtgaaatgcctgaaagaaatgtacgttcttggaacatcatgatctcgggttgcctaagggtcaatagaatgaatgaggctatagatatggctgcatggactgcaatgatcactgcatgtgttgatgatgggctcatggatgaagtttgtgagcttttcaacctgatgccacagaagaatgttgggagttggaacacaatgattgatggttatgcaaggaatgatgacgtaggagaagccttaaggctattcgttttgatgctaaggtcttgctttagatccaatcaaaccactatgactagcgtggtaacttcctgtgatggcatggtggagctcatgcacgctcatgcaatggtcatacagcttgggtttgagcacaacacatggcttacaaatgctcttattaaactttattccaaaagtggggatctttgctctgctaggcttgtttttgagctactaaagtcaaaagatgtagtatcatggactgccatgatagtagcctactcaaatcatggacatggtcaccatgccttgcaggtattcacacgcatgctagtatcaggaattaagccagatgagatcaccttcgtgggactcttatcagcttgtagccatgttggtcttgtcaaccaaggtagaagactgtttgtttcaatcaagggtacatataatttaaatcctaaagctgagcactattcctgccttgtagatattctaggtagagcaggacttgtggatgaagcaatggatgtagtatccactatccctccttctgagagggatgaagctgttcttgtggcattgcttggtgtgtgccgtcttcatggggatgtcgcaatagcaaattccattggtgagaatctattagagatagagccatctagttcagggggatcacatccccagattgaggaaatttacgtattgttgaaacagaatcttcaacctttgatgagggaaatgggttgcacaccagagaacttgctactcgtagattaa

SEQ ID NO: 43489 - DNA, 633 bp, Glycine max
  Peptide Sequence Number=SeqID_135174
atgtacagaaataatgaagctgatgagcagcagcagtcggaaccacaaatgcagcatttatctgcaaatggaatttctcatgcaggtattggtactcagaatgttcagtatgcaacacctccgcagcttggaactgggcatgctgtgtggtttgcatccttagtgctctcattggagctggtaccacccacttacccatatccagatccatactacagaagtatctttgctccctatgatgcacaaacttatcccccacaaccttatggtggaaacccaatggtccaccttcagttaatgggaattcaacaagcaggtgttcctttgccaactgatacagttgaggagcctgtgtttgtcaatgcaaaacagtatcatggtatattaagacgcaggcagtcccgtgctaaagctgaatcagaaaaaaaagctgcaaggaatcgaaagccatacttgcatgaatctcgacatttgcatgcactaagaagagcaagaggatgtggaggtcggtttttgaattcaaagaaagatgagaatcaacaggatgaggtagcatcaactgacgaatcacagtccaatatcaatctcaattctgataaaaatgagcttgcaccatcagatagaacatcctaa

SEQ ID NO: 43490 - DNA, 1200 bp, Glycine max
  Peptide Sequence Number=SeqID_135175
aatgttcctcctgctttgcttgttcggtttttgagggagcatcgatcagagtgggctgattatggagttgatgcatactctgccgcatgccttaaagctagtccctatgcagttccttgtgcaagacctggaggcttccccagcacccaggtcattttaccccttgctcatactattgagcacgaggagttcctggaggtagttcgaatagagggtcatgcattttctcctgaggacgtagcgatggcacgcgatatgtatctattgcagctgtgcagtggagttgatgaaagtgcagttggggcatgtgctcaacttgtgtttgcacctattgatgagtcatttgctgatgatgctctgttactgccatctggttttcgtgtcattccgttggatcctaaatcagttgagtttcatttctttgcgacttttatgattttcctagagcttggtcatgaaactactgatggtccagctccaactaggacattagatttggcatcaacgatggaagtaggttctggtaatgcccgtccagctggggaagcagacttgaatgggtacaaccttaggtcggtcctcactattgctttccaatttacctttgagaaccatacacgggacaatgtggctgctatggctcgccagtatgtgcgtagtgttgtgggatcagttcagagggttgccatggcaattgctccctccaggctcaatacccagttggctccaaagtctcttcctggttcgcctgaggcccttaccttagcccggtggatctttagaagctataggatgcacactggtacggagctttttaaagctgagtccacagctggtgatgcaatcttgaagcaactttggcaccatcccgatgcaatcatgtgctgttctgtgaaaacaaatgcatctccagtgtttacctttgcgaaccaagctgggttagacatgcttgaaactactcttgtcgcccttcaagatataatgcttgataaagttcttgatgaatctagcaggaagattctttgctgtgagttctccaagataatgcaacagggttttgcatatctcccagcaggaatatgtgcatcaagtatgaatcggccagtatcttatgagcaggctgttgcatggaaagtcctcaatgatgatgattctaatcactgcctagcattcatgttcatgaattggtcttttgtataa

SEQ ID NO: 43491 - DNA, 528 bp, Glycine max
  Peptide Sequence Number=SeqID_135176
atgtatgataacataatatctgaagaagttgatatgaatgaaaaaaatgaagacaaagctggtgtgaatgaggaacatgttgattgttcttactgggagtatgttgatgctttacattctatgcaaaatagtaattcttcagtgaaacatagtgcatcatcgtctgaccaagcaattctaaaaaggactatgccgatgttggatcaatttcatccgtgcattcatgattccattgaaaacattgtcaatgtcaaagctgatagtaactgtggatattgtgtaattgttgccttattaggtatgggtgaagattcatggtctttggtgtgcaaccatttgcttaaagaagttgccaaatggtctgatgagtatatcaacctcattggtggcatagaaaaatttgatggattatccatgatttatttaagagatcgttgtcccttaccgcatctagctttgttatggtctagaaattgtcatcctcaggcaaagcagtggccaactccatatattagtagaatgaagtag

SEQ ID NO: 43492 - DNA, 801 bp, Glycine max
  Peptide Sequence Number=SeqID_135177
atggaattgaaccaagcactctcttttaagaaaaggttctatcatgtcataatcaagagcctagaagtagctagtttgcaagagctagggcagcgaatgaatctacttcaacgtcaaacctttcgcaagacatatgaaaagatctgggattttgctatgatagaagtgtttgttaaagccattgcatccctcgctcaatattatgaccggtcgctaaggtgcttcacgtttggggactttcagttagtaccaatcgtagaagagtttgaagggatcttgggatgcccactaggaggaaagaagccgtatttgttttctgggttatacccctccatggaaagagtagcaaagtggacttcattcattgacgttttggcacttttggtgtttgggatcgtcctctttccaaatgcagatgggctagtggacctagcagcgatcgatgcttttcttgcttatcaccatagcaaggaaagttcggtcgtcactgttttggccgatgcttatggtcaccacatgtgtgccgagaaagggaaagcaaattgggagaagctcttggctggcatggataaagagcttagaggaagcggcaatagtgttattggtggatatcatcaatggttgaaggctcagacgcaaaggctaactttgctcccgaagctaaagatttcaagtggtaaagaagccgaagtcctagaggagagcaaagaagaaaagttcaagacggcagccatcagggccaggaaagagtatgacaagctgagggacgtcaatgtggccatagccgaagcattaaaatga

SEQ ID NO: 43493 - DNA, 524 bp, Glycine max
  Peptide Sequence Number=SeqID_135178
gaggttagagatgcagatgctccagttcctgtacccactgatgaggtttccttagtggggcaggcacttcacaccttccttgcttggccgacacatctggtagctgtgtctccgccaaaaccaccttcgaagcctgatccggaggtcgatgatccactttatctgatgacattgaccatcccagagcttttcctgaggccttatcagcacgaagacctctccgaaatcgcacacggtggtcaatgtctcagcatatcagtgttacagttgcatctcactgaaacatgtatgcgagcggggaattctgatatctatggattcctcgagcctcaatccattcagaggtctgggcaatcgcagtttgaatctgaaagttacataaagagttggatgcagagttcacaacgcaatgtgtatcttggagcctacctaaatgggccagacaactaccttaaggggattattaatagtgctatcaagggtcttgatgatgctccacagcctaaatcaaaggctcctgctag

SEQ ID NO: 43494 - DNA, 168 bp, Glycine max
  Peptide Sequence Number=SeqID_135179
atggtgctcaaccaaatgatgatgaaagacacttaccggttgaaggagactcttctctccttcagagtattttggacaggtttgatggacttcaaacctatgttggtgagagatgtcaccatcattcgtgactaccttgatttacctccaccaccaccatcagtttag

SEQ ID NO: 43495 - DNA, 471 bp, Glycine max
  Peptide Sequence Number=SeqID_135180
atggctccaaagaagctcccagctaagagggcaaggaaagatgccgctggagaaggttccagtatggccccacaggtggatgtggagttcaaaggacataggttccgaagtgaggagcaccagcgtcgttttgaggcaattaagggttggtcgttcctcaaggagaggggggtccagttaagggatgaagagtacactgaatttcatgaagaaattgccaagaggcaatggactcagcttgcggcacccatggctaagtatgatccaaaacccacggaggaaggagtcagagacaagcgctcttgggtgaggggccaatggatcccctttgataaggatgccattaatcaatttctggggcatccattggtcttggaggagggccaacgctgtgaattcagccataggaagagtcaggcctcagggttcgacgaggaggccatcagccaacggctgcgtgttcctgggtag

SEQ ID NO: 43496 - DNA, 759 bp, Glycine max
  Peptide Sequence Number=SeqID_135181
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttactggagtctcactctgttgcccaggctggaatgcagtggcacgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 43497 - DNA, 123 bp, Glycine max
  Peptide Sequence Number=SeqID_135182
atgcaggggaaacatcgcggtggggtgggatatcgccagtcgagaacgactttgaatggcaatctgaagggaagagacaccaaaaatgggttttcctttgccggcagtcccttaccttgctga

SEQ ID NO: 43498 - DNA, 411 bp, Glycine max
  Peptide Sequence Number=SeqID_135183
atggcttctccacctgcctcccctccttctcctcctcctgctccttccgacgcatcggctttgccgtctgccgtgaagcgaacacgcaaagcctcacgcctacaatcgttgtctactagaccacctggtactaagagaccagtggtgcatgttgatcatactaccggcaaggccgacggtccccacaagaagaaattaagaacatatttggggattgtggtgcgtgataaggtggacgtcacctatgatcactggaaagaggtccctactgctcagaaggacttgatttgggaggatattcaagcggaatttgaaatcctagagacttctgacagtaggacgaaaaggaagttacttcataccgtgggcgagagatggaggcagtttaaatcagacctcacgaggaaatga

SEQ ID NO: 43499 - DNA, 180 bp, Glycine max
  Peptide Sequence Number=SeqID_135184
atgccgatctccccctgcggaagtatcagttggtctgtgccgtcccgggatcgtgcccttaagacacccagtggactcggagaagtccaacagggtcttggggtttccagctctgattacgggcctctgtcagttctacgaagtgcttgtcgccccaagcaagatgagaaaatgacttaa

SEQ ID NO: 43500 - DNA, 1272 bp, Glycine max
  Peptide Sequence Number=SeqID_135185
cgttattggtgttcggagtcgtcctctttccaaacgtggatgggctagtagatctagcagcgattgatgtttttcttccttatcacaacagcaaggaaagtccagtcgttgctatgttggtagatgcctatgacacatttgaccagagatgcgagaagagaggagcaaggattgtctgttgcacacccgctctttatgtatggctggtttctcacattttccgccatgaaagtagactcacctgtcccctacaaggtcactgcatgtgtgccgagaaagggaaagcaaattgggagcaactcttggctgggttcctgaacgtccccttgatgggaacgaggggttgcatcaattataatcttatacttgtcataagacaacttggctaccccatgagaggagcaccatcagaagagagtattgcgcctttcatcacacgaggcttcggtgaccccaattcaagaatgcttcaaagcgctgaggtccccgaggagagcaaagaggtgcaacccttaatggaactggaaagaacccaaatagtcaaggaaaagttcaagatggcagccatcaaagtcagaaaggaatgtgacgagctgagggatgtcaacacagctacagccgcagcattggaacgagaaacaaagacggcccgaaaagaggaacgaggccgaaacaagttccgaggggctttatggggtagcaacaacaaactcaagttccgaagggccaagagggaccaaccgagaatcgaagggatgatattagaagacaagttaaaggcttatcaaaggtcaaagagaatcttatccaaacaattgagtaggacagaagagaacatgtgggctatcattgagcagtataaagaaaagttaaatctagctgcaacccatgagcaaaggctagaggacaagtatgcaaaagtatctgtcctgcaagcggaaagggaagcaagggagagagtgatagattcattacacagagaagctatgatgtggatggataggttcactttcactttgaataggagtcaagagcttccgcggctgttagccaaagccaaggcgatggcggacttgtactcggctcccgaggaagttcatgggctcctcaattgttgccgatatcgaggccttgaaggatcgaatggcctcatgatggaggacatgttaagcatgaagcgaatgatggaaagcaattcgaccgcagttgccgccaatagtacctccgccgaggcggatcttactcatccattcaccataacccagtggacca

SEQ ID NO: 43501 - DNA, 438 bp, Glycine max
  Peptide Sequence Number=SeqID_135186
atggtggaggcctctggtaatcgattaccagtctgtgtaatcgattacacagaggaatgggtcactggtaatcgattaccagcctctggtaatcgattaccaagtctgtgtaatcgattaccagagatgaaaagccttaagataccccttttaattatcgtgatggcggcacagctaatccatgatcgagtggagatggagtgcctagagggagcttgggagaccctcgaaggcaacacgaggtgccgatttcggggcaccattcgattcacggctacttctttggtgcatccagatgaacctgcacagacgcttcagcgcacggtggagtggatactacccacgcctacaccatatcgtctagtggagcccgtccaagtgatcgaggtaacgtcatccaagaagaccctgagaggatctggaggagctacctcctga

SEQ ID NO: 43502 - DNA, 658 bp, Glycine max
  Peptide Sequence Number=SeqID_135187
aaaaggacacgctttacggcgcccttaccgaactcgtgctagagctagagtaatgggtgaagcagaggaggtgcaagagaagatgaaggccgacatggaggccatgaaagagaaaatggccacaatgatgaaggccatgatgagcatgaagaagataatggaagccaatgcggttgcaattgccgctaccagcgttgttgctaagatgaacctgatgtccccatccggcatcaaccaaatgaatcacccaacctcagatatggtaggcaaagatttgggaagtacgggcagcccccataatgtacaaattcaaaacgagcacgccttcccgtcatatggcttgcctctcaactatacgccacccaatgaggcgtacactcccaataagaatacccatgaaattccccatcacaatctagccgacttcgagccttggctcggatataccactgaagggcaagcagttggtggtataccctacaaaaccctttggagggccctcagtatcacccacaactgcacctcttgcattccacagcggttaaaaaccctcatgactatggcaggaatgggaaagttggatcatctagaggaaaggctcagggccattgaaggaggtgaagattatgcctttgctaacctagaagagtgttcctaa

SEQ ID NO: 43503 - DNA, 663 bp, Glycine max
  Peptide Sequence Number=SeqID_135188
atggggacaaatcaaaccggcaagaggttttaccaagtcaaggttaaaggcctagataccaccagcatcaaggaattagggcagttgatggaacctctccaaatgcaagccttccgcaagacttacggaaagatcttagagttgaccatagcaaaggtatccatagaagccattgcatcactcacccaatactatgaccagcctttgagatgcttcacgttcggagacttccaattggtaccgaccattgaagaatttgaggagattctaggatgtcctctcgggggaagaaaaccatatcttttctccggttgtctcccctctttgagcagaattgcaactatggtcaaggattcagcaagaggtttggaccacgtaaaacagactcgaaacggcatagcgggcctaccacggaagtacctagaagacaaggtgaggggtatggccaatcagggagattgggtcccgtttatggatgtgttagcattgctaatttttggggtcgtcctctttccaaacgtagatggtttggtggacctagcagcaatcgacgctttccttgcatactaccatagcaaggaaagtccggtggtagctgtcttgacactaggcatccaagtccgctccaaagccatcgctcgtgtgctgaaaagaggagaataa

SEQ ID NO: 43504 - DNA, 863 bp, Glycine max
  Peptide Sequence Number=SeqID_135189
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctcgtagttctggaggctgggaagtccaagatcaagacactaggagatacagtgtctagtgagggcctgcttcctggttcacagatggcacctcttgctgtgttcttaaatgagggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43505 - DNA, 174 bp, Glycine max
  Peptide Sequence Number=SeqID_135190
atgactctaaagaaaaagatgaaggaagcaatcaggattctcaagacaatggggatagaggaaataatgaacttccaagagaatggaaagcctcaagagatcatcccctcgacaacattattgcatgggttgagcataacttttctggcaccaagaacccctcaacaagaatga

SEQ ID NO: 43506 - DNA, 290 bp, Glycine max
  Peptide Sequence Number=SeqID_135191
gtgctggtgcagtcacttcatttggttactgtaaggatcatgatggtcaatggctgaagaaggacgcactccctctgcaagacgagcgtactccttctccttctcctcagcgagatgcttcagcccttatgactgaagttctttcagagttacggggtctccgcacctatgttggtggacgattcgattccttggatggtcgctttgaaggcatggatactcgcatcacccagcttgaagaagacgtgggttatcttcgtcggtgctttgaccttccaccaccgtcttag

SEQ ID NO: 43507 - DNA, 291 bp, Glycine max
  Peptide Sequence Number=SeqID_135192
atgggatcaagtcaaaagccttcgcttaaaaagaggttctatcaagtcaaaatcaagagcttagaggtcactagtttacgagagttggggcaattaatgggtcaacttcaaccgcaagccttccgcaagaattgtttgttgtgcactggctctctatgtgtggctggtttcacaccttttttctccaagaaggtaggcccgtctatccgctacaaggtcaccgctcgtgcgtcgaaaagggaaagggtaattgattcattgcaccaagaggcaacaatgtggacggactga

SEQ ID NO: 43508 - DNA, 415 bp, Glycine max
  Peptide Sequence Number=SeqID_135193
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttcccccctggcggctccctcgtgcgctctcctgttcctgcctttcggtttaccgggtgtcattcccgctgttatgggcgc

SEQ ID NO: 43509 - DNA, 474 bp, Glycine max
  Peptide Sequence Number=SeqID_135194
atgtcatttaagacttgtgggaaagcttgggctgagcaaatgagaaaaatgagtgacaaagcagaatttttgttcttgagcagaaaatgcttgtgcattgctggttacgggaaagggtttgatggggaccccgtgctaagaggaacaaggataagggctacgtgggggtacgtgagctcagttgaagagatgatttgcaccatcgcccaatcgccacctagtaccacatatgacggagtggtacctggagatatgtcgtgggggtcaggagaccttggggacgtcaggcgagctcctggcagtcaaccaataaaagaacaaagaccacaaagcaaggaggcttgtgtggtggctggccagctatggatcttgagtggtatctggattttggcctctggtaatcggttaccaagggaagttgagatggcctctggtaatcgattaccaagggttgtaatcgattacaaggcttag

SEQ ID NO: 43510 - DNA, 456 bp, Glycine max
  Peptide Sequence Number=SeqID_135195
atggctgaagatcaacctagaagagtcacccttaaagattactctagttctactgtgccgcaattctttacaagcatagcgctactagaggttcaagcacataacattacttatcctcattctttgatacagctaatacagggcaatttatttcatggcctacctaatgaagacccttatgcacacctagcaacctacattgagattgtaatacaaccaagatttccgaaatattttctcgagtcaaaaatagcaaaaggaaaagttgtcatctctttttttcaccaattcctagatgaatccttgagtgaagttctagaaagattccgtagcttgctacgaaaaactctgactcatggattcccagagccgattcaacttaatatctttattgatgggttaaggtcacagtcaaagcagtttcttgatgcttctgcttgggaaaaatcaagttga

SEQ ID NO: 43511 - DNA, 610 bp, Glycine max
  Peptide Sequence Number=SeqID_135196
atggccaccagccaggatcataagcgtgtgggcaatggcgataccggcccgaataccggcggaatgggggcttactcccctgctccggtggtcactgatgaagtgcaccagcgcacgatggatcgtatcatctggccaactgtaaaagggatggctgccgaggggaatacgtataccggtttcctctatgcgggcctgatgatcgacaaacagggtaatcctaaggtcatcgaattcaactgccgctttggcgatccggaaacccagcccatcatgctgcgcatgaaatccgacctggtagaactgtgcctggcggcatgcgaaggtaagctggacgagaaaacgtccgagtgggacgagcgtgcgtcactgggcgtagtcattgctgcgggtggataccctggccactacaacaccggcgatgagatccacggcctgccgctggaagaggttgaagacgcgaaggtattccacgccggaacgaagctggctgacgatgaccgcgtactgaccaacggcggacgcgtgctgtgtgccaccgcgctgggccataccgtagcagaagcgcagaaacgcgcctatgcgctgatggcggatattcactggaacg

SEQ ID NO: 43512 - DNA, 90 bp, Glycine max
  Peptide Sequence Number=SeqID_135197
atggatttgctgggtgagacctcctttaagggcggtgacattgaagcacactctagctccatgagggaaatcagtgcgcagacgtgttag

SEQ ID NO: 43513 - DNA, 193 bp, Glycine max
  Peptide Sequence Number=SeqID_135198
agtacctgtaacctccagcaagggcatcaggccccctactgatcgagctttcatcaagaagtactgcgtccctaggcaggcgcagggcgaaacaccacagcagcattgggatggccggatgcacctagttgctcatgatcctggggatttaaataaaacaagcgcaagctcggaaggtagcaaggtaccttag

SEQ ID NO: 43514 - DNA, 378 bp, Glycine max
  Peptide Sequence Number=SeqID_135199
atgcgtagagatcggaaaaaaacccccacggcgaaagcactctgctgggccgacactgacactgagagacgaaagctaggggagcgaatgggattagataccccagtagtcctagcccgaagaaccttaccagggcttgacatgccgcgaatcctcttgaaagagaggggggccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 43515 - DNA, 114 bp, Glycine max
  Peptide Sequence Number=SeqID_135200
atgaagatgctcttgataccacatgttatgaatggcagtggaatggtgaaggaagagagagaggagatgccacttcaaggagacgatgagtctagaagaagctcaccaccatag

SEQ ID NO: 43516 - DNA, 531 bp, Glycine max
  Peptide Sequence Number=SeqID_135201
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtttcttcctggggctctgaagtatctgaaaaaccaggaaattccgccccgtggggataagccactagttccgtcgccgcatcgagaccgagcggtaggagctcaacgggaattcgcgcctatagtgagtcgtattacaattcatgctgacgcaccggtgcagccttttttctcctgccacgaacgcacttcactgaaccctcatcagttgccaactagtaatcgccatatacacatccccctttcgccggcaatagcaaacccgcaccatcgcccttcccaacgttggccgattcaccttaatgcagcgaatggcgacggtttcccgtacgggcattaa

SEQ ID NO: 43517 - DNA, 204 bp, Glycine max
  Peptide Sequence Number=SeqID_135202
atgacaaataatgaacataaaactgaaaaagaacatgaatctggggatctcccagtcatgtggctccactccctcccaagaagccgagcaaatctgacatctcctcatccatgccggcctcctctccatcgtcgggagcctctgcgggtgcctaccctgcctgggcctcgggtcaatccccgggccatgcgacctctgccttga

SEQ ID NO: 43518 - DNA, 324 bp, Glycine max
  Peptide Sequence Number=SeqID_135203
atggtggtcattctgcccaaggaaaatcttgttgtctggtttttttccttgcataacaggccagacaactactttaagggaataattaacagtgctttgaaaggacttgatgatactccacagcctaaatccaaggctgctgcaaggtggattgtcgttaagtgtaatagacaaaaaggaagcactgagtgcggctattatgtcatgcactggatgtccaccatcatcttaggaagtttcaggaataactggaaagtgaccattggagctagagagattaaaggtgcttcgcatccagtgggcatgatattatctccgacttag

SEQ ID NO: 43519 - DNA, 453 bp, Glycine max
  Peptide Sequence Number=SeqID_135204
atgcttgctataagacagttagggtacgccatgaggggagcaccgatggaagaaagcttgtctcctttccttgtgagtgattttggcacgcaaaatttcaagctgaaagttcgtacacggggtttagattggctcgccaagttaaagattatcaacgaagagaatttcgaagctccggaagaggatgaagaagtccgagctctaaaaacccgaactaggaaaagcgagactcgccaaagaaaaatttcaagttggtcactaaagacgtccggaaagagtgtgccgggttacgagaagaaaatgcagctaccgcaaaagcccttgaacaagaaaccaagagggctcgcaaggaagagcatgttcgtgacaaattttcgtggagtcattgtgggggcagcagacagtgagctcagcttcaaggtgaaggaggagagacgaatcatgagcacatag

SEQ ID NO: 43520 - DNA, 858 bp, Glycine max
  Peptide Sequence Number=SeqID_135205
atggggacgaggggttgtattaactataatcccgcacttgccataagacagctagggtaccccatgaggggagcgccaacggaagagagcctctcgcctttccttgtgagagattttggcgtgcaaagtctcaaggttgtagaaagagtccacaaggcgtggagaagtccattgaggaaagataaagaacttaggggcatccgtaatggcatcatcggtggttatcatgaatggctaaaagttcatacgcgagggttagattggctcttcaagttgaaagttgtcaatgaggagaactacgaagctccggaagaggatgaagaaatccaagctctaaaattagagctagggaaggcaagactcgccaaagaaaaattcaagtcagccgctacaaacatctggaaagagtgcaccgagttacgagaggaaaatgcggccactgcaagagcccttgaacaagaaaccaagagggcccgcaaggaagaacatggtcgagataaattccgaggagctttgtggggtagcaacaatgagctcaagctccggagaaaggaaagagaccagtcacgggtacatggcatgatcttaaaagaagaattagctgcttgctcaagatccaagaggagattggctcaacacttggaagccatggagcaaagtatgctagctatcatagggcagtacaaagaagagttaaaccattcgtggacccatgaacaaaagctagtagaggatgtcgcacaagcgtacgccgaaaaggaagcaagagggagggtgattgatgcactgcatcaagaagcgaccatgtggatggataggttcgccttgaccttaaatggaagtcaagacctcccgtga

SEQ ID NO: 43521 - DNA, 178 bp, Glycine max
  Peptide Sequence Number=SeqID_135206
atgtagctcctatggagcttgtaggccttggatcttcttcatcaacggagtccttttcttcttgaagatcatggcagcggaatggataaggaagaaagatgattggagacgccacttcaaggagaagatgagtctagaagaagctcaccatcataggaagccacggataagagcttga

SEQ ID NO: 43522 - DNA, 447 bp, Glycine max
  Peptide Sequence Number=SeqID_135207
atgattaacgctgcggccagaaaagaggaagagtgtgcagagattgaaatacatcaagaaagcatttgtcaagttacctctatccatcatcaattgaccaatgaagaggaaaagcctgaagtctccaatactccagaatatccctacttggccactgttggctatgttggagggaaagataaaggtagattggaactcagcgtggaggatcaaaagatctcttttgacctctttgaggccatgaaacactcagatatgggtgatgcctatttcgaagaagaagaggtggagcaggaaataacattattagcctcaaccatggtgctacagtctcctttggaaaaagaacctggctatgggagagattgcttagcttgtgatgaagagcttgatgattcaaaagacaattatgttgacaaggttgttttgaagaattggaaaaactga

SEQ ID NO: 43523 - DNA, 420 bp, Glycine max
  Peptide Sequence Number=SeqID_135208
atggatatgaagttggggtccctcatctcaggtcaaatctctcttatggcacatcacgactcctcgaggctaggttttccatccttgattactgctttatgcaaggcccaaggagtcacatctgattctctgacctttgaatccctgagcccagccattaatttggtgtatattataaagaattgctggaacttggatgacccttcgaccacttttcggggaacacgcaaatctagggccagaggatctgaggcaccatctacttcagctccccctacctcagctcattctacctctcctctccctccagcaccagcatctccagttcttccggatccttcttctcagagcttcgagccttccttgtctatgctgcagagcatacatcagggccaactcctgatcatgaagagtttgtag

SEQ ID NO: 43524 - DNA, 390 bp, Glycine max
  Peptide Sequence Number=SeqID_135209
atgcagatttgtgaccattacagtcgaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43525 - DNA, 177 bp, Glycine max
  Peptide Sequence Number=SeqID_135210
atgataaatgcaggaatgatatgtccattacgatgccatgaagagatgcatgatgcgatcaaggaacaagccagaggtcgacaagggtgttgcccttgctcctacgtatcctcaggtgcgatgaggaatttagacctacgtagttctttaagtctgaatgtttgtgtgttaaattga

SEQ ID NO: 43526 - DNA, 420 bp, Glycine max
  Peptide Sequence Number=SeqID_135211
atgggtaaagtagaggaggcgcaagagcaaatgaaggccgacatggaggccacgaaagagcaaatggccacaatgatgagcatgaagaagataatggaagccaatgtggttatagttgccgctaccagcgttgttgctaaggtgaacccgatgcccccatctggacttaaccaaatgaatcatccaaccttagatatgacacatggaatgccccaccactatctagcggactttgagccttgcctcggatataccactaaagggaaagcagttggtggtatacccatgccaaacactttggagggccctcagtttcgcccacaaccacaacccttgcattttgcggtgggaagagcccctcctgctatggctgaaaaagggacagttggatcatatagaggaaaggctcaaggacattga

SEQ ID NO: 43527 - DNA, 239 bp, Glycine max
  Peptide Sequence Number=SeqID_135212
catcacagtcgtcatctaccttgaagcggacacaaaaagccacacggctacgatacttggcgactagagcacctggggaagacagaccggtggtccacgtcgatcctgcgatcgggaaggccgacggtccccacaagaagaaattaagaacatatttggggattgtcgctcgtgataatgtcgacgtgacatacgagacttggaaggaagtccctgttgctcagaaggatttgatatga

SEQ ID NO: 43528 - DNA, 523 bp, Glycine max
  Peptide Sequence Number=SeqID_135213
gttacaggttgtaccatctgtggtgaggctcatgaaacagagtccttataatcaacaaggacagtggaggtcacaccctggtaatcagttcaacaaagaccagggtggaccttcgaataggccaatccagcaagggcctaacatctttcagaggattactaagctggaagagactttgactcagtttatgcagaagaatcccaaggaggaatgcaaagctgtgatgacaagaagtaaaaggtttgtggagaatgaggaagagaagagtgttggactcaagaagaaagttgttgaagagaaaggtactgatggcaagaaaaatgatgagcgaggtgaaaataatcaggaaaaagagaaacaaataatggtcaataaaaaagaattgaatgaccaagaaaaagaaaaagaagtagaaaaagaaaagaaaataaaaaaattgaaaaagatgaaaaaaaatgagaatgaaaagaaaagtagaagtgaaaaagctgtgaatgaagctgcggaagtaccatatcctgtg

SEQ ID NO: 43529 - DNA, 249 bp, Glycine max
  Peptide Sequence Number=SeqID_135214
atgtccaaccataagagtactgagtcagccctgaaaaaccttgagattcaagtggatcaactggtcaagcagttagctgagaagtcatccaacagctttggggcaaatactaagaagaatcccaaagaagagtgtaaagttgttgtaacaagaagcatgaagcttgtggcggctgaggatgaggatgttgttgctttgaaggagcaagttgctttaaaggatactactgttaaaaaaagaatgaggtaa

SEQ ID NO: 43530 - DNA, 183 bp, Glycine max
  Peptide Sequence Number=SeqID_135215
atggataaatttgatatctttgtccctcatcctctcacaacacacatatttgcttattcaactttcaccggaatatgggtgcaagccattggtctgtttgcccaagcgacctgtgctcctgagtttggacatccaagaccattcaatcagagactactcgtcttgcacgttgttgggggcgcc

SEQ ID NO: 43531 - DNA, 893 bp, Glycine max
  Peptide Sequence Number=SeqID_135216
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatcctaccctagccccccagcccctgacaggccctgcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43532 - DNA, 306 bp, Glycine max
  Peptide Sequence Number=SeqID_135217
atgcatagtgctgcttgccaatgtcagaattcacaaatcacaagcgataatcctcctcaaattttagccagcctgcatcaattagattttgcaccttatgtttcaaggtcatacaatgctcaatggaatgccctgaaacccttccatgataagcacgttgcgttcaagttgtatcctcagaaaaatgaagggtggtgtctagtatcggttgtgcggcaggcggactttgtggctgatttaggggtgacctttgtggatgattgggtgttcttggatgataaagtggtggttaatgagaggggctga

SEQ ID NO: 43533 - DNA, 756 bp, Glycine max
  Peptide Sequence Number=SeqID_135218
atgagtcatcattcatctagtgttaatggcgagggtactagtcataaggaccctttatctagaatcttagatgagttgagttccctcaagttatggaaagaaaaaactagaaagaaaagaaaaagcggaaaagagaggataaaaataaatcaagatgagaggaaacaaataagggaagaagaaagaaggaaaatactaaaagagttgagaaaagaaaaacatgtctcctatagtagtcataactcttgcatgagcctaagtgaagaacttcatgactattatgaaggaaggcataggtcacatcttagacttcactcccataggagaaaaaatgaaagaaagcctaaagaggctaacattaacctcccatacttccatgggaaggacaatgtagaggcttacttagattggaaaataagggtagagaaaaaacttaaaagaaagtctactttaaaatcttatggctctcattcttatccaaagaaagaccaaggtctaggcatcttaggggcagcaccttctaagcccaaagatgataaggggaagacaatagaaaagcaaccccctaaggctagtatgcaagagaagactagatctataaagtgctttaaatgtcttggaagaggacacattacttctcaatgctccaccaagaaaaccatgattatgagcgaccaagacatttatagtagccaagatgaggctactacttcaccttcctctagtgaaagtgaagaagcaaaagggaagaatcta

SEQ ID NO: 43534 - DNA, 845 bp, Glycine max
  Peptide Sequence Number=SeqID_135219
atgccctcacctttagaggactacatgtgctcgccttcagaggactacacgtcctcacctttagagggctacacgcactcgccttcagatgactacataggactacacgtcctcgcctacagaggcctacacaccctcgccttcataaggttgcacaccctcgccttcatagggctacacgccgtcaccttcagtggactacacgtcatcaccttcagaggactacacgtcctcgccttcagagggatacaaacccctaccttcatagggctgtacgccctcgccttcatagggctacacgccctcaccttcaaaggacaacatgtcctcgccttcagaggactacacgtcctcgccttcagagggctacacgccctcgctttcatagggatgcacgccctcgccttcatagggctacacgccctcacctttagaggactacacgtcctcgccttcagaggactacacgtcctcgcctacagagggccacacgtcctcgccttcagaggactacatgtcctcgccttcagagggccacacgtcctcgccttcagaggaccacacgtcctcgccttcagaggactacacgtcctcgccttcagagggccacacgtcctcgccttcagagggctacacgccctcgccttcagaggactacacgtcctcatcttcacaggactacacgcccttacctttagaggactacacgtcctcaccttcataggactacacgtcctcgccttcgtaggggtacacgccatcaccttcataggactgcacgccctcaccttcatagggctatacaccctcaccttcatagggctgcacttcctcaccttcagagg

SEQ ID NO: 43535 - DNA, 267 bp, Glycine max
  Peptide Sequence Number=SeqID_135220
atggagaatggcactaagcaatcactacgcataggctccaaactcgaaggtggaggacacatgaacgaaaatgcatttcatggggctccgaaaagattgagaatggagaattgcactaagcaaatcactacccatggctccaaactcgaaggtggaggacacatgaacgaaaacgcaattcatggggctccgaaaagattgagaatggagagttgcactaagcaatcactacgcatggctccaaactcgaaggtggagaacacatga

SEQ ID NO: 43536 - DNA, 282 bp, Glycine max
  Peptide Sequence Number=SeqID_135221
atgggtaaagtagaggaggcacaaaagcagatgaaggccggcatagaggccatgaaagagcaaatggccacaatgatggaggccatgatgagcatgaagaagataatggaggcaaagatttgggaagtagggacggcccccatgatgtgcaaattcaaaacaagcacgccttcccgccatatggcctgcctcccaactatacaccacccaaatgtcaataactccactcctatacccattgagagccaacaaccccaaactgatcatgcacatgtctcttaa

SEQ ID NO: 43537 - DNA, 267 bp, Glycine max
  Peptide Sequence Number=SeqID_135222
atgccgatctccccctgcgaaaggatcacgcccacaagacactcagtggactcgggaggagcccgactgggccctgggggtttacagctctggtttacgggcctctgtcagtcctacaggggtgcccgtcccccccagcaaaggtcattgcccatcatggagacagggatttgtgccctgcaagacaatccaatgggacctcggaagaaatccaacaggggtccttgggggtttcccagcttctggattaacgggccctctaaatag

SEQ ID NO: 43538 - DNA, 270 bp, Glycine max
  Peptide Sequence Number=SeqID_135223
atggggtggttggaataccgaggaaatgtttggaagcaaaagcaagagtcttggcaggcagcgatcgacacttttctcgcctttcatgaccgcaaggaaagcccagttgtcgctatcttagccgatctatatgacaccttcgatcgaagatgtgaaaagaatagtacaaggattgtttgctgtactccggccctctacgtatggttggtttcacaccttttccgccaagaggtgagacatgcttgcccgctagaaggccagcgctcatga

SEQ ID NO: 43539 - DNA, 230 bp, Glycine max
  Peptide Sequence Number=SeqID_135224
gtgttgggttaagtcccgcaacgagcgcaaccctcgtgtttagttgccaacatctagtttggaaccctttgggggatcggatcgataaaccggaggaaggtgaggatgacgtcaagtcatcatcccccttatcccctgggcgacacacgtgctacaatggacgggacaaaggatcgcgatcccgcgagggtgagctaactccaaaaacccgtcctcagttcggattgtag

SEQ ID NO: 43540 - DNA, 531 bp, Glycine max
  Peptide Sequence Number=SeqID_135225
atggttttgaaagaggagttagttgcctgttcaaggtccaaaagaagcttgtctcagcgtttatgcgagacggagaccaacatgctagctatcatcgccaagtaccaagaagagttaggtctagccacggcccacgagcataggatcgcggacgagtatgcccaagtatacgcggaaaaagaagctagaggaagggtgatcgactctttacaccaagaggcaaccatgtggatggatcggtttgctcttaccttgaacgggagtcaggaacttccccgattgttagccaaggccaaggcgatggcagacacctactccgcccccgaagaaattcatgggcttctcggctattggaaaaacaccataactaaacgcgccacaaggcatccctatcgcaccagatccaaatctagaacgatgggtgatcaagaggagacacaggaacagatgaaagccgacatgtcggctctgaaagaacagatggcctccatgatggaggccatgttaggaatgaggcagctcatggagtaa

SEQ ID NO: 43541 - DNA, 180 bp, Glycine max
  Peptide Sequence Number=SeqID_135226
atggtgaaagttggaacctcttacgtgccgatcaacgtctcattttcgccaaaagttggcccagggattcccggtatcaacagggacaccaggatttatttattctgcgaagtgatcttccgtcacaggtgctccagtggcttctgtttctatcagctgtgcctcctgttcagctactga

SEQ ID NO: 43542 - DNA, 537 bp, Glycine max
  Peptide Sequence Number=SeqID_135227
atgttcagcttagcgggcacttaccagctaagccaattatgcagaggctgtagttctgcaacttccgctaagcggcttcacctgtcgctaagcggaagtgtctattttgtgatgatggcttctaggaaacgtaaaagtatttgttcaagacccatagtgcagtatgacacaaggagattctcttccttagatgcttggacccgatacacaaataatgtcctggggaaaaacattttgccagagaggaaagtagagatatatcacactaagctagatgagttcaaggctgaattggagaggcgtaatttccataaacgtctcaccaatttagtcgatgggagcatagacctggctttggtgaaagagttttatgcaaatttatacagttctgaggaccattcaccaaagaagtctagagttagaggtcatttggtgaaaattgatgctgacagtctcaacacattcctggagacacttgcggtattagcaaagggggagaccttacccgtatactccagatactgcagttgcctatag

SEQ ID NO: 43543 - DNA, 497 bp, Glycine max
  Peptide Sequence Number=SeqID_135228
ttggacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaggcaatgatgcaaaaatagacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 43544 - DNA, 940 bp, Glycine max
  Peptide Sequence Number=SeqID_135229
atgccggtcagaccgttgccctcccggccccagtttttcactgggctttcccggacgcacacgctatacgccgctacagcgctggacgctgggcgacacgatgaaggaatcctgatgaagtttagccctgcactccagcccgccacgctgatccaacgctacaaacgcttcatcgccgacgtggtgacacctgaggggaaaacgctcactctgcactgccccaacaccggagccatgaccggttgcgccacgccgggtgacacgctggttaaggaagcgctgacccatggcactattcccgaactggtgggttatggtacgcataaaagtgaagtgaaatatggcgatgaaagcagcagaattgacttcatgttacaggcggaagacaggccggagtgctatattgaagtaaaatcagtgacgttagcggaacaggaaaatggctacttcccggatgcgaagcatctgcgagagctaatgagtgttgcggcggcgggcaaacgcgccgtgttgctgtttgcggtattgcattcagccattgaacggttctcccctgcccgccatattgatcctaaatacgcgcaattgttgaatgaggcacaaaagcagggggtagagtgttctggccgcgtgcgcaaatacgcttttcctcacaggcttgtcaagagaagcaacatgcaagaagggcaaaaccgtaaaacatcgtccctgagtattctcgccatcgctggggtggagccgtatcaagagaagccgggcgaagagtatatgaacgaagcccagctgtcgcacttcaagcgtattcttgaagcatggcgtaatcaactcagggatgaagtcgatcgcaccgttactcatatgcaggatgaagctgctaacttcccggatccggtagaccgtgccgctcaggaagaagagttcagcctcgaactgcgtaacc

SEQ ID NO: 43545 - DNA, 372 bp, Glycine max
  Peptide Sequence Number=SeqID_135230
atgatatgtgtagggactaaaaggggatgctttgaagcattgggactaaaagggaaaggtagtgcccgacagttgtttcaacgttttcaaggaccaatggaggaggatactctgaagtctcattttgataaaattatcaagattgggcagaagcaacgttaccacaggaatcagttgaaacttgaatttagtgatgcttgtagtggtatgaatgccattttaagattagatctgcttgtattgcaatggcctaattgtattacattgtgcgtgagagagtgcattggtaaaaactcaagtcccacatcggctagagataagaccaagataaaatatataagtggggggcaaccctcagtcaatgacttttag

SEQ ID NO: 43546 - DNA, 627 bp, Glycine max
  Peptide Sequence Number=SeqID_135231
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccatttgagactctaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43547 - DNA, 444 bp, Glycine max
  Peptide Sequence Number=SeqID_135232
atggtgaaagttggaacctcttacgtgccgatcaacgtctcattttcgccaaaagttggcccagggttcccggcctgtttcctcacgcctggtatagcttattcgcaataccgtgcgtcaggggggagcccaagcttattgatttgtgtagtgagggtttttcgaggctctggcttcatgtttctatcagctgtccctcctgttcagctactgaggggaatggtgttatccgctaattcggcaacaagcataccagccggacatcagcgcaagtgtaaagcctggggtcctaagatcaggaaacctgtcggcaactgtaatgacggcaacgcgcgggcgatgaggcgggcctttgctattgccagcggcgaaaggggatgtgtgcatactggcttactatgttgggtaactgagagggtgttcccagtgaagtgcttcatgtag

SEQ ID NO: 43548 - DNA, 234 bp, Glycine max
  Peptide Sequence Number=SeqID_135233
atggtgcaggcttgtacagagatgataatgcccataggtggaagcaataaggagagcatattcccggaatatgagtggtcattcaaagcaagaacctcttggatttcagggccgacagtgagctcaaagctccgagtgacaccgagagcgacagagagagagcaagaccaaaagtcatttaagggtcgcgacgagagtgagagtgatagagcgagaatgagagttgcaacatag

SEQ ID NO: 43549 - DNA, 291 bp, Glycine max
  Peptide Sequence Number=SeqID_135234
atgtaccctctcttgttcttagttacaacaacccaagtagatgtaccttctacttgtaccacaaaggatgtaccctccaatgtgttaagacaaagttctcaggcgggagaagggagacacaaaagaattcaggcggttagtcctttgttcttttggaaaagggagaagagagacacaaaaagaattcaggcgaacaaggtttggaaaccagaaaactcaaaaagcttttggcaaaggatgaagaagaagaagaagttcaaaaagatgttcaaagagattcaaaggttgtaa

SEQ ID NO: 43550 - DNA, 210 bp, Glycine max
  Peptide Sequence Number=SeqID_135235
atgaccataatttgtctccgcgtgccatcggacatgatcgtatttggatggcaaaaggcgcagaatgaccataatttgtctctgcgtgccatcggacacgatcgtgtctggatggtgaaaagggccagtatgacagagattgtggggcgtccgacaaaagcgaggctcttgttcctatgtatcctcaatgaggaactcaaacctacgtag

SEQ ID NO: 43551 - DNA, 275 bp, Glycine max
  Peptide Sequence Number=SeqID_135236
atgaccggccctctcgatgagtcgatctcttgctttctcataagggcggacccttgggtactagtacctatcttcttcagaggactacacatcctcaccttcaaaggacttcacgtcctcaccatcagaggactagatgtcctcgccttcagagggctgcacgccctcaccttcagaggactacacgtcctcaccttcagaggactgcacgtcctcaccttcattgggctacatgccttcaccatcaaaggacaacacgtcctcgccttaagagg

SEQ ID NO: 43552 - DNA, 586 bp, Glycine max
  Peptide Sequence Number=SeqID_135237
atgggctagtggacttagcaacaattgatgcctttctcacttatcataacagcaaggaaaacccggtcaccactattttggctgatgcatatgatatgttcgacttgagatgcgagaaaagcagtgcccgaattgtctgttgcatgcctgctctttatgtgtggttggtctcccacatttttcgtcatgaaggattcccaaacgttcccttgatgggaatgaggggttgtattaattataattccatgctagccataagacaactaggctaccctatgagaggtgcaccgtcggaggagatcatcttgcctttcatcgcacgaggtttcaatgaagccaatgtgaagatacttcagagaatccatagggcatggaatacaatggaaaggaaagataaggagcttagtggaagcctaagtgggaaagaagctaaagtccctgaggaaagcgaagaagtgaaagctttgaaagcggagcttgaaaaaatgagagtggtcaaggagaagctaaagatggtagtcactagggtcaggaaagagtgtgatgtgttgagagatgtcaacatgactacggtcgaagcattaga

SEQ ID NO: 43553 - DNA, 279 bp, Glycine max
  Peptide Sequence Number=SeqID_135238
atgagacaaacgcggccatacagcggaatgacaccggtaaaccgaaaggcaggaacaggagagcgcacgagggagccgccagggggaaacgcctgtctggaacatcgaattcctgcgcccgtggggataaccactagttctagagcgtgccgccacacgcgagtaggagctcaacaattgccctggaatagtgagtcgtattcacatattcagctgagcaccgtcagtttttttctcacaacgcttcgactggaacaccctggccgttacccaacatag

SEQ ID NO: 43554 - DNA, 237 bp, Glycine max
  Peptide Sequence Number=SeqID_135239
atgggatcaagtcaaaagccttcgcttaaaaagaggttctatcaagtcaaaatcaagagcttagaggtcactagtttaggagagttggggcaattaatgggtcaacttcaacgtattatgacccagcccctaaggtgcttcacatttgaggacttccagctagtgccgactatgaaaaagtttgaagaaatcctgggatgcccacttggaggaaggaagccatatctttttctctag

SEQ ID NO: 43555 - DNA, 375 bp, Glycine max
  Peptide Sequence Number=SeqID_135240
atgagcgaaatagaggaggtgcaagagcagatgaaggcccacatggaggccatgaaagagcaaatggacacaatgatggaagccatgatgagtatgaaaagaatggtggaggtcaacacggctatagtcattgccgcaagtaccgccacagaggttaaggaggcagagccttgggaagtacatgcagcccttattttgtgcggaatcagaacaagcattacttcccaccatatggcttgcctcccaactatacaccacccgatgttgcacacgctcttgatgagaatgtcaataactccactctcatactcattgagagccaacaaccccaatttgatcatgcacatgtctcttaacccatggggagacacatga

SEQ ID NO: 43556 - DNA, 393 bp, Glycine max
  Peptide Sequence Number=SeqID_135241
atgctgcgcgtaacaccaccccgccgcgcttatccgctacagggaacctgtcccattcgccattcagtgtgcgcaactgttgggaagggcgatcggtgcgggctcttcgctattacgccagctggcgaaagggcggatgtgctcaaggcttacagttggctactgagcagggtgttcccagtgaacgtgcttctgtggcaggagaaaaaagcgcacggctcagcagaatatgtgaatacgactcactatagggcgaattcccgcttcggccgctctagaactgactcctcgctcggtcggaattcgatctgccccgagcggaaatggttacgcaaggggcggagtcagcagggtttcctggaagatgcaggaagatacttaacagggaagtga

SEQ ID NO: 43557 - DNA, 687 bp, Glycine max
  Peptide Sequence Number=SeqID_135242
atgtcggtcagcggcggccgcaccggctgtcgctcgccgcaggttgcgctggaaatcgcccaggcaatccatgacagccgctcgctgcagctggtgggggtggccggatatgaaggtgcgctgggtgccggacgcgatgccgcaggcgtgcagcgcgtgaaagattactgcgagatgatgatcgcgaccgccgcgctgctggctgaacaccagctgtttgccagcggggaaattattctcagcgccggcggtggcgcgtggtttgatgtggccgcggcctgcttcagcgcggcacagttgccgctgccggtcacgccgctgattcgatccggtgcgtacatggcacatgacagcggcttgtatgcacgcattgccccctttgcgcagccgggtgcaacgcaccatttcagcgccgcactggagatctggggccgcgtgttatcgcgtccggagccggggctggcctttgtcgatttcggccggcgcgatgtgccgttcgatcaggatctgcccaatccgctgtggattcgtcaggcggacggcagcgcaccgcgcgcggctacgcatttgcgcatcaccgacgtcaacgatcagcacgcttatttgcagttaccggcggacgatccgctgcaaccgggcgactggattggctgcggcatttcccatccctgtaccgcatttgactaa

SEQ ID NO: 43558 - DNA, 718 bp, Glycine max
  Peptide Sequence Number=SeqID_135243
acttatttcatacctttgaccgaaggtgtgagaaaaatagcgcacggattgtctgttgcttgcccgctctctgtgtgtgtcgattgggaccaacacttggctcggataggaggcagcgcgatcaattggtttcctcgatggaaggaaggaaaggagggagttcttttctcgtgtggggactaccctaatgttccgttgatagggacgaggggttgtatcaactacaatcccgcacttgccataagacaactaggataccccatgagggggacgccaacagaagagagtctttcgcctttccttgtgagagattttggcgcgcaaagtctcaaggttatacaaagagtccacaaggcgtggagaagtccgttgaggaaagacaaagagcttaggggcatccgtaatggcgtcatcggtggttatcatggatggctaagagttcatacgcgagggttagattggctcccgaagttgaaagttatcaatgaggagaacttcgaagctctggaggaagatgaagaagtccaagctctgaaattagagctagggaaggcaagacttgccaaagaaaagttcaagtcagccgctacaaacatccgaaaagagtgcaccgagttacgagaggaaaacgtggccactgcaagagcccttgaacaagaaaccaaaagggcccgcaaggaggaacgtggccgagataaattccgaggagctttgtggg

SEQ ID NO: 43559 - DNA, 360 bp, Glycine max
  Peptide Sequence Number=SeqID_135244
atgcgtggggtgctaataccttccccgtgcgtaaatacaactcccgaacctttcacacttaaaaatcgtagaccacaccttttccggtttttccgacattttcctcgaataaatgttggtggcgactacgtgcgttttcctcccttggaagacgcacccgtgagccctcgcgtcgccctccctccgaagggaaggccaattggtgttagggaacaaattcatgatgcatcccttgacatttgtgagactcctcgtttttgcacaaaaatgccttcaatatgtgaacaagcagaggtggatggcgtacatgcaattcgtcatgatcatgctgaaggtttatgggagaacattgctccttaa

SEQ ID NO: 43560 - DNA, 438 bp, Glycine max
  Peptide Sequence Number=SeqID_135245
atgagtgaaataaaggaggtgcaagagcagatgaaggtcgacatggaggccatgaaagagcaaatatccataatgatggaagccatgatgagtatgaaaaaaatgatggaggtcaacatggttacaatcgttgccgcaagtaccgccactgaggtggacctgactcatccatctgacctcaaccaagtaaatcgcccagcctcaaacatgatagggcaggtaggcgaagcgttaggatgtacggggtggcccccattttttgcaagtttagacaaagcattccttcccatcatatggcttgcctcccaactagacaccacccaatgtttgcacatgctcccgatgaggatatcaataactccactcccatactcattgagagccaacaaccctaatctaatcatgcacatgtctctcaaccataggggagacacatga

SEQ ID NO: 43561 - DNA, 311 bp, Glycine max
  Peptide Sequence Number=SeqID_135246
cttccgttttcacatttaacggatacctaggcggtgttgtccttgctgaggtgttgttggctgattcacgattcactcgaccggatatgggttttcacccaacaaaactcaatttcgtgcctagcgatgcggatgaggcgccactcgatgtttccattttgcctgcatgcctttggtattgtggggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 43562 - DNA, 384 bp, Glycine max
  Peptide Sequence Number=SeqID_135247
tattgcacgcagagacaggcccagggggatgctccgcaggccacagacgcaccgccacctcatcaggctggcccagctggatcatttgacacggagcagtatttatggcatttggttcgccagcaggcggccaaccaccgggcgcatgtacaaacccatgattgtctttaccagttgagcctcagcctgcagagccagggttttacttcttttccatgccctactccggatcagttcagggcagaggtcgcatggctcggagattggcctgaggcccgagtaggagaggcaccagcagaggctcccgacgaggcaaatgagacccgcgaggacgaggagatgaccgatttgcttgatttcttgggagggagcacagccacatga

SEQ ID NO: 43563 - DNA, 195 bp, Glycine max
  Peptide Sequence Number=SeqID_135248
atgcagaactatcaacatgcaaagagatctaattctgcaaaagccaggatcaattggaaacgtatcatgcagcaaaagcgacatcctcatgctcagtcatcttcacaaccaacaattaactgcacttccgaatatgatagttcaagctctaattttttaactgcttatgaggattgtcaatctccaactaattag

SEQ ID NO: 43564 - DNA, 195 bp, Glycine max
  Peptide Sequence Number=SeqID_135249
atgtctcctccacctctaggacctctcaatcactcacaaactcagctcacgctctcaggacggcttccttttccaggtggctttgttcgtgctcttatgcttatcgtaactctgatcctctcagcgcacattactgaatatcggcttagcacgtgcttttctcgctcggtgaatgcactgaagcggtgcgcttag

SEQ ID NO: 43565 - DNA, 615 bp, Glycine max
  Peptide Sequence Number=SeqID_135250
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgtttggatttttcaaaactccatggacatgcagaagagaaatgctattcccactcggaccaagacataactttacttgttcaaataacaattaagatgctacatagttgggttctcatcctttcagagactacgagtataataggagcatccgtcaacaaaagggatcaccctaagatgatcatctcggtggctatttga

SEQ ID NO: 43566 - DNA, 609 bp, Glycine max
  Peptide Sequence Number=SeqID_135251
atgcccacatctcagtatgacacaaggagattctcttcattagatgcttggaccagatacacggataatgttctagggagaaacattttacttgagaggaaggtagagctctatcacattgagctagatgactttaaggctaaattggagaggcgtaatttccataaatgcctcaccaatttagtcgatgggagcatagacatggctttggtgaaagagttctatgcaaatttatacagttatgaggaccgtccaccaaagcagtccagagtcagaggtcatttggtgaagattgatgctgatagtctcaacagattcctggagacacctgtggtattagctaaaggagagactctacctgcatactccagatactgcaggttgcctacaaacttcagagagatagaggctgccttatgcatacctggtcgagggttcatcttgaactttgagggccatcctgggatgattctcaggaaggatttgactacactagctcaagtgtggagtgtcctctcatactccaacttggcccccacatcacatacctctgatctgacaatggacagagctaggctgatctttggcctagtctctcaccggatatga

SEQ ID NO: 43567 - DNA, 159 bp, Glycine max
  Peptide Sequence Number=SeqID_135252
atgtcggctcttcctatcatgggaagcagaattcaccaagtgttggattgttcacccaccaatagggaacgtgagctgggtttagaccgtcgtgagacagtagggggcctcggccccccaaaggcacgtgccgttggtgaccctcgtgaggcggattag

SEQ ID NO: 43568 - DNA, 198 bp, Glycine max
  Peptide Sequence Number=SeqID_135253
atggcttacgaacggggcggagatttcctggaagatgccaggaagatacttaacacggaagcagttcgctccaagctggactgtatgcacgaaccccccgttcagtccgaccgctgcgccttatccggtaactatcgtcttgagtccaacccggaaagacatgcaaaagcaccactggcagcagccactggtaattga

SEQ ID NO: 43569 - DNA, 138 bp, Glycine max
  Peptide Sequence Number=SeqID_135254
atgctccaaccatatgggatcaacataggcttaaaggagcactcaaaccgggtgaccccaaaggcctacactccgaaaattccgtcagggcttctccctccagattcagtttatctcatcgcccttaaagggacttaa

SEQ ID NO: 43570 - DNA, 141 bp, Glycine max
  Peptide Sequence Number=SeqID_135255
ttccgggtaggcagttcgctccaagctggactgtatgcacgaaccccccgttcagtccgaccgctgcgccttatccggtaactatcgtcttgagtccaacccggaaagacatgcgaaagcaccacttggcagcagccactg

SEQ ID NO: 43571 - DNA, 165 bp, Glycine max
  Peptide Sequence Number=SeqID_135256
atggataagagcttgaaggtaggagaagatgagtggagggagagggagagaaggagcacgaaattttgtgcctcaaaagagttatgcttcagcccactaatccaagatgaagtccaaggttctccactaagtgtgcttaggtgtcatgaggcatgtaaagcatga

SEQ ID NO: 43572 - DNA, 195 bp, Glycine max
  Peptide Sequence Number=SeqID_135257
atgtgcgcatatctaaaccattcagcaaatcaatcaggggtctttgtgcttagcgcgagcaagctcggcttaacacatgaagagatggcgcttagtgcaagcttgacgcatcatcctgttatccaggatccaataatgttcccacttcaaggaccttcttctcaggtcttctttcctccatcacatgaactttaa

SEQ ID NO: 43573 - DNA, 258 bp, Glycine max
  Peptide Sequence Number=SeqID_135258
atgactgaagcacgtcaaaagggggtacgaaaagtaaacgaaaatgagaataaaattgaagaccgaagaaaacgaagaacgaacgatgaatgtcgaagaacggttgaaaatcttcgtgtaattactcacggaaacgttacggaagcgcctcggcatggattttcttcacggaaacaattttccttagcaaatttaagagaacacgaagtgccaagaaggctgaacccttttcctcttcactcctccccctatttatag

SEQ ID NO: 43574 - DNA, 159 bp, Glycine max
  Peptide Sequence Number=SeqID_135259
atgtcagtgaaaaacctcgtcgggcgcctaggagtatatgacaagacaaaccacacactagcaagtcaagtcactctcactaggcttaaaggaacactcaaactgggtgacccccaaggcctacactccgaagagtctgtcagggcatttccctcttga

SEQ ID NO: 43575 - DNA, 375 bp, Glycine max
  Peptide Sequence Number=SeqID_135260
atgcaggatcacacccacaaagacacccagtgggcccgaagaagtccaacagggccctggggtttccagctctggttacgggcctctatagtcctacagggtgcccgttccccccgacaaggtcacatcatcatagggatcgtgcctgcaagacacccagtggacccaaagaagttcagcaggttctacggagtacctgtcacctccagcaagggcatcaggccccctactaatcgagctttcatcaagaggtactgcgtctccaggcaggcgcagggcgaaacaccacagcagcctggggatggccagcagagggcaacagacacaccgccatcacctctagatttcacctcagctcatccacaaaaaggttag

SEQ ID NO: 43576 - DNA, 336 bp, Glycine max
  Peptide Sequence Number=SeqID_135261
atgtgtgtagttaagaaggtgatatggatctttcggtttcccatgacaaaagatgagaccaacatagaacgtgtgcgtgacggcatgatgcagatgcgcaaaagcgcaacagggggatgcacagagcctaactcacaaaaagtccccagtggagtcgccaactgtcgcaacatgcccttttgcgggcgaagcgaggcgaggctcacgggtgcgctttccaaaggaggaaagatgcgcggagtcgccaccaacgtttatttgtggaaaacgtcggaaaaaccgaaggaaaccggtcaaaacgaaaattctaagttcaggagttgtatttacgtttga

SEQ ID NO: 43577 - DNA, 345 bp, Glycine max
  Peptide Sequence Number=SeqID_135262
atgtactgtgtctccaggcaggcgcagggcgaaacaccacagcagcctggggatggccagcagtgggcaacagacataccgccatcacctctagagttcacctcagctcatccacaaaaaggtaatggtaggacacacctagttgctcatgatcctaggaaattaaataaaatgagcacaagctcagaaggtagcaagatacctgggacacgcatgtatatagcaaaatacttcacaaaaatatatggtgaatgctgtgaaaattttcccggacgccaaaaatggactcgaatgaatgcaaaaattgataaaagaacgtattttggaaacattgggttgacttaa

SEQ ID NO: 43578 - DNA, 954 bp, Glycine max
  Peptide Sequence Number=SeqID_135263
gagatggccccgaggaaacttgcctcaaagagatccaggaaggataaagcgaccgaaggaaccagttccgctcccgagtatgacagtcaccactttaggagcgctgaacaccagcagcgcttcgaggccatcaagggatggtcatttctccgggagcgatgcgtccagctcaaggacgacgagtataccgattcccaggaggagatagttcgccggcggtgggcatcactggttacccccatggccaagttcgatcctgacatagtcctcgaattttatgccaatgcttggcctacagaggagggcgtgcgagatatgaggtcctgggagtgcgagtacggccagaggaggaaccggtccgatgggttcgatgaggaggccatcgcccatttgctatgtataccggggcaagattttgcccggactgctgccgggagacgggtgcggatcatgcgcaccaacatgaccaccctgactcagatctggatgactttgctgctcagcaacatccagcccagcgatcataattccgacctccccctgccgaagtgtcagctggtgtacgccatcctgacacggatgagcattcacgtggctcagttaatcgctgatgccatctatctattcgcaggtatggcgcctaccaggcaccctctggacccggataagtccaatagggccctgggatttcccgccttgatcacaggactctgccagtcgtttggagtccctgtcgcacctaacaaggccgcagacgcgccgccaccttatcaggccggtccagccggatcgtttgatacggagcagtatttgtggcatttggttcaccagcaggcggccaaccactgggcacataggtcgcatggcctggagattcggctgaggcccgggcaagagaggcaccagcagaggctcccgacggggcagatgaggcccgcgaggacgaggagatga

SEQ ID NO: 43579 - DNA, 204 bp, Glycine max
  Peptide Sequence Number=SeqID_135264
atggaacaacgcaaaagaacttcttccgccagagtcaacggaagaaggtcttccgtgagttaccacggaagaaggtcttccgtggaaatgacgaacaaggccaaaggaaaagacaaggaggtcgctggaaaaggttctgccggcaagcgcaagggcgccttcgacgatgacaagaccggtggcggccaaaagagaaacaagtga

SEQ ID NO: 43580 - DNA, 132 bp, Glycine max
  Peptide Sequence Number=SeqID_135265
atggagagttatctacagcacttggttcgccaacaggcggccaaccactgggggcaggggcagggtttcgctccttttgcgtgccctactccagagcagtttagggctgaggtcacatggcccggagattag

SEQ ID NO: 43581 - DNA, 147 bp, Glycine max
  Peptide Sequence Number=SeqID_135266
atgcgcaagaggctccaagaggattgggctagagctgctgaagaaggccctaaggttctcatgaacctcaggggctccataatgcaggtagggtaccctagaaatataggattttttagcccttgtattttagggcacctagactag

SEQ ID NO: 43582 - DNA, 402 bp, Glycine max
  Peptide Sequence Number=SeqID_135267
atgaatgtcgaagaacggttgaaatcttcgcataattactcacgcgttacgaaaatgttacggaagcgcctcggcttggattttcttcacggaaacaattttcctcagcaatttcgagagaataagaagtgccaagaaggccgaacccctttcctcttcactccttcccctatttatagcaaaataggggaggagcttgccacccagctcgcccaggcgagctcagctcgccccggcgagcaaggttgcttcctccagaagcaaccgccttctagaggaagaaactggaaggccaaactttcgaagaagttacggaaactcacggattgcgcaaaaacacctccttttggttttcgccacattacggaatttcacggatcgcgtaagcctgcttccttttga

SEQ ID NO: 43583 - DNA, 255 bp, Glycine max
  Peptide Sequence Number=SeqID_135268
atgctgggacttgttctctttggccgtatcaaaagtaagttgcttaatcccaactcaagctatatgatattcaagttcataataacatgcgatgatgatgaagagagatcaagtctgaaagcaagcaggggctgttctcgttcttcaacttgccaaggctgctcaacttgttactgtgaagggtgcatcaagtgccactttgaggattgcaattgccaagaatgcagagactttatgctatatgctaaaccttaa

SEQ ID NO: 43584 - DNA, 180 bp, Glycine max
  Peptide Sequence Number=SeqID_135269
atgaaagaagatctcaagaagactctcaagttcttagatgctacaaatgaaaccaacttggccacatcaaagcaaattgtccttcaaatgaagaatggcctgagaaatgtgataagaaaagaaaaggagatcaaccttctaaccaaggattatgagagtgatgagaacatttctcaataa

SEQ ID NO: 43585 - DNA, 132 bp, Glycine max
  Peptide Sequence Number=SeqID_135270
atgggggtgagcttagctattatagaggcttctttaggaatcttcttaaggaagcttctcaaggaggaagttttctcaaagaagcttctcaaggaagttttctcaagaaagcttctcaaggaagctacctag

SEQ ID NO: 43586 - DNA, 522 bp, Glycine max
  Peptide Sequence Number=SeqID_135271
acacctacccaggccaaatttgatagatccaggttcacatcccaagaggcttgggagaggtatacagacattgtggtgcctcgaaagctactactagagaggaatgtggtagtctattacacaaagtttgacgagttcaaggaggaactcgagagaagacattgggatgagaagttgattgattttgatgacagtagcatagacattgctattgtgaaggaattctacgcgaacctctatgaccccaaggataaatcacctaagcaggagttggctgctaagctctgtatcccagggaggggattcgagctaaatgctgatgggcaaccattgaagatattgaggaagaacatgaccaccttagctcagacatggagtgttctttccttttctaacctaattcctacctcccacacatctgatgtgaccttggacagagccaaactgatttatggcatcatgatgaagatggatatgaatgtggggtacctcatctcccataagatctctctgattgcatag

SEQ ID NO: 43587 - DNA, 654 bp, Glycine max
  Peptide Sequence Number=SeqID_135272
atggcgaatcaagaggagtgggtcccgtttatggatgtattagcattgctaatctttggggttgtcctctttccaaacgtagatggtttggtggacctagccgtgattgatgctttccttgtatatcaccatagcaaagaaagcccagcggtagctgtcttggcaggcttatttgacacatttgaccaaaggtgcaaaaagagtagtgcacggatcaatttcaaggttatacaaagagtccataaggcgtgggaaaacccattaaggaaagataaagagcttacgggcattcgtaatggcattattggtggttatcatgaatggctgaaagttcgtacacggggtttagattggctcgccaagttaaagattatcaacgaagagaatttcgaagctccggaagaagatgaagaagtccgagctctgaaaaccaaactaggaaaagagagccttgccaaagaaaaattcaagttggtcgctacagaggtccggaaagagtgtgtcgggttacgagaagaaaatgcagctaccacaaaagcccttgaacaagaaaccaagagggctcgcaaagaagagcacgatcgtgacaaattccgtggagcattgtggggcagcaaccgtgagctcaagcttcgaagggaagagagagactga

SEQ ID NO: 43588 - DNA, 601 bp, Glycine max
  Peptide Sequence Number=SeqID_135273
cacaatcaactggtttcctcgatggaaggaaggaaaggagggagttctcttctcatgtggggactacccaaacgttccgttgatagggacaaggggttgtattaactataatcccacacttgccataagacagttagggtaccccatgaggggagcaccgatggaagagagcctctcacctttccttgtgaaagatttcggcgctcaaagtctcaagattgtacaaagagtccacaaggcgtgggaaagcccgttaaggaaagataaagaacttaggggcatccgtaatggcatcatcgatggttatcatgattggctaagagttcatacacgagggttagattggctctccaagttgaaaattatcaatgaggagaacttcgaagctccggaagaggatgaagaaacatctggaaagagtgtgccgaattacgagaggaaaatgtggctaccgcaagagccctcgaacgagaaaccaagagggctcgcaaaaaagagcatggccgagataaattccgaggagctttgtagggcagcaacaatgagctcaagctccggagaaaggaaagagaccagtcacgagtacatggcatggtcttaa

SEQ ID NO: 43589 - DNA, 453 bp, Glycine max
  Peptide Sequence Number=SeqID_135274
aaaagaaggagtagagacgagaatcgtcatcacggaaagggcaggatggacgaaatcagtgtcttatctttgctttcctcttatctccgatgagagatatttggcaccctttgttgcacaatatgtgaagtcccgagacgtgccgaaaatcaaaaggaagcaggcttatgcgatccgtgaaaattccgtgatgcccacttgggccttccagattcttcctccagaaggctgttgcttctggaggaagcaacctggctcgcctgggcgagctggggagaaggggttcagccttcttggcacttcttattctctcgaaattgctgaggaaataatttccgtgaagaaaatccaagccgaggcgcttctgtacgtttccgtgagtaattacgcgaagattttcgaccgttcttcaaaattcatcgttcgttcttcgttttcttcagtcttcaatgg

SEQ ID NO: 43590 - DNA, 147 bp, Glycine max
  Peptide Sequence Number=SeqID_135275
atgaagaaacaacaatggaagagaagcggaagacaaaggaaaagaggtgagaggaggcgccatccattaaggaataagccatggaagaaggagcttcaccaccaagatgagccttggataagaagcttggagaggatgcttcaatag

SEQ ID NO: 43591 - DNA, 573 bp, Glycine max
  Peptide Sequence Number=SeqID_135276
atgtctcagtataccttgaagcggacacgcaaagcaacacggctaagatcgttggccactaggccacctggggcagagagactagtggtcaacgttgatcctgctaacggcaaggccaacggtccccacaagaagaaattaagaatatatttggggattgtcgctcgtgataaggtcgacgtgacatacgagacttggaaggaagtccctgttgctcagaaggatttgatacgggaggatattcaggccgaatttgaaatccttgaagcttctgacagtaggaaaaagaagaaaatttttgagactgtcagcgagtggtggaggcagtttaaatctgacttgaccaagaaatgggcacttgcagccgacaaggacggtgtggacgacactatctgtgaaaaatacgacattagcaaggagaaatgggcccagttttgtcagacccgcagagacccctcatgggagaacaaaagatcatggttgagaagacaaagtaaagactggaggaagctagccagtccggaagcactgagggcgtcattgaccctccatctcccatcagacgccacgtga

SEQ ID NO: 43592 - DNA, 741 bp, Glycine max
  Peptide Sequence Number=SeqID_135277
ctatcacttattgtagaagaatttgaagagatcctaggatgccctctaggggaaaggaaaccatacctcttctcagggttctatccctcattagctagaatttccaagatagtccaaatctcggtgcaggaattagaccacaagaagcaagtcgaaaatggggaggttggaataccaagaaaatatttggaggcaaaagcaagaatcttggcaggtaaaggcgagtgggccccgttcatagatattctcgcactgttgattttcggaggagtcctctttctgaatgtggatgggttggtggacctggcagcgatcgacgcttttctcgcctatcataaccacaaggaaagcccggttgtcactatgctagtcaacctatatgacaccttcgaccgaagatgtgaaaagagcaatacaaggattgtttgctgtactccagctctttatgtatggttagtttcacacctttttcgccaagagcaagcaaagaaggagcatctgtcaactggttccctcgatggaaggaaggaagaaccggagttcttatcatgcggaggatttccaaatgttcccttgatggggatgaggggttgcatcagctacaatcccgttcttgctataagacaacttggctaccctatgagaggggcgccactagaggatgagctcacgcctgtcatttcacgagatttcaataagaccaacatagagacagttcagaaagtccgcaaggcatgggag

SEQ ID NO: 43593 - DNA, 363 bp, Glycine max
  Peptide Sequence Number=SeqID_135278
atgttaatgtgcaatgagcaatactcatgtgttggccctatagaattattatgcaccatcaatagaacactagatggtatactcaaacaacttcaatccattattactcctactcatgatgcaattatgtattacaatgggaagtggaacataccacgccaaggtgggtttttgggttactccttcactggaacaaatctaataagatttgacattccttcgggatgtagcatgggcaaactcaaggatataatcaagcaagttgcacctatgggggttcccccttatggaattcacaaatcacaggtggtcagacaattgttctttcgacaaccaggccatgctaagtatttagaaaattaa

SEQ ID NO: 43594 - DNA, 129 bp, Glycine max
  Peptide Sequence Number=SeqID_135279
atggaaaatgctaaacaaatggtcacccctatgagcactgcttgctacttggatgaagatgaagctggtcaatcaatagatataaagaaatatagagatatcaagccaatcccaaataatctcacctaa

SEQ ID NO: 43595 - DNA, 300 bp, Glycine max
  Peptide Sequence Number=SeqID_135280
atgaacagtaaaaagctattcccggaagaacttttaactacaggaggaagtagtttcggaatgagaatgttgaatttctggaagaagttctttcgaaagttacaatgcttaatttcggaagaagttgttccgaaagacacttccggaaccatttcttccggaattggacatattaactttcggaagaagttctttcggaagttactatgctcaattccggaagaagtggttccggaagtgtcttctggaacaacttccggaattgatgatattaacttccgaaagaagttcttccggaat

SEQ ID NO: 43596 - DNA, 387 bp, Glycine max
  Peptide Sequence Number=SeqID_135281
atggagatgggaggagatctccatgaccacatcaacaagttcaatcggctagagcaagcgctcttgttgttggtctcactaccaaagtcttccaaagctttggttcaaacgttgcttgtgggaagatcaactttgaatttggatgagcgagggaggaatcattcaaggagacatgatggtctaagaggaagatcaaaatcgcaatcgcatccacaacgagatatgagtaacattcaatgttactattgtggtgagaatgatcatgtgcaagtgaggtgtaaacaaatgaaggaggacttgaaaaaattaagagatatgaacaaagatggcgtcaactcccaagctaatgtagtaaaaagtgtgaaagatgaggttcatgcatattga

SEQ ID NO: 43597 - DNA, 181 bp, Glycine max
  Peptide Sequence Number=SeqID_135282
atgagggacggcaagaggtcttcgtatgtcattgggatcggggtgaattatggagttggccttgggggaaagttcctcatcgcgttggaaccggcgccaaagtgggcgttgccggccgggcgagtcgtggttggagccggagcttggggggcctccttctggatgggtgcgggcgctctag

SEQ ID NO: 43598 - DNA, 486 bp, Glycine max
  Peptide Sequence Number=SeqID_135283
atggggctccgaacaaaagtcggagaatggagaattgcactaggtaatccctacgcatggctccagactcacgggtggaggatgcatgaacgacaatcaattcatggggctccgaacaaaaggggagaatggagaattgcactaggtaatccctacgcatggcttcagactcatgggtggaggatgcatgaacgacaatcaattcatggggctccgaacaaaagtggagaatggagaattgcactaggcaatcactacgcacggctccaaactcatgggtggaggatgcatgaacgacaatcaattcatggggctccgaataaaagtggagaatggagaattgcactaggcaattactacacatggctccaaactcactggtggaggatgcttgaacgacaatcaattcatgggagctccgaacaaaagtggagaatggagaattgcactagggcaatcactacgcatggtctccacactcgttga

SEQ ID NO: 43599 - DNA, 429 bp, Glycine max
  Peptide Sequence Number=SeqID_135284
atggataacaaagagggagtgcaagaacagatgaaggccgacatgtcggccttaaaagatcagatggcttctatcacgaaagccatgctaaaaattcaaaaatcaatagaagacaatgctatggcagccgcttccaaaacagctagggaagcagaaccggtgctacagcccgcaatgaacttgggccgggacagaagcgcgacgggtttcaatcggaggtatagtcctcaagcctacccttatggtttgcctccagacttcaccccccgtaccgctccaaacgatttgcgccaagcccctaccttcgaggggcaactccctcttcatgccgactatcctctgcaggaagatgatgaaggagatgcccatttaggccctttacttccccttaaggaactggaccccatgagttgccccaaccaaacataa

SEQ ID NO: 43600 - DNA, 294 bp, Glycine max
  Peptide Sequence Number=SeqID_135285
atggagctgagcccaatgcttatgagttgcaagattttgttgattgttgttctgacctggggctggggagcatcaactactcatggccccttgtacacgtggactaatggcaagatgtggagcaaactggacagagctttatgtaatcagtcctggttcaattcctttggaaattctgcttgtgaagttatgaagtttatttctatttcagaccatactcctctagttgtcaccactgagttggtagtgcctagaggagttcagcaacatctccaaccgagtggagctagttaa

SEQ ID NO: 43601 - DNA, 201 bp, Glycine max
  Peptide Sequence Number=SeqID_135286
atggtggtgagcttcttcttgactcatcttctccttgaagtggcttctccaatcatcttccttcttcattctgctgccattaaacttcaagaagcaaaggactccattgatgaagaagatccaaggcctacaagctccatggagctacatcatgtggttctatcatttttcagtcataatcttcttgtgctgaacctttag

SEQ ID NO: 43602 - DNA, 132 bp, Glycine max
  Peptide Sequence Number=SeqID_135287
gcagaggccccaacaagaaagaaccacaacttaggaaccaacatgagtcatcattcatctagtgttaatggcgagggtactagtcataaagaccctttatctagaatcttagatgagttgagttccctctag

SEQ ID NO: 43603 - DNA, 264 bp, Glycine max
  Peptide Sequence Number=SeqID_135288
atgagtgaagtagaggaggtgcaagaacagatcaaggctgacatggaggccatgaaagagaaaatggccacaatgatgaaggccaatatgagcatgaaggagataatggaggttaatgtggctgcattgctgaggcccacttgggccctccagaatattcctccagaaggctgttgcttctggaggaagcaacctggctcgcctgggcgagctgagctcgcctgggcgagctgggcggcaaccacctcccctattttgctataa

SEQ ID NO: 43604 - DNA, 300 bp, Glycine max
  Peptide Sequence Number=SeqID_135289
atgactagagacaatgcatctgaattacaaccctttgatcctgagatagataggacatttcatagattagttaggcatcattttgtaccttttgatcatcctgagcattccattactggtgagtttgtgcattctgttattggtgattttgaacatcctgattttgagcattctgattttgaacattctgagaacatggcacaacctccaccccgtgagaggactctaagggaaatgactttacctgatttcacctacgaaagcttgtgcatccaataccctgatgaagatgtcccatat

SEQ ID NO: 43605 - DNA, 717 bp, Glycine max
  Peptide Sequence Number=SeqID_135290
atgggaaactccccgttaaggaaagatcaagaacttagaggcattcgtaatggcatcattggtggctaccaggaatggctgaaagttcatatacgaggtttagattggctcgccaagttaaaagtcgtcagcgaagagagttttgaagcaccggaagaggacgaagaagtccaagctctcaaaagcgagttaggaaaggcgaaacttgccataggagaagttcaagtttggccgtttctttacccattcggaaggagtgtgccggaccaagagggctccaagatagagtatggccggaataaatttcgcggagctctatggggtagcaatagtgaactcaagctgcgaaggacagagaaagcgaccatgtcgcttaaagaacaaatggtctccatgaaagaggagttagttgccatgttaggtatgagtgtctcagcgtttcatggagaagaacggagaccaccagctagcttcgccaagtcggagtcgcaccgagtatgcctccctaagaacaatagtaggacggggaaggtgatcgacactggggcacgatggcaaccctcacctgggatacaaccgagcgatgcttacccttacggattgccagcccaactactcaccacccgtcttgttaccaagaaggcgatgcgggcacatattgcttctcccccgaagagagccccctcaacagcccgaagaaatccggggatcctctag

SEQ ID NO: 43606 - DNA, 562 bp, Glycine max
  Peptide Sequence Number=SeqID_135291
ttgggcaccgtaacccagcttccggttcatcccgcatcgccagttctgcttaccaaaaatggcccacttggagctctcgattccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaaagacgggccgaatggggagcccacaggccgacgccaggaacgcgcaggtgccgaggcacgccaagggcgcgcgctgccatccacaatcgcgatgatgacgtctccaccgagcatatcaacagccccggggcttggggccaccatcgcaatccgcgtcg

SEQ ID NO: 43607 - DNA, 207 bp, Glycine max
  Peptide Sequence Number=SeqID_135292
gaagctaagggagcctctggtaatcgattaccagcctgtgtaatcgattacacagagggatgggtcactggtaatcgattaccagacgcatcgtgtgcagcacagttagtgatgcaatcctaccccgcaagggcattggctagaagactccaagtagattgggctagagatccaaggaaaggccctagggttctcatgagccttagg

SEQ ID NO: 43608 - DNA, 347 bp, Glycine max
  Peptide Sequence Number=SeqID_135293
ctgataccgctcgccgcagccgaacgaccgagcgcagcgagtcagtgagcgaggaagcggaagagcgcccaatacgcaaaccgcctctcccccgcgcgttggccgattcattaatgcagctggcacgacaggtttcccgactggaaagcgggcactatgaccatgattacgaattcgagctcggtacccaactggccaagcagatagctgacaagtcatccaacaattttggagcaaatatggaaaataatactaaggaagaatgcaaggatgtgatgactagaagtaaaaggtttatggatgttgagaatgatgagagtgtggtgtacaaggagcaaatgagttaa

SEQ ID NO: 43609 - DNA, 582 bp, Glycine max
  Peptide Sequence Number=SeqID_135294
atgggtgatcaagaggagacacaagaacagatgaaagccgacatatcggctctaaaagaacaaatggcttccatgatggaggccatgttagaaatgaggcaactcatggagaaaaacgtggccaccgctgccgctgtcagttcggatgccgaagcagacccaactctcttagcgaccgcgcgccatcctccctcaaacgcagtgggacggggaaggaacacgcaggggcacaacggcaaccctcatttgggatacaaccgagcggcttacccttatggattgccgcctaattactcgccaccagtcatgcaagatgatgcgggtcatatctcttctcccatccttcaaggggagcctcctcaacagcccgaagaggtccacgaagatcctgaagactatgcccaaagggatgtcgagttctatcccccggtccccgaggggccggcacccaacacgttgcctcagcccaacctcacggcacaaccaatagttttgtccatggaaggaccgcccccggcaactgaagaaaggaggaagctcgatctccttgaggagagattgagggccgtggggatcctctag

SEQ ID NO: 43610 - DNA, 276 bp, Glycine max
  Peptide Sequence Number=SeqID_135295
atgttggtgcgcatgatccgcactcgtcactttgtagcggcacgggtgaaatcttgtcctggtatgcatagtagctgcgcgatagcctccctttctggttatgctcgcacagtgtggatatggagcacactgaaaacgaggatgcgtagccctctaaaggcgagggcgtgcaaccctctacaggcgaggacatatagtcctctaaaggtgataggtactagtacccaagggtccacctttatgagaaagcaagagatcgactcatcgagagggccg

SEQ ID NO: 43611 - DNA, 639 bp, Glycine max
  Peptide Sequence Number=SeqID_135296
atgattggtacctcaaagccttacactggggcaatgaggggcatcgtgcatgaacctcaagtgaacgtaggggcagattcaaagttctcacccaataggttccctgctacacgatttcttacatctaatgtccaatcttgtgaatttgggatgatcgaccctctcgatgagtcaatcacttgctttctcataagggtggacccttgggtactagtacttatcaccctaagaggactgcacgtcctcgccttaagagggctacatgtcctcgccataagggggatacaagtcctagccttaagagggctgcacgtcctcgccttcagagggctacacgtcctcgactttagagggctacacgtcctcaccttaagagggctgcacgccctcgccatcagagggctacacgccctcaccttcagaggcttgcacgcccatcgccttcagagggctgcacacccttgccttcagagggctacatgtcctcaccttcagagggctacacgtcctcgccttcagaggactccacgtcctcgccttcagaggactgcacgtcctcgccttcagaggtctgcacgcccttgctttcaaagggctacatgtccttaccttcagagggatacacgtcctcgcctttag

SEQ ID NO: 43612 - DNA, 680 bp, Glycine max
  Peptide Sequence Number=SeqID_135297
atgagtcttcattcttcatctagtgttaatggtgagggttctactcctaaggaccccttgtataagatattagatgagttgagatcccttaagttgtggaaagaaaaacaagagagaaaagaaaaaggaaggcataggtcacatcttagacctcactcccataggagagaaaaggaaagaaagcctcaagaggctaacattaacctcccatacttgtatgggaaggacaatgtagaggcttacttagattgggacataagggtagagcaacaacttaaaagaaagtctacttttaaatcttatggctctcactcttatccaaagaaagaccaaggtctaggcatcttaggggaaacaccttctaagcccaaagatgataaggggaagacaatagaaaagcaaccccctaaggctagtatgcaagagaagactagctttataaagtgctttaaatgtcttggaagaggactcgttacttctcaatgccccaccaataaaagcatgattatgaggggccaagacatttatagtagccaagatgaggctactacttcaccttcctctagtgaaagtgaagaagcaaaaggggaagaatctaatgaagaaatctaccaccaagaagaaggacaaccattaatggttaaggaggagtgtaaggagataagtgtctcctccaagag

SEQ ID NO: 43613 - DNA, 222 bp, Glycine max
  Peptide Sequence Number=SeqID_135298
atgacattcatggggctccgaaaaaaaagtggagaatggagaattggcgaacagcactacgcaataacttcgcggggctccagacccgaagcgcttggcaatgacattcatggggctccgaaaaaaagtggagaatggagagttggcgaacagcgctacgcaataactttgcgggactgtagactcgaaggtggaggacacatgaacagcgctaggcaatga

SEQ ID NO: 43614 - DNA, 599 bp, Glycine max
  Peptide Sequence Number=SeqID_135299
gagcgtctatcaactggttccctcgatggaaagaaggaagaaccggagttcttattttgtgtggaggatttccgaatgttcccttgatggggatgaggggttgcatcagttacaatcccgttcttgctataagacaacttggctatcctatgagaggggcaccactagaggaagagatcgcgcccgtcatttcacgaggtttcaataagaccaatgtggagatgcttcagaaggtccgcaaggcatgggaggtggtgcgaaagaaggacaaagaactcaggggcagtaacaatgggcccatcggtggctaccgtaagtgggaggaagttgaggcaccggaggaagacgaagaggtgcaggcccttcggacagaactcgagcaagctcaaacagtcaaagaaaggttcaaatcagcagctcttaaaatccgaaaggaaaatgccgaactgagagatataaatatagctaacacgaaagccttggaacaagaaaccaagagggctcgtagggaagagcacggtcggaacaagtttcgaggggctctgtggggcaacaatagcgagcttaaactccgaagagaggaaaaggaccaatcataa

SEQ ID NO: 43615 - DNA, 333 bp, Glycine max
  Peptide Sequence Number=SeqID_135300
atgagtcatcattcatctagtgttaatggaaagggaaggcataggtcacatcttagacctcactcccatagaagagaaaaggaaagaaagcctcaagaggttaacattaaactctcatacttccatgggaaggacaatgtagaggctaacttagattgggaaataagggtagagcaacaacttaaaaagaagtctacttcaaaatctgatggctctcactcttatccaaagaaagaccaaggtcaaggcatcttaggggtgacaccttctaagcccaaagatgataaggggaagacaatagaaaagcaagccaagatgaggctactactttaa

SEQ ID NO: 43616 - DNA, 558 bp, Glycine max
  Peptide Sequence Number=SeqID_135301
gaaacggctctgaggaatctttcctcgaagagatctaggaaggacgtcgtggccgaagggactagtgccgctcccaagtttgatagccatcgtttcaggagcgctgagcaccagcagcgtttcgaagccatcaagggatggtccttccaccgagagagacgcgtccagctcaaggacgacgagtacacagatttccaggaggagatagctcgccggcgttggacgtcgctggtaactcccatggccaagtttgatccagatatagttctcgagttttatgccaatgcttggtctacagaggagggcgtacgggacctgcggtcatgggtaaggggccagtggattcctttcgatgcagatgccctcagtcagttcctgggatacccgctagtattggaggagggccaggagtgtgaatacgctgctatgcataccaggttaggattttacccggaccgctgccgggagacgggtgcggatcatgtgcaccaacaagactaccttgacccagacatgaatgacgttgctgctcagcaacatcctgcccaacgatcataa

SEQ ID NO: 43617 - DNA, 306 bp, Glycine max
  Peptide Sequence Number=SeqID_135302
atggctagacgtaatacatggtggggtttggtttggttcaaggataaaagggatgccccacattatttccatgacacaaatgcaaaaatgatgatttggaaattttatgcaaaactggacatgaccaagagcaagggcaaggatccacttgaaggacttggaggacctatgacaagggctagagcaaggaaagccaaggaagctcttcaacaagttctgtccatactatttgaatacaagcccaagtttcaaggagaaaagtccaaggttgtgagttgtatcatggcccaaatggaggaggactaa

SEQ ID NO: 43618 - DNA, 226 bp, Glycine max
  Peptide Sequence Number=SeqID_135303
atggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggcttttcctcattctctggagggagtggcaaaggactggttgtattagacaactcagtggagagagcct

SEQ ID NO: 43619 - DNA, 495 bp, Glycine max
  Peptide Sequence Number=SeqID_135304
atgaacgaagaacggatgaagaacggaggaaaaccttcacggatttgctcacagaaacatctcggaagcgttacggaagcacctcgacttggattttcttcacggaaacaatttttttcacccaagacagctgaaatgcatagccaagggggaaaagggggaggaggttgccgtccagctcatccaagcgagctgggttgctttctccataagcaaccctgcttccaaaatgctttggaagggcccagattcgaaaatttgaaacttgctatttgtacccccatcttgataagttcacccccttttttcgtaatttacgaaaaagttatggaagccttacggaagcatataggacttgattttcttctttttcctcttccctttcaccaatatcaagtgaaatatgcttacccaaggttttcagaaattttacggaagcattacggaagtcccgaaagccctggaagccattttttaacaaaacgggggaggtga

SEQ ID NO: 43620 - DNA, 522 bp, Glycine max
  Peptide Sequence Number=SeqID_135305
atggagacctatccaatggcgaaagagttgctacaagggatgatggataaaggcctaattgaagtttgtagggcaagaaaaggggaaggggatgtgcgcatgcagtcggttgataaaagcccgagcaagcccaagccattggtgatccactgcactagggatgttgccacacagaagccccgaggtttccagcccatcctagttaagaagcctacgcctttcccttacaaaagtgataaggtggtgctgtggaagtatgttgcacaagggtccgacggaaggaaggacgcgtccatcgtacatgttatggatgatctatcctccactaaggtcacaaacatatctggtatgagtggcatgattcgtagcgggcggatcattgcagcacctgaactaccagcacggtccaaagacccaaaagggaaatcaaaggtggagaaaggggatgatttcagcaaaatgggaatattcactgaagaagcaaccgagttcttgagaatcatccaacagagtgagttcaag

SEQ ID NO: 43621 - DNA, 525 bp, Glycine max
  Peptide Sequence Number=SeqID_135306
aggactacacgtcctcgccttcagggctacacgtcctcgcattcagaggactacacgtcctcgccttcagaggactgcacgccctccccttcagaggactacatgtgctcacctttagaggactacacgtccttggcttcagaggactacacaccctggcctttagaggactacacgtcctcaccttcagaggactacatgtcctcgccttcagaggactacacgtcctcacctttagagggcaacacgccctcgcattcaaaaggctacacgccctcacctttagaggactcatacgtcctcgccttcagaggactacacgtcctcgccttcagagggctacacgccctcaccttcagaggactacacgtcctcgccttcagagggctggacccctccctaaacagggctgcacgccctcaccttcagagggctacacgccctgcctttagaggactacacgtcctcaccttcagaggattacacgtcctcccctttcagaggactacatgtcctcagctttag

SEQ ID NO: 43622 - DNA, 54 bp, Glycine max
  Peptide Sequence Number=SeqID_135307
atggttgccgctaccaacactgttgctaagtgtgaacccgatgccccgatctga

SEQ ID NO: 43623 - DNA, 267 bp, Glycine max
  Peptide Sequence Number=SeqID_135308
atgaattgcgttttcgttcatgtgtcctccaccttcgagtttggagctatgcgtagtgattgcttagtgcaattctccattctcaactcttttcggagccccaagaattgcgttttcgttcatgtgtcctcccacttcgatggagctatgcgtagtgattgcttagtgaaattctccattctcaacctttttcggagccccaagaattgcgttttgattcatgtgtcccccccctccgagtttggagctatgcgtagtgattgctta

SEQ ID NO: 43624 - DNA, 780 bp, Glycine max
  Peptide Sequence Number=SeqID_135309
atggctacaccacctagctctccttctcctactggtgcagcatcacattcgccatctaccttaaagcgaacaagaaaagccacacatctaagatcattgtcgactagaccagttggggcagagagatccctaatacatgtggatcctgagatcgagaaagtcgacggtccccacagaaagaagttaagaacatatttgaggatcgtcgctcgtgataaagtggatgttacatacgagaattggaagcaagtccctgctgctcagaaggatttgatatgggaggatattcatgctgaatttgatatccctgaagcatcttatctgaggaaaaaaaaaagaaaatacttcagactgtgggggagtgtcgacaaggacagtgtcgatgacactgtatgcgaaaagtacgacattagcaaggagaagtgggcccaattttgtcagagttgcagagacccttcgtgggaggccatctggaaacaaaacagtgcccctcacatgttgtcttgtgggggttatgaatttctagaaaacaagttgttagaggagaagaaaaagaaacaacttgcaaaggctgctaaatctggaagcactcacactgtcattgatcctctatctcccatcagacgacacgtgaagtggaagatgaaccgcaccaagaaagctgggcaaatgacttctgagacaattaaagaaattgctgacaagattgtaagcctcacagggttcctttgtcaggatgtactgattgctgccattgggcgaccagaacaccctggtcgt

SEQ ID NO: 43625 - DNA, 303 bp, Glycine max
  Peptide Sequence Number=SeqID_135310
atgcttccttttgacttccggcatgtcacgaaacttcacggatttcctaacgatgggtgccaagtacctcaaagtggtcaaacgagggtcgcatcccaacaaacagatggtccccggacgaaattagggtatgacactggccatagcatgcccattagcgtgcgttccaaacgaaccctcgtggacttcctcgatcatgtggttcacctctttggcatccacgcatcacaagagggtcatgtcatggtttcgtttgtacaggacggtaccactcacaaagaaaccaatagccaatctccttaa

SEQ ID NO: 43626 - DNA, 486 bp, Glycine max
  Peptide Sequence Number=SeqID_135311
atgattagtcagtggaacaatcgagcagagtttagggtcgacgtttatcctcgacaggagggcctactgggttataactcagactacatggtgtggtataggcgtaaaacaaagatgtttgtcgacccaaacaatgcaaacacagctgcattgggtgacgttgtggagactctacagtatatggtgtcaccacaagggaggaacacatggacagttgatgatctcgtgccttatctggataagttagcgattatatcagaagagcaagagagaatcactgagccagtgtcacatggtccagcatcagagcgtgaatttccagcacaagagtttcacattcttcagtcaagtgttgagactcggggcataggcagacgaagggagcttgttgaagcggaacaatattcccaacaaatgatggagcgtggtcatggaatgtattacacgccaacgacattttccgaatatccttcacagatgtattag

SEQ ID NO: 43627 - DNA, 333 bp, Glycine max
  misc_feature (5)..(5): n is a, c, g, or t
  Peptide Sequence Number=SeqID_135312
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccggttcatgagagcccttgggccttctttagcatttctagctcaatcctcttggatagaagactccaagaagattgagccagagatggaagagaaggccctagggttctcatga

SEQ ID NO: 43628 - DNA, 189 bp, Glycine max
  Peptide Sequence Number=SeqID_135313
atgtgcatatcgtgggggagcctggggcattccattgagcactgtatgaccctcaggcgtaaggattttcaagtgcaagccattggtcagtttgctcaagcgacctgtgctcctgagtttggacttccaagaccgttcaatcagagattactcgtcttgcacgttggtggggttgtcgtaaaacaatga

SEQ ID NO: 43629 - DNA, 318 bp, Glycine max
  Peptide Sequence Number=SeqID_135314
atggtgaaagttggaacctcttacgtgccgatcaacgttcattttcgccaaaagttggcccagggctttcccggtatcaacagtagtttgcccaggatttatttatctgtcttacgtaaagtgatcttccgtcacagtcaagcttattcgcaataccgtcgtcgagggaacgcgcgggcgatcgagtgcggtcttcgctattaccagctggcgctaaagggcggatgtgtcatactggcttactatgttgggtacactgatgagggtgtcagtgaagcgttcgtgaaaaaagcgacggtgctcagcatgaatatgtga

SEQ ID NO: 43630 - DNA, 639 bp, Glycine max
  Peptide Sequence Number=SeqID_135315
atgaagcacttcactgacaccctcatcagtgccaacataggaacaaaagctggtaccgggccccccctcgaggtcgacggtatcgataagcttgatgctctttatgtatggctggtctcccactcttttcgtcatgaaagtagacccgtctgtcccctacaaggtcatcacatgtgtgccaagaaagggaaaatgatttgggagaaactcttggcgggcttagcaatccatccactaagcgcacctctcttacggctgagcgcatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 43631 - DNA, 240 bp, Glycine max
  Peptide Sequence Number=SeqID_135316
atggcagaaatcaaccaaggtaagacgatgaccggtcacgattggccgcatattgtttgtctcctacttgcagttttggtttgttttttatgcttgatttctcgaattgaggatttgaatgagaaggccttaggcctatgttgtattctgaagcaatggggcatgccgcattgcccccattctcttgcaatttatgtccaaacgtgcgcccaccaagtgctcggtgaaatgccccaatga

SEQ ID NO: 43632 - DNA, 288 bp, Glycine max
  Peptide Sequence Number=SeqID_135317
atgtacaaagagaattggacccaaacttggcccatgggctcaaaaatctaccctacggttcatgagaaccctagggccttcttcagcagctctagcccaatcctcttggagcctcttgctcatggctcaagtgattggtcccttcctagggaggattgcatcagttaccactactggaaaacccgaatgcaaatatttattgaagccatagactacaacatttgggaagccatagaaataggaccttatgttgcctccataatagatggaagcacatcaacaggatga

SEQ ID NO: 43633 - DNA, 291 bp, Glycine max
  Peptide Sequence Number=SeqID_135318
gggggcggagcctatggaagtaaagcggtttgccgcggcctctcattccctgttaagtatcgaattcctggctcttccagggggaatctccgccccgttctaagcctttccgctcgccgctcgaacgaccgagcggtaggagctcagagcgggaatgcggcctatagtgagtcgtattcacatattcatgctgacgcaccgtcgctttttttcacgaacgcattcgactgggaacaccctggcgttatcagtgccaacatagtaatcgccgtatacacatccgccctttag

SEQ ID NO: 43634 - DNA, 297 bp, Glycine max
  Peptide Sequence Number=SeqID_135319
atgctacaatgcgagaggtatttctctttgctcagacatattatcgaaattcccaacggtgagaattctcggaattgggttgcgaacgtgattctcaaatttcacaatgatccaacggtgaatgagtccgagatcgtcatttttctgagacaggttaggtggcctacaggaaaaagagagggtgttgggagaagagagaaaaacgaaattgagcacttataccggatgacccccaaggcatccactctgaagagtccgtcagcgtctctccctcctgattcaatgcgcctcaagtga

SEQ ID NO: 43635 - DNA, 351 bp, Glycine max
  misc_feature (43)..(43): n is a, c, g, or t
  Peptide Sequence Number=SeqID_135320
atggaaccgattgcatccctttcccagtattatgaccagcccntaaggtgcttcacatttgaggacttccaactagtgccaactgtgaaagagtttgaagaaatcctgggatgcccactgggaggaaggaagccatatcttttctctgggttttatccctctgtcgcaacctacccttcggcgggagggcgacgcgtgactcgcgggatgcgcgttccacgaaaggaatccgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 43636 - DNA, 705 bp, Glycine max
  Peptide Sequence Number=SeqID_135321
atggcgtcattggtgattatcaacgaagagaacttcgaagctctggaagaggatgaagaagtccgagctctgaaaaatgaactaggaaaagcgagacttgccaaagaaaaattcaggttggttgctacagacgtccggaaagagtgtgccgggttacgagaagaaaatgtagctaccaccaaggccttggaacaagagaccaagagggctcgtagggaagagcacggccggaacaagttccgaggggcgttgtggggtagtaacaacgagcttaaactccagagggaggaaagggaccaatcgcgggtagacagtttgatcttgaaggatgagttgaaagcttgctcgaggtccaagagaagtttgtctcagcatttatgcgagacagagaccaacatgttagccatcatcagcaagtaccaagaggaactaagtctagccacggcccacgagcatagggtggcggacgagtatgcccaagtctacgcggaaaaggaggctaggggaagggtgatcgactcgttacaccaagaggcaaccatgtggatggaccgatttgctcttaccttgaatgggagtcaagaacttccccgattgctagccaaggccaaagcaatggcggacacctactccgcccccgaggagatccacggacttctcgactattgtcagcatatgatagatttaatgggcccatataattag

SEQ ID NO: 43637 - DNA, 426 bp, Glycine max
  Peptide Sequence Number=SeqID_135322
gcccttgcagccgatcaggatagtgtcgaggagactgtctgtgagaaatacgacatcagcaaggaaaagtgggcccagtttttccagactcgcagagacccttcttgggaggatgtgcgcaagaaggcacaggccatccagaagcagaatactgccccccataagctcctggctgagaagacgaagaagaagctggaggaagctacacagtcaggaagcgttgatggtgtcatcgaccctccatacccggtcagacaccacgtgaagtggaagatgacccacacgaagaaaacaggggagaagacgactgaggccgcaaaggaaatcgctgagaagattgattcctttgaggagcaggccacacagggatccttcgtcccccatggacgtcaggatgttctcgtcgctgccattggacgtccatag

SEQ ID NO: 43638 - DNA, 467 bp, Glycine max
  Peptide Sequence Number=SeqID_135323
cctcaaggaattgggacgattgatgggacctctccaaaggcaagcctttcgcaaagtgtacggaaagattctagatttgaccgcgacggaggtatttacggaggctgtcatatccctcgcccaatactatgacccagccgttgaggtgcttcacgtttggggacttccaaatgctgtggttggggattcggcaagagagttggatcgcatgaagcaaactcgcaacggcgtagtgggcctgccacggaaatacttggaaggcaaggcaagggatatggcgagccaagagaagtggggcgcgtttgcggatatactagctttgttgatttttggggttgtcctctttccgaacgtggacggtttggtggacttagccgccattgacgctttcctcgcgtatcaccataacaaggagagtccagtggtggctatcttggcagatttgtttgatacctttgaccggagat

SEQ ID NO: 43639 - DNA, 378 bp, Glycine max
  Peptide Sequence Number=SeqID_135324
ggcaccgacccaggcaccctttggaccctagataagtccaatagggccctgggttttcccgcactgatcaccggactctgccagtcgttcggagtccccgttgcacctaccaaggtgattcgatcgcccatcacccgggcttttattgagaagtactacacccagagacaggctcagggtgatgctccacaggccgcaggcgcgccaccacctcatcaggcggaccagttcagggcagaggtcgcatgtcccggggattggcccgaggcccagacaggagaggcacccccagaggcccccgacgatggagaggaggcccacgaggacgaggagatgaccgatttgcttgacttcttgggagggagtggagctacatga

SEQ ID NO: 43640 - DNA, 399 bp, Glycine max
  Peptide Sequence Number=SeqID_135325
atgtcggactcagccaacaagttgcgattggtgcgtttcccaaagtgtcaaaatcttcttctcgaactcgctgattactctgtctatcaatgtggtggctgtggtgccgttcttcgagcaaagcataaaggttatgtgagtggtagcttgtcggatgaggggaaggttggacttggaggagattctgaggatactggtgagaaaggggtaattgacgatgatgttgatgtcggcaagaataaagatgaactgggtaaaacaataggaagagaacaggagaaacctcccaagtctcaaattggttgtgagaatgggtccaaattctctaattggccgaatgagagagaagtgagatggaagggttttggagaaagccacgagctgatctggaaaatctga

SEQ ID NO: 43641 - DNA, 240 bp, Glycine max
  Peptide Sequence Number=SeqID_135326
atggcttacaacggggcggaattcctggatcagatggcgactccatggaagatcgttaagggagttgagaggcttcgcaggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccg

SEQ ID NO: 43642 - DNA, 384 bp, Glycine max
  Peptide Sequence Number=SeqID_135327
atggatgaatactttagggtgtcaaactgcaaaaatgcaaatgatatgtgggataccttacaattaacccatgaaggaacaacagatgtgaaaagggaatggcaaccaagggaacatgaaatggaattaatgagattgaatcagcatgaggagaatgataagaaaaagaaaggacttgctcttaaagtttcatcttcaatccaagaaggaagtgataaagaggattcaaatgaagtagacgaagatgatgatttcagtctttttgtgaaaagattcaacaaatttataagagtcagaggaaaacaaagaagattaaatttcaaatcaaagaaaagggcagaagattcatcctctactccaaaatgtttgaatgcaatcaactag

SEQ ID NO: 43643 - DNA, 732 bp, Glycine max
  Peptide Sequence Number=SeqID_135328
atgacgattggtttaccgcccgggcaacgggcgcgggccacgtcaatccgtgcactcttccaccaggctttcgtccagggcgaggatcgccagtttcaccccaacggcgcactcttccacccaggcgaacgaggcgttcgggctgaggcaggcatcctcgaggcgccggcagctttccaccagttgctcgccacgcaccaccctcgccgcgcccttgatccgatgcgccagctcggccagttcgccggtctcctggcgttgcaccagtccctcgagggtctccaggtccttgcggttgctggtcagcagttcgtcgagcagccgcctgagcatcgtcggctcgccgccggtcagcgcatgcagggaatccaggtcgtagagacggggggccgtcggtatggcgacgggttcggcatcgatggtgacgggcagctcgtcggcggcgaagcccagggccagcaggcgctcctcgaggacatcgaggccgatgggcttgatcaggcactcgttcattccagcctggatgcagcgctcgatctcctccggctgggcgtccgcggtgaggccgatgatgaccaccggctcctcgccattctcgcgctcctcctggcggatcgagcgggcaaggtcggagccgctcatcagcggcatgtggcagtcggtgatgaccatgtcgaacggttgcccatgccacaggttgagagcgctcaggccgttctccgcttcctccac

SEQ ID NO: 43644 - DNA, 243 bp, Glycine max
  Peptide Sequence Number=SeqID_135329
atgccctatcgaggtttaaaaaagaagcatcagcggatgacgccgatcgaacatttcctaatagacagcatccaaataatattcagggatacaatagaaattacaattgccgacatcggtcattgtaaagccacgactgaggtagcgtttttgttcggtgttgccgtaaaaatttactatgaaggtgatgagaatcatgaaactggccaaatacaggctaaaggcccaagtggagaaggatga

SEQ ID NO: 43645 - DNA, 691 bp, Glycine max
  Peptide Sequence Number=SeqID_135330
tttcgatgcggatgccctcagccagttcctgggataccctttagtgttggaggagggccaggagtgcgagtatggccagaggaggaaccaggccgatgggtttgatgaggaggccatcgcccagttgctgtgtataccggggcaggacttcgcccggactgctgctgggagacgggtgcggatcatgcgcaccaacataactaccttgacccagatatggatgacgttgctgctcagcaacatccagcccagcgatcataattctgacctccccctgccgaagtgtcagctggtgtacgcggtcctgacacagatgagcattcacgtggctcagttgatcgctgatgccatttatctatttgcagtccccgtcgcacctagcaaggtgattcggccacccatcacccgggcttttattgagaagtattgcacgcagagaccggcccagggtgatgcaccacaggccgcagacgcgccgccgcctcatcaggctggcccagctaggtcatttgattcggaacagtatttacggcatttggttcgccagcaggcggccaaccaccgggcgcacgtactgacccatgactgtctttaccagctgagcctcaacctgcagagccagggttttacttcttttccatgccctactccggatcagttcagggcagaggtcgcatggcccggagattga

SEQ ID NO: 43646 - DNA, 348 bp, Glycine max
  Peptide Sequence Number=SeqID_135331
atggtttctcaaatcccaaatccaagggttgatccttctcaatattgtgatttaaaaataagcaacattaacaacaaaaggaaccgctcaaaatatgaggacttgcattgcatgggaaccaagaatcttccaagatggattcatgagatgacaacaaaggctaagggagtgcaaccttctagggtagaaatttattttgacactcgaactcaaaaagatggaagtgttgttattgaaaaggctactattgtaattgatgaactaaaaaagaaaatagttgaagtagagagttcacaaaatttacaaagcacccaagattctactaattggacaaatgatatatattga

SEQ ID NO: 43647 - DNA, 258 bp, Glycine max
  Peptide Sequence Number=SeqID_135332
atggaagccctctcatccggcatgatggacctgaattaccagcggcatcagcaccttgttgccttgcgtataatatttgcccatgaaactcccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataa

SEQ ID NO: 43648 - DNA, 626 bp, Glycine max
  Peptide Sequence Number=SeqID_135333
caagccaaacagtcaaagaaaggttcaaatcagcagctatcaagatccgaaaggaaaatgccgaactaagagatgtaaatatagctaccaccaaggccttggaacaaaagaccaaaaggactcgtagggaagaacacggccaaaacaaatttcgaggggctctgtggggcaataacagcaagcttaagctccagagagaggagagggaccaatcacgagtagacagtttgatcttgaaggataagttgaaggtttgcctaaggtccaagagaagcttgtctcagtgtttatgcaagacagagaccaacatgttagccatcgtcagcaagtaccaagaagaattaaatctagccacagcccacgagcacaaagtggcggacgagtatgcccgagtgtacgctgaaaaggaggctagaggaagggtgattgactcgttacatcaagaggcaacaatgtggatggaccaatgtgctcttactttgaacgggagtcaagaacttccccgattgctagccaaggccaaggcaatggcggacacctactccgcccccgaggagatccacagacttctcggctattgtcagcatatgatagacttaatgacccatataattagaaactgctag

SEQ ID NO: 43649 - DNA, 180 bp, Glycine max
  Peptide Sequence Number=SeqID_135334
atgacattcatgtgtctccgaaaaagtggagaatggagaattggcggacagcgctacgcaataactttgcggggctccagactcgaaggagaatggagaattggcgaacagcgctacgcaataacatcttggggctccagactcgttggtggaggatacatgaacagcgctaggcaatga

SEQ ID NO: 43650 - DNA, 372 bp, Glycine max
  Peptide Sequence Number=SeqID_135335
gttacaggttgtaccatttgtggtgaggctcatgaattaggccattgtattcccattgaagaacacactcaggaagttcattacatgggaaatcaacaaaggcaaggatacaaccaaggaggattttcaggtttccagcaaggtccctacaatcagcaagggcaacggaaatcacaccctggcaatcaattcaataaggaccagggtggactttccaacaggccacctcaacaagggccaaatatttttcagaggaccaccaaactggaggagacactagttcagtttatgcaagtgaccatgtccaaccataagagtattgattcatccctgaaaaaccttgatatccaggtgggtcaactggcaaagtag

SEQ ID NO: 43651 - DNA, 210 bp, Glycine max
  Peptide Sequence Number=SeqID_135336
atgactaaagcacgtcaaaagagggaaagtaggggaggagcttgccacccagctcacccaggcgagctaggttactttctccagaagcaaccgccttctggaggaacatcctggaaggcccagaacctcacgaattgtgcaacgatgctttcttttgatttcggacatgtcacggaactccacaaattgtgcaacgatgctttcttttga

SEQ ID NO: 43652 - DNA, 97 bp, Glycine max
  Peptide Sequence Number=SeqID_135337
atggaaaactcaaaacacttggctactcctatgaacaccagttgttatcttgacaaagatgaatctggtcaaccagttgatgcaaagcaatacagag

SEQ ID NO: 43653 - DNA, 807 bp, Glycine max
  Peptide Sequence Number=SeqID_135338
atgggaacaaatcaaaccggcaagaggttctaccaagtcaaggttaaaagcctagataccacaagcatcaaggaattagggcggctgatgaaacctctccaaatgcaagccttccgcaagacttacggaaagatcttagagttgaccatagcaggaggtgtccatagaagccattgcatcactcacccaatactacgaccagcctttgagaaattgcacaaggattcagcaagaggtttggaccgcataaaacagactcggaatggcatagcgggcctaccacggaggtacctagaagacaaggcgaggggtatgtccaatcaaggagattgggtcccatttatggatgtgttagctttgctaatttttggggtcgtcctctttccaaacgtggatggtttggtggacctagcagcaatcgacgctttccttgcataccaccatagcaaggaaagtcctgtggtagctgtcttggtagatttaattgacacatttgaccgaaggtgcgaaaagagtagcgcacagatcatctgttgcttgcccgccctctgtgtttggttggtttcgcacttgttccagcaagacacaaggcatccatgtccgctcctgagccatcgctcgtgtactgaaaagaggagaatagattgggaccagcttttggccgggataggaggtagaacaatcaattggttcccccgatggaaggaaggaaaggagggagtccttttctcatgtggagggtacctaaacattccgccgataggaacgaggagttgtattaactacaatcccgcgctcgctatatga

SEQ ID NO: 43654 - DNA, 231 bp, Glycine max
  Peptide Sequence Number=SeqID_135339
atggtggcgcgtgttatgctcaggaatggatttgagcccggaatgggtctaggcagggactgcctcgggaatgctgacatggtcgatatcaaaggaaatccatacaagtatgggttagggtacgaacccgggatgccggggaggaggtggccgatagggtatggcccggccgtattagccagtgtttcaccagcgctggaatggtgtccgaggaggaggtggctgcaatag

SEQ ID NO: 43655 - DNA, 594 bp, Glycine max
  Peptide Sequence Number=SeqID_135340
atggagacgtgtttggaagtagaggaattgttacagcggatgatagaccaaggtcgactagaagtcggcattgaaggaaaagaagagcagcatatatgcatgcaatctatggaggggagcggtgttgcgaagcccaaacccttggtgatatacttcactaaaagtgcagcctcgcaaaagcccgggcaccccttaatggccaaacctgttcctttcccgtaccaaaatagtcacgcggtcccgtggagatatacacctccggggaagaaggaagaagaagtcactgacgtcagctcgctgtcagctaaagtaacaaatatcacggggctgagtggtgtgacccgtagtggtcgtgtgttcgcacctccggacctaccagtccaacccgccgacgtcaaaggaaaaggaaaagtggtggaggaacaagatggcgaagcaccccacgcttcgaataaagatattccagcaaaggggcccccagagaaaaaggatggtagaaaggaggtgtcgctagaggaagccagcgagttccttcgcataattcagcagagcggaattcaaggttatcgaacagctcaacaaaaccccggctag

SEQ ID NO: 43656 - DNA, 402 bp, Glycine max
  Peptide Sequence Number=SeqID_135341
atggttaggaccagaggattaggtcgtgccttaggtcaggttactggcaaaggtgtgggcagaggagatcatgatgattctgatgatgctccgcagcgtcggcggcctactgcatcagcacggaggcagcgagtcgctgtgactgcggatcacgtcgatgagccagtcatcccttcgccagatgttcaggatgacccgatggaggcaccagttgctgtagaggacattcctgcggacacaggcgcagaggctgctgaggacgcgcatgagggatttccgggtggtccgagcgacccatccgtgttgaccttgactaagtcctctgatcatgtgttcggtagacaccggcgatcggggacttttgtccgtgtttatggagcggtggcaccgggagacatctaa

SEQ ID NO: 43657 - DNA, 240 bp, Glycine max
  Peptide Sequence Number=SeqID_135342
atggcatttgcgcaggattttgtggaacttagcttgcgaaacaaattgtgcacattgatgtatcatgaaaaggaaatggctctgagaaagctttccgcaaagagatctaggagtgacgccacggctgaagggaccagtgccgctcccgagtttgatagccatcgtttcaggagcgctgagcaccaacagcgtttcgaggccatcaaaggatggtcgttccaccgaggtgggatcctctag

SEQ ID NO: 43658 - DNA, 425 bp, Glycine max
  Peptide Sequence Number=SeqID_135343
ggctcgcaaggaagagtatggccggaataaatttcgcggagctctgtgggttagcaatagtgaactcaagctgcgaagggaagagagagaccagtcgcgagcacatagcatggtcttgaaagaggagttagttgcctgttcaaggtccaaaaggagcttgtctcaacgtttatgcgagacggagaccaacatgctagctatcatcgccaagtaccaagaagagttaggtctagccacggcccacgagcataggatcgcggacgagtatgctcaagtatacgcggaaaaagaggcaaccatgtggatggatcggtttgctcttaccttgaacgggagtcaagaacttccccgattgttagccaaagccaaggcaatggcggacacctactccacccccgaagaaattcatgggcttctcggctatt

SEQ ID NO: 43659 - DNA, 420 bp, Glycine max
  Peptide Sequence Number=SeqID_135344
atgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaagtttggcggcgggcccgatgatacgcggagtcgccatggagaagatgaaggccgacatggaggccattaaagagaaaatgggtgaaaaaaggaggttatatgccatgtggagtcgccatgtcggcctccatgtcggcctccatgtcggccttcatccccagtggagtcgccaactgtcgcaacctacccttcggcgggagggcgacgcgtga

SEQ ID NO: 43660 - DNA, 336 bp, Glycine max
  Peptide Sequence Number=SeqID_135345
atggaggccattaaagagaaaatggccacaatgatggaggccatgatgagcgtgaagaagataatggaagccaatgcggttgcaactgccgctaccagcgttgttgctaaggagacacatgaaattccccaccacgatctagccaacttcgagccttgcctcggatatgctgctgaaggacaagcagttggtggtatacccctgcaaaacactttggagggccctcaatatcttccacaaccacaaccctcacgttccacagcggttaaaaaccctcatgactatggcaggaatgggaaagttggatcatctagaggagaggctcagggccattga

SEQ ID NO: 43661 - DNA, 1190 bp, Glycine max
  Peptide Sequence Number=SeqID_135346
atgcacggcctcaccttcagagggccgcacgccctttccttcagaggactacacgtcctcgccttcagagggctacatgacctcgccttcagagggctacacgccctcgcctttagagggttatacgccctcacctacagaggactacacgtcctcccctttagagggctacacgccctcgccttcagaggactacacgtcctcaccttcaaaggggtacacgccctcgcctttagagggctatgtgccatcacctccagaggactacacgtcctcgccttcagaggactacacgtcctcaccttcagagggctacacttcctcgccatcagaagactacatagggctgcacgccctcgtcatcagaggactacccgtcttcgccttcagagggctacaccccctcgtcatcaaagggatacacaccctcgccttcagagagccacacaccctcgccttcatagggctacacgccctcgcctcagagggctacacgccctcgcctttagagggctatacgccctcgcctttagaggactaaacgtcctcaccttcaggaggctatacgccgtcgccttcaaaggactacacatcctcgcctcaagagggctgcacgccctcgcctttagagggcttcatgtcgtcgcctttagaggactgcacgtcctcgccttcagagggctacacgccctcgccttaagacagatgcacgccctcgccttcagagggctgcacgcccttgccttcagaggactacacgtcctcgccttcagagggctacatgccctcgccttcagagggctacacgccctcgcctttagagggttatacgccctcgccttcagaggactacacgtcctccccttcagagggctacacgccctcgcctttagaggactacacgtcctcaccttcaaagggctacatgcccttgcctttagaaggctatgcgccctcacctccagaggactacacggcctcgccttcagaggactacacatcctcaccttcagagggctacacttcctcgccatcagaagactgcatgtccttgccttcatagggctacacgtcctcaccttcagagggttgcacgtcctcaccttcagagggctacatgtcctcgccttcataagggttacacatcctggctttatagggctacgcgctctacctccagaggactacac

SEQ ID NO: 43662 - DNA, 87 bp, Glycine max
  Peptide Sequence Number=SeqID_135347
cctttgagaaatagcatcatgtcataccctaatttcgtccggggacctttgcttgatgacatgcgacctttctttggtccttgtgag

SEQ ID NO: 43663 - DNA, 222 bp, Glycine max
  Peptide Sequence Number=SeqID_135348
atgcctacaattgaactagacttcccaaatggaaagaagttccctggcaacggcaccaaaaacttgttccacccctgtactacttgttattatggatgcgaaatcttatcgacaagtgtaccgagtcgtgcaagtaataacaaaactgtgttcatgtgttctatgctgaggacaacattcccaaacatcgatgtctcgcatgagtggacaaattctaattaa

SEQ ID NO: 43664 - DNA, 909 bp, Glycine max
  Peptide Sequence Number=SeqID_135349
atggtggctggcctgaaggggattttgcccgttttgccaacgccttttctggcggatggcggcattgaccaagcgggtatggagcgactggtgatcttcgcgctcgaaaaaggcgtggatggtgtggtgttcccgggttttgccagtgaggttgagactttggatgctgcagagcgtgcgtcgctgctgaagatcgttgttgatgctgttgctggccgggtgccggtcgtggcgggcgcgagcgcggcagactggagagacgtggttgaacatggccgcgccgcatctgatctcggtattcgccacctgatggttcagccgccaaaatcggtcgggactgatgcgccggcgctgatcgagtttctgggtaaggttgtcgaggcgctgcccggggttgaaatcatcctgcagaacgcgcctgcgccgcgcgggtctgatctgtcgccggaggcgattgtcgagatcgtccggtctctgccgcaggtcacctacgtcaaggaagaaacgctgccggccggtcccgccatcagccatatcatcgcccatgcgccctcaacattgaagggtatcatcggcggcggcggcgcccgttacattctggatgaatatgcgcgtggcgccaccgctgccatgccggcgctggagatcgtcgaggaacacgtggcaatagatcgcgctctccgcgcgggccgtcaggatgaggcccggaaaatctatgtccgcactcttccgcttctggttctgcaggcggtttatcgcatgcggctgaccaagtacgtgctggcccgccgtggggtgatcgagggtctcggtgtccgcgcgcccaccccggaactcgacaaggcggcgattgccgatatcgacgccaacctcgtcgagctcggccttgtcgccccggaggccgcatga

SEQ ID NO: 43665 - DNA, 450 bp, Glycine max
  Peptide Sequence Number=SeqID_135350
atggtagctacaacttaccaaacctcccatgaatgttcaaaagagaccattatagatatcttagtggcaggattttctggacaactgaaaggatgcgcagttaagacggatctcaatggaaaagtcattactaatgacgatgataaagagattcctgacactgttaacacattaatttttacaatagcccaacatttcattggagaccaatccttgtggaaagataggtctgcagaattattatcaaatcttaagtgtagaaccttagcagactttaggtggtacagagatactttcctaactggggttttcaccagagaagatagtcaacaacctttttggaaagaaaaatttctagctggtcttcccagatcattaggagacaaggttagagataaaatccgtagtcaatctgccaatggagatattccatatgaaagtttaagctag

SEQ ID NO: 43666 - DNA, 777 bp, Glycine max
  Peptide Sequence Number=SeqID_135351
tattctggcggcgctggtggactcgctgatggatattgccgcctcgctgaccaatctgctggtggtgcgttactcgctgcagccagcggatgaagagcacacgtttgggcacggcaaagcggagtcgctggccgcgctggcgcagagcatgtttatatccggttctgcgctgttcctgtttctcaccggcattcagcatctcgtctcgccgacaccgatgaacgatcccggcgtcggcgtcgttgtgacgattgtcgcgcttatatgcacacttgttctggtaacgttccagcgctgggtcgttcgcaaaacgcaaagtcaggctgtacgggcggatatgcttcattatcaatctgatgttatgatgaatggggctattcttattgcgctcggtctggcctggtatggctggcatcgggccgatgcgttgtttgcgttagggattggtatctatattttatatagcgccctgcggatggggtatgaagcggtgcaatcactgcttgaccgcgccctcccggactcagaacgcaatgaaattttttctatcgtgaccgcctggcccggcgtcagcggtgcgcacgatcttcgaacgcggcagtcagggccgacccgctttattcagattcatattgaaatggaagacaacctgccactggttcaggctcacgtgattgctgagcaggttgagcaggcgattttgcagcgttttcctggttcagacgtcatcattcaccaggatccctgctcggttgtacccggacatgttgggctttc

SEQ ID NO: 43667 - DNA, 321 bp, Glycine max
  Peptide Sequence Number=SeqID_135352
atgaataaaatcctgttagttgatgatgaccgagagctcacatcccttttaaaggagttgctcgacatggaaggtttcaacgtcctggttgcccatgatggcgagcaggcgctgagtctccttgacgacagcatcgatttacttttgctcgacgtcatgatgccgaagaaaaacggtatcgatacgttgaaagagcttcgccagacacaccagacccccgttatcatgctgaccgcgcgcggcagcgaacttgaccgcgtactcggcctggagctgggcgcggatgactatttacccaagccgtttaacgaccgtgaactg

SEQ ID NO: 43668 - DNA, 378 bp, Glycine max
  Peptide Sequence Number=SeqID_135353
atgggtgaagtagaggagatacaagagaagatgaaggccgacatggaggccattaaagagaaaatggccacaatgatggaggccatgatgagcgtgaagaagataatggaagccaatgcggttgcaattgtcgctaccagcgttgttgctaaggtgaacccgacgtccccatccggcatcaaccaaatgaatcatccaacctcagatatgacacatgaaattcctcatcacaatctagccgacttcgagccttggctcgaatatgccactgaagggcaagcagttggtggtataccccttgaaaacacttcggaaggccctccagtatcacccccaaccacaaccctcatgttccacagcggtttaaaaccctcatga

SEQ ID NO: 43669 - DNA, 54 bp, Glycine max
  Peptide Sequence Number=SeqID_135354
atggccgaccagcaggcgaccgagtccaaagccaaaggtagcaagataccttag

SEQ ID NO: 43670 - DNA, 734 bp, Glycine max
  Peptide Sequence Number=SeqID_135355
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggcaccatccagcccactgagggccagaatagaacaaaaaagcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43671 - DNA, 466 bp, Glycine max
  Peptide Sequence Number=SeqID_135356
atggtgggttacacaccttcaagttttacagatttggtcttcgccagcaaaaagatcgaagtggatccgaaaagaggcaaatttgatcatcctactaggacgactgagaaaactggggcaaatgaagagggtgagaaagagggagaaacccatgctgtgactgccattcctatacggccaagtttcccaccaacccaacaatgtcattactcagccaataacaaacctcctccttacccaccacccagttatccacaaaggccatccctaaatcaaccacaaagtctgtctaccgcacttccaatgacgaagaccacctttagcacaaaccaaaaaaaaacacaccaacaaaaaggaattttgcagcaaaaagcctgtagggttcaccccaaattccgttgtcatatgctaaacttgatcccatatctacttgataattcaaatggtagccataaccctagccaag

SEQ ID NO: 43672 - DNA, 468 bp, Glycine max
  Peptide Sequence Number=SeqID_135357
atgagaggccctttcgatgagtcaatctcttgctttctcataggggtgcacccttgggtactagaacctattgcctttagagggctacacgccctcaccttcagaggactacacgtcctcgccttcagaggattgcacgccctcgccttcagagggatacacaccctcgccttcagaggactacacgtcctagcctttagaggactacatgtcctcgccatcagagggctacacgccctcgcctttagaggactacacgtcctcgccttcagagggctacatgccctcacctttagaggactgcacgccctcgccttcatagggctacaagccctcgccttcagaggactacacgtcctcaccttcagaggactacacgtcctcgccttcagagggctacacgccctcaccttcagaggactacacgtcctcaccatccgaggactacacgtcctcgccaaaatgtag

SEQ ID NO: 43673 - DNA, 839 bp, Glycine max
  Peptide Sequence Number=SeqID_135358
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatcttgtcgagatgcgggccgactcactcggtcagaatatatcaccaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43674 - DNA, 84 bp, Glycine max
  Peptide Sequence Number=SeqID_135359
atgggaaaagatgtcaaggaaggagaagtgaaagggatcctaggaacagagaattattcgctcatcgcctttgattctgcttaa

SEQ ID NO: 43675 - DNA, 1926 bp, Glycine max
  Peptide Sequence Number=SeqID_135360
atgcctgaggctcatagccactacctttgcaacaagccaaatggcaaacatgatggtgctactaatactagtagcatcatcgagcacaacaacaagaaagctctgaaatacattgaggatgttactagcaacgctgatgaaattcagaaaagggtccttgctgagatcctttcttctagtgcacatgctgagtaccttcaacgccatggcttggatggacgcacagacagagaaactttcaagaagatcatgcctgtggtgacatacgaggatttaaagccagatattgatcgcattgctaatggtgatacctccccaattttatgttccaaacctatttctgagttcctcactagctctggaacatctggtggggagagaaaactgatgccaaccatagaagaggagctagagcgaagatcattactctacagcctcctgatgccagtgatggagcaattcgtacctggcctagacaaaggcaaaggaatgtactttctgttcataaaatcagaagccaaaacccctggtggactcttagctcgtccagttttaacaagctactacaggagctcacacttcaagaacaaaacacattgttttgacccttacacaaactacactagccccattgagaccattctctgcctagactcttaccaaagcatgtactctcaaatgctctgtggactttcacaaaacgagcatgttctccgtgttggtgctgttttcgcctcaggtttcatccgtgcccttaagttcttggaaaagcattgggtgtgtttgtgccgtgacattagaaatggcaccattggccctgaaatcactgactcatccgttagagaagccatcatgagggtactcaaaccaaacccaaaacttgcggattttatagagggtgagtgcaagaaggggttgtggaaagggataattactaggttgtggcctaataccaagtacgttgatgttattgtgactggaaccatggctcagtatattcctatgttggattactatagcaatggtctccctcttgtttgcaccatgtatgcttcttctgagtgttattttggactcaacttgaaccctttgtgtgatcctagtgaggtgtcttatacccttgttcccaccatggcttactttgagttcttgccccttaataagacgaaggaacatgcgaattcaatttcttacaccgagcaggaacttttggttgatcttgtggatgtggagctggggcaagaatatgagcttgtggtcaccacttatgcagcttctaacaactatgccaccatgcacaaccaaacaggactttacaggtaccgggtcggcgacatcctccgtgtagcaggattcaagaacaatgctcctcaattcaatttcgtgtgccgaaagaacgtggttcttagcattgattccgacaagaccgatgaggttgagctacaaaacgctgtgaaaaatggagccaaccaccttacactattcggtgcatcactcacagaatacacaagctttgctgatacgtccactatccctggccactatgtactatactgggaaatcagcatgaacaagaacaacaacattgatcaaaatcaaaacccaattccaagttctgtttttgaggagtgttgctttgcagttgaagggtctctcaacagcgtgtatcgacaaggaagagtatcagagtccattgggccattggaaatcaagattgtggagaatggaacttttgataagcttatggactttgctcttagccagggtgcgtctataaatcagtacaagacacctcgttgtgtgaagtatgctcccattgttgagcttcttgactcgaaaactgtttccaattacttcagtccaaaatgtccactgtgggttcctggtcacaagaagtggtgcatgtaccctcttgacaacaaataa

SEQ ID NO: 43676 - DNA, 3614 bp, Glycine max
  Peptide Sequence Number=SeqID_135361
aaggcgatggacatgcttccaaaagagctaggatgctggttgattatagtgaagaagatagtgattttgaagatggcagcctgccaaattggaaagatgaatccacttttgaggctttatgtggtgatgctacattctctggggaaggaagtgacattactgatcccaatgttggaagcttgggtttattagatggttgtatgttgtcacgagttttccactgtttaaggtctgatttgaaatcacttgcctttgcatcaatgacttgcaagcattggagagctactgtaaggttttacaaaaaggtctcaaggcatgttaatttgtcatccttgggtcattcttgcactgattccataatgtggaacattttgaatgcctatgaaaaagacaagatagaatctattgttctaattggttgcaccaatattactgctggcatgcttgagaaaattcttcttttgtttcctggtttatctacagtagacattagagggtgcagccagtttggagagctgactctgaaatttaccaatgtgaaatggatcaagagccatagttcacatataaccaaaattgcatcagagtcacataaaatcagaagtgttaaacaatttgctgagcaaacttcatctgtttctaaggtcagcattttgggtattagggatgattttggtgagctgaaggactattttgatagtgtggataagagagacacagcgaagcaattattccgtcaaaacttgtacaagcggtcaaaattatatgatgctcggaactcctcgtctattctctctagagatgctcgtacaagacgatggccaattaagaaatctgaaagtggttacaagaggatggaacaatttcttgcttcaagactgagggaaattatgaaggcaaactcctgtgacttttttatgcccaaggttgcagaaattgaggctaaaatgaaaaatggttattacagtgggcatgggttgagctatgtcaaggaggacatcagtagaatgtgccgggatgcaataaaagcaaagactcggggtgatggtggtgatatgaatcatgttatcacattatttattcagcttgcaacacggttggaggagaattccaagtatgtgaatagcagagatgcactaatgaagttgtggggaaatgatcccccatcgtctttatgttctacttcctctaagtacaagaagagtaaggagaatagattgttatctgagaggaagcataggaataatgaaacacatggtggtttggataatggagaatatgcttctgatagagaaatcaggaggcgtttatcaaagttgaataagaaatatttcaactcggagagtgagacatctgatgactttgatagatcttctgaagatggcaagagtgatagtgatactaccaccactgacactgaaagcgaccaagatgtccattcagaaagtcgaattggggactcgagaggagatgggtatttcacacctgatgatgggttgcatttcattactgatgagcgtgaatggggggctcgcatgacgaaagcaagtttggttcctcctgttactcggaagtatgatgtcattgatcaatatatcattgtagctgatgaagaggatgtgcgaaggaagatgcgggtttcattaccagatgactatgcagagaagctgagtgcgcaaaagaatggcattgaggagtctgacatggaactgcctgaagtcaaggattacaaacctagaaaacagcttgaaaatgaggttgttgagcaagaagtttatggcattgatccctatacccacaatcttttactggattctatgccaaaggagttggattggtctctacaagagaaacatttgtttatagaagacaagctccttcggatgttgaataagcaagttaagcattttactggaactggaaacactccaatgagctaccctttgcagcctgctattgaagaaattgaaaggtatgcagaggagcactgtgatgcgaggacagggcttggtgttgtttgcaacaaggaagaaggctttggtgaagatgattttgttgtggagtttttaggagaggtctatcctgtgtggaagtggtttgagaaacaagatgggattcgatctctgcagaagaatagtgatgatccagcaccggagttctataacatctaccttgaaaggccaaagggtgatgctgatgggtatgacttagttgtcgtcgatgccatgcataaggctaactatgccagtcggatatgtcattcatgccgaccgaattgtgaagcaaaagttactgctgttgatggtcattatcaaattggtatttatagtgttcgtgaaatccaacatggtgaggagatcacttttgattacaattctgttacagagagcaaggaggaatatgaagcttcagtttgtttgtgtggaagccaagtttgccgtgggagctatctgaatctaactggcgaaggggctttcgaaaagccaatagcattagcaggtggagtggccacttgctggggaggcgtcaatttttttggttttctgacaaggctgcaacttctgatggcggattattcagctgatgggacaaagagaaagagaccggtactgaaggagtggcatggaattcttgatcgtcattatttgatgctagaagcttgtgaattaaactctgtttctgaagaggactataatgacctgggaagagctggtttaggcagttgtttgcttggaggcctgccagattggctagtttcctatgcagctcgccttgtgagatttatcaattttgaacgaactaaacttcctgaggaaattttaaagcataatcttgaagagaaaagaaaatatttttcagatatctgtcttgaagttgaaaggagtgatgcagaggttcaggctgaaggtgtatacaatcagaggcttcaaaatcttgctgtcactcttgataaggtaaggtatgttatgcgatgtatttttggtgatccactgaaagctccacctcctcttgagaagctcagtcctgaagcagttgtttccttcctctggaaaggagaggattcatttgttgaagagcttcttcagtgcctggccccttatgttgaagagtctacattgaatgatcttaagtccaaaattcatgctcatgatccttcaagttctggagatattcaaaaggcagttcaaaaatctcttttgtggttgagggatgaggttcgaaaccttccttgtacatacaaatgccggcatgatgctgctgctgacttaattcatatttatgcttataccaagtacttctttagaatacaggattatcaaactataacatcaccacccgtctatattagtccacttgacttaggtcccaagtatgctgacaaattgggagcaggatttcaggagtatcgaaagatatacggtgaaaattattgtttagggcaactgattttttggcataatcagagtaacgcggagccagattgcaccctggctagaataagcaggggttgcttgtcattaccagacatcagttccttttatgccaaagctcagaagccttcacgacatcgtgtttatggtccaaggactgtcagatctatgctggcaaggatg

SEQ ID NO: 43677 - DNA, 363 bp, Glycine max
  Peptide Sequence Number=SeqID_135362
atggacaaacttactgtgaagataatgtctcattcttgcaagatggttgatatcactgatgaaggtgtctcatatatggaatctgatgatgagtggataacagaagagggagatgatatttttgatgaagacaatgtccaagttgagcaacctctaggtgaaagtgatagtggaagcaatattgacttgaatggaggaagtttaagtgatccaactttagatgatattgatattgacaatttggttttgaatgacaatattgaagatcacttcttaatcaaggaagagcttgaagatgatggagatgatggtgacggtggtgacattggagatgatttaattagaggattgatagacatttga

SEQ ID NO: 43678 - DNA, 675 bp, Glycine max
  Peptide Sequence Number=SeqID_135363
atgggaggttcgggatctgaacctggtggtggcgctgctgaatcagagcaagagcttcctcttcagcacttgcgagcactacggggatctcgcaaagcagtttatgacattcagattcaatttgcgagtataggtgaaaccctaggtcttatggaaaggcatgggcggtttgattcacacgcatatgagccctccacaattcacgtggccgaaccttccgacatcgaagctcttcgatctggagttcccttgcaaaactttgggaaggaggatttcgctttggcgactcaggagtacgggattaatggcgtgttagcgatttttaatatcgggaatcggaccggtcaggccagggcggatttctatgccagcttgaacgggctggttcagcagtttttccaatctttgccaatgtcggtgccgttgccattcaagcacgaagagagttcggtgggggtaaagggtggggataaggggtggcagagaggagaggttgcagttactcaggaggatttgggattgcttagtgagaggttgaagaatcatgggtttgctgagagtgttagtggcaatggtggtggaagcgcggaggaagaaggtgatggaaggtttaacattgggtctattggtcttctgggcaggcttgttattgtttatttgcttattgatcgttag

SEQ ID NO: 43679 - DNA, 372 bp, Glycine max
  Peptide Sequence Number=SeqID_135364
gggtatggttttcgacacttccaaggattcaatctagccatgctagcgaagcaagggtggaaactttccactgacccagatgctatattatccaaggacgcaacccaagctttgtgtgacatagcatccatgctattcaggtggtggttagaagaggttttagtggagagttggagagggctcaagaattacagtttagcgacaacggttcttggaattctaaagattcctcggtgtagcgaactcaaagtccctaataaagttcgggtttttttgtggagcttgctagaggttgtttaccaactcgccaatggcttcaaagaaatggcgtccaatgtcctccttgttgtagttcttgtgaaagggacttag

SEQ ID NO: 43680 - DNA, 402 bp, Glycine max
  Peptide Sequence Number=SeqID_135365
atgaagaagtggagttgggtgcgcagcagaactcttcataagatgagctctgataccatatctaaatggattaatagccatgagagagaaatgtcgaaagagaaagagggtggggaggccgtcaccgcgcagaggggagggggagggaggaacgagaaggaagaagaaggtggaggggagggggagtggcagagaagaaatagaaaaaaagaagaaggaagaagaaagggaggagaagaaaaagaaaaagaaggaaggaaaaggtgggtgagggagaaagacatcctgaaaggaagcactagtgacacggtccaaaaattagatgacaaaagcacgaacgacgaggaagtaggaaggagtaagaataaccctagctgtgctggagatccttgcattttctaa

SEQ ID NO: 43681 - DNA, 987 bp, Glycine max
  Peptide Sequence Number=SeqID_135366
atgttccagcgaagaaaaaaggaacacggtcatagtaccttgccactttccaccacctcagacttagacaacacagcaacagcaatgcctcctcttcccaccatcagaaccaaaacaccttccttcaaatccttcctcttaaccctatctatcctcctcaacctcttcctcctgtgggccccacccaactcctcatcaccatcactgccctcatccacgtccgccctcatctcccgcctctcccccaccacgcgccgccacctcctcttctccgtcgcctcctcctccacctcctggccccgccgcctcccctacatcaacctctggtactcccccgccaccacccgcgccctcgcattcctcgacaaaacaccacccaacgccacctcagccgacgattcctcgccgccgttggtgatctccggcgacacctcctctttcccctacacgttccgcggcgggctgcggtccgccatccgcgtggcgcgtgccgtgaaggaggccgtggatcgcaacgagacggacgtgcggtggttcgtgttcggcgacgacgacactgtgttcttcgtcgacaacgtggtgagggcgctcgcgaggtacgatcatagcaagtggttctacgtcgggagcaactccgagagctacgagcagaacgtgaagtactcgttcgagatggcgtttggaggtggtggcttcgcgatcagctactcgcttgctagggttttggcgagggttttggactcgtgtttgaggaggtatggccatttgtatggaagcgattcgaggatttattcttgcattgctgagcttggtgttgcgttaactcacgaacctggatttcatcaggaaatggggagtgagaaccaactgggtttattcccacatttagtcccccacaacatgccaaatcaagtgttaaaatgtgctgaagagttcatagatgtcccattgactattttattccttacttcttttgtggatatttga

SEQ ID NO: 43682 - DNA, 831 bp, Glycine max
  Peptide Sequence Number=SeqID_135367
atgcagatgaagtcctctagcggtgaaggcccacaacatctgcactatgtggatcatgtagatgatgaggtccatgatcatcctgaagaagcagctactgatgatgcagttactgatgccgagggtttttcaggcgaaccccacgacacatcagttttgatggactatgtttatcatgtggcagcgaaacaacgtcttgagttgaagttatcctcccatggaaggaaagttgagaaatttggcaggcctgctccagagattaaaggcttagtggctgccacacgattaagtcctctgattgcatgttcgttggacactagtgatcagggacttatatcggcattcatggagagggtcttccacagcttccaggctcttcatgtggatgaagtcatcttgctgttagttgaattgcttgaaagtggaagctatgcatggagagctaccgcactggttcatatgtatgagaatttgaatgatgcatcaaagaagactgccagacaactttgttggatctacgagcactttcttctattgcttcttgtattgctgttgaagattatcacgaaaggaaatcacgtgcttgtcgttggaaacatatcagatggagtccatctattgtcatacaccgactggagagggttgtatgacaatttgggtatgtgcaaaccattttcgcctcaccttgttgctccttctctatgtatagaagacattgatgatagatggattcagttttctaaatacattgcaccgaccaagcgatctgggacacagggactaagaccacacaagttttacagaccaagcgatgtgggacacaagaactaa

SEQ ID NO: 43683 - DNA, 1336 bp, Glycine max
  Peptide Sequence Number=SeqID_135368
atggttgaacggaagcagttcaagacgaagctatgcgttctgtatcagagaggtcgctgcaatcgccataactgctccttcgcgcatgggagtgctgatcttcgacgattctctgcctcgtatagtgtctatatatcttgtgaattgaggtatgctgattgttacttggttggtgttttgagtaacggtgccctagaatatgtctgggaacatggttttggaggaaaagaaaaagcttctttgcgtttgaaggtgttgagtgccatggccgctatggtggaatggcatggcggatttttcgacaactgccataggcaatttgtgaagggaggcccattgtggcagtgccataggctgcaatggcgtgtttacatggcagaattttggcggagacataggagaaaacaggatactaatggccaaagtgatatttctggaaatttgaaagtctcagatagagttcaaggtcaagttaaagaaggaaaattgctttcctctggttctaggaataatcttgaggagcagctgaagaaagtagattcagatatcagcactcttcagaaccgaaaattccagctagaggtctatcttgatgagagtgttcaagaagtggatagccttaattctagaattcgggaacttgaagctcaactatgcaaagaggatgaggagtgcaaaagatcacaagtccgacttcaaaggtttggagatcagcttgtctcagacatttctagaattggtgccaacgaagaagatttaagcattgatattataagcaatggtgaaaatactggtcttcatccaatcgctaaacataatgtggagcacaatgatgcatcttcccacaaaaaaaggctgcatattgaacatgatgctttggaagagttaaaacagggtagtagttatggaaaatatagtgatgttgatagatcaaaagatgggcatttggttgagacagctagaactaggaagcgttctcgctggaatttatcagatcaattgaaagaggagtctcttggtactccagacaatggaactgaagttactagatctctagatcttgaaggcaagcacaagaaaggattgaagcaacccagaattgaagcgccatcaaccagcatggcagctcatgtggttgacgaggatgttgatattgaacgttatgatggaaatgatatcaatgaaactgcaaatacggaaaatgataatggagcggcatataaggtaaagggtgcaccattaatgcttcccccagctttgctacctcgtagcaattacctgcaggcaacgacgagaatgttgatgtggatggttgatgaagaggcaacaggggcac

SEQ ID NO: 43684 - DNA, 288 bp, Glycine max
  Peptide Sequence Number=SeqID_135369
atgtgggctttgatgtttttcttttgggcttttcctctttctgcacctcccctgtttgttcatgtgttgtttgttttgcttgacgcacctctgatattgcttccgtatcaccctgcggcccttgggaaatcaccttgttctcaaggtggtagtcatggcaaagctgggaccaatcctcccaagatgtctcgtctggggaaaggccctgccactgcaccaaaacctcccatgactgatgaggggatgaggacgaacatcgataatctaaaatggcgccgggaaaaatga

SEQ ID NO: 43685 - DNA, 327 bp, Glycine max
  Peptide Sequence Number=SeqID_135370
atgtgtgccgataaatcatataccttgaataagtctgttgtatgtagaagagaaaaagcatggaaattaggggcgcgagtgaaaatgttagcttgtaggacagtttgtagactaaagaagagaaggtgtaaaaagttgttgatgaactcgcctagcgaggcagattggctaagtgagcctcatccgcttagcgaggcagccagctcgcttagcggatgcaaaaccctagaagaggataagtcagagatcaacgtgctttgcgcgcagccagcccacccagtgaggacgttgtctcttctcacgcttagcacgcccaagctcgcttag

SEQ ID NO: 43686 - DNA, 228 bp, Glycine max
  Peptide Sequence Number=SeqID_135371
atgccaacgtcatcacgtcgcctcggagactcctcaccagaatcttactccccgtaccctgctgctgtcattctgctcccacgaacaatgttcgtgatcatcacagtgccaaagaccatggatcaattaaagcgcctaagcatcccctcagaaatacttagattctttaaccacgcttgtcacccacatttggcccatccgacaaggtcagtgcacttacccccatga

SEQ ID NO: 43687 - DNA, 741 bp, Glycine max
  Peptide Sequence Number=SeqID_135372
atggcaaccactagtgctcttgtagtgctgcctccttcctcttcagctccaatagttctcccctttactattttggtggcggtgtcgccttctttgctttctcacccttgcgtctccttggatcatttgtacatctctagtgatgctgattcattgtggagtgcaacttacaagccagagcagaagaccccgattgactttgtgtcagcctttgataagaaccttattaagtcagctggggtgcaaaatgctatggattctgccaaacgacaccaagagtctccacacaaggtggcatccttggaggcagaggtcgccaaatggagggctactgcttgcactgtttggaaagtggagcaccctaaggtggccaatgccaccattacttttgttgaggccgtaaggtcgaatcgccaactgtcttccaaagatttgaaagtgaagaagaaggacctgggtagaaaggtggaaagcattgcgactgagagggtcgagcttgcgaaggtggttgctgagttagaggcccgacttaaggagtcggagtctaggctgaaggagtctgagctgcgggttaccaaggaggggaaaaccaacaagaagcttgaggaggagctggttgtttacaagaaggagggtgtgaaggatggtgtcttgcttaacgaggaggagattgctgcggaggaagaggctattgatgaggagcagggtgctgcggagcaaggcaatgatgcttgtgtctag

SEQ ID NO: 43688 - DNA, 393 bp, Glycine max
  Peptide Sequence Number=SeqID_135373
atgaacaagcttggtgtggttgttctgctacttgctcagatcttagtacttcatgtcaaggctcatgagtctgatcaggcacaggcaccactcacagtgttgaacccttttgagcataaaactcaaacaggagttcaacttaacgatgatcagaatagtgatcataaagttgcagtttctggagctattgaagagtcatcatcatcagaagaagagaaaaatggagaagctaaagctgctgaggcaccacaaattcgaagaatagggaaacatcattcttcggacaaatcagtggcaggtggaggtgtcatcattggagggcttgttactgccatctttgctgctgttttttgctacattcgggtcactagaagaagggacactcgttactaa

SEQ ID NO: 43689 - DNA, 945 bp, Glycine max
  Peptide Sequence Number=SeqID_135374
atgatgttgcccgaacagcaaagtaggccactggggccgttgcttcctgcacccccacctcctcttcccccctcctcaccgccccgcacccacgcacctcctttggcttcttgcatttcccttttcttctgcttgttcattgtgtttggtggtgtccggatcaagctattcataatagaacaaggcaattcggaaatattatgcaacccaaaatacattttcaaattgtcttgtccaattagggatagcttgattcggagtaatatcaatcaatccggaatagattttcagattgacttacattactttagatcattttttctgtgtgaaagacgtgcagttgtagaagaggggcaagagatttacaaagctcccgaacattttgcggttgatgatgttaagatgttgtgtttggtggtggacctgaggacaaatcagtccttactgaatatgctgatcatgtggcttgaccgtggagagttaaagctagtagctcatgaaaggaagttgagggatttgccccccttcccccataaggagatcatgagattggtggaggatttagggttacttccattgacagaatgtagttatgaaacccctgataagggacttttttctgcttttgttgagaggtggcatcatgagaccaacacctttcattttcccataggagagatgacaatcatatttgatgacgtgtcatcattgctgcatattcttattattggtgatttttatagttactcgcacacgtctaaagaggtggttattgcattgttgatggagcttttgggagtgaacaaggaggatgcatttttggaaactaaacaatgtatagggggtcatctgggtgatgcaggttttataaatacaaagcaactcaatggttatgcaactctaatgcaggcatggatctacgagcattttcctactattgggtag

SEQ ID NO: 43690 - DNA, 276 bp, Glycine max
  Peptide Sequence Number=SeqID_135375
atggcattgtatgcctatggacgtgaacctaagatccctggcccaaattggtgtggcccaacagtaggaacaacaacatttttcagtgcccaggaggaagcaggatatgggcatggaggcggaggatgcagaggtgttgttgtccgtgccgtggtggctgtcggtgctcgtaaggagagcggcttgagagtggttgccggagttgccttcctttgccaagaggtttttaatggtccgctctgcaagtttgagtcaagatcggcaactcgcaaatga

SEQ ID NO: 43691 - DNA, 204 bp, Glycine max
  Peptide Sequence Number=SeqID_135376
atgattaaagatgattttaaaagtttaaaccctaaaatctttttaaaaaagaaaaagaaaacacaaaaaataggcagaggtcaccgagggcagaaggaagtcgtaagtggccatgtgatagcagttgatcagcctgcgaaaggaccctaccttccctatgctgcacgccacctcgccactgcgttgcactgcatatgcatatga

SEQ ID NO: 43692 - DNA, 243 bp, Glycine max
  Peptide Sequence Number=SeqID_135377
atgcatggtgcaagcaaaccgccagtcctgctggtgattggactcgccactaacagtggcgatatgcacatgcaagcctcaactcgccattcgaagtggcgacatgccacagcaaggggaaccgccagtttgactggcgataagtattttatactggacagtgcttgttcctgttactattacatggtttcttctcctccgagctattacgtggtttttctatttggtttagttagaatgtga

SEQ ID NO: 43693 - DNA, 382 bp, Glycine max
  Peptide Sequence Number=SeqID_135378
atgtcagttctagaattgtacacagaaaaggatgtggctggtggttcaatgtttcattctgcaaattcgcttacattatgtggaaattatttatctaatgatgagacacaaccgccaacaaatatgagcaatttacatcttcacgaagatgatgatgattattattattttgtgtctaacttatacgttgaagagtctttagacgaagatgacagtgttgatggtatatctgatacagacaatgaagtcaccgagatgattccaccagtaagaattgttcacccagcagaaggtgtacaaggaattcagaatccattttggaatgatgctttgcattataataatatcaactggagtcatcctgatgaggaggacatttgcg

SEQ ID NO: 43694 - DNA, 2856 bp, Glycine max
  Peptide Sequence Number=SeqID_135379
atggttatggggagaacactgttcatcttggttttgtgcttgtggattcccttggaagtggtgggaaggaaagaacctttttattcacctaccactgtgaattccactgtgtcttctagaccgaaggttgtgaagtttggtgccctctttaatatggattctgtcattggaagatcagcgttacctgcaattatggctgctgttaaggatgttaattctagcaccagcattctccctggcattgatctgcaagttattttacatgataccaattgcagtgcttttcttggaacaatggaaggtacttttggtgctgttttccaatcaaaattagagtttcacctcggtcatctacatatcgaagctctgcagttgatggagaatgatgtggttgctgttgttggtccagtgtcatctggaatagctcatgtcatatctcatgttgttaatgaactccatgtgcctcttctatcgtttggggcaactgaccccactctatctgctctacaatacccatattttgtccgcactactcagaacgactattttcagatgtatgcaattgcagactttgttgattactacagatggaagaaggtgattgccatctatgtagatgatgacaatgggaggaatggagtttctgtattgggcgatgcaatgtcaaagaaacgtgccaagatctcttacaaggctgctttccctcctgaagccaaagaaagtgacatcagtgacttgttaaatgaagtgaacttaatggaatcgcgggtctatgttctacacgtgaatcctgatcatggtttagcaattttctccattgccaagaggctaagaatgatggacagtggttatgtttggattgcaacagattggcttccttcagtgctggattccttagattcacctgatactgacacaatggatctcttgcaaggtgttgtggcgtttcgtcatcacattcctgatactgatctcaagaagagttttctctccaggttgaaaagccaaagagacaatgagactgtgagcttcaattcttatgcactttatgcatatgattctgtttggttagcagctcgcgccctcgatgcttatctcaatgaaggtggaaatgtatctttctccagtgaccctaagttgcgtgacacaaatggaagcatgctgcagttagcatcgcttcgtacctttgatggtggtccacagtttctcaagacaattttgggaatgaacttcactggtttgagtgggcaagttgagtttgacatggacaagaatttagttcatccagcctatgatattttaaatatcggtggtagtggatcccgtagaattggttattggtctaatcactccggtctatcagttatagctcctgaagttttatatgagaaaaaatcatctaagacttctttaaagagcaatcaagagctgtacagtgtgatatggccaggagaggccacaactacaccaaggggatgggtgtttcccaacaatggacagccactcaggatagcagtgccgaaccgagtgagctacacggattttgtttctaaaagcaagaaccctccaggggtacaaggctattgcattgatgtctttgaagcagccttaaaattgttgaattatcctgtcccgagacaatatatattatttggaaatggtgaaaggaatcctagctacaacgagcttgtggagcaagttgcacagaataactttgatgcagttgttggagatgttacaattgttacaaataggacaaggattgtggattttactcaacctttcatgccatcagggcttgttgttgttgttcctgtggagaagaagtcaagcccttggtctttccttgagccgttcactgctcaaatgtggttggtcactggtgctttctttcttttcgttgggactgttgtgtggattcttgagcaccggcacaatcctgagtttcgtggttctccgaggaaacaacttataacagtgttttggtttagtttctcaacaatgtttttctcacacagggagaacactgtgagtggacttgggcgattggtgctaataatatggctctttgtggtgttgatcataaattcaagctacacagctagcttgacatctatcctcactgtgcagcaactgtcatcacaaattgaaggaattgacagcttgatctcaagtactcaaccaattggaattcaagacgggtcatttgcacgcaagtatctgatagatgaccttaatatagctgaatctaggatagttacattgaaaaacatggaggattatattgatgcccttcagcgtggtcctaaagctggaggggttgtggcagttgttgatgagcttccttatattgaggtcttgatgtccaggactgactgtaagttcacaactgttgggcaggagttcactaaaagtggatggggatttgcattccaaagggactctccccttgctgttgatttgtcaactgccatccttcaactctctgagagtggggacctgcaaaggattcatgacaaatggcttaataaaaaggagtgtgcaaccgttgatgctaattcaaacaaactagctctgacaagcttctggggcctctttcttatatgtggcattgcttgtgtcattgccctgattattttttttgctagaatcttctgtcaatacaacaaattcagccccgagcctgagaagaccgacaaggaaatgcaaccagtcaggtctagacgtcctagcagaactcgtagcctcaagaagttgatgggtttcaagatcaccatgctcaatgtagcatacggtgttaatgcgcacgaattgttaagtgacatttattcaagttttaatgtgagctcgtgttag

SEQ ID NO: 43695 - DNA, 162 bp, Glycine max
  Peptide Sequence Number=SeqID_135380
atggtgggtttgatgcgacatggaggtctggtgcaatgtggaggtggcgttgggtggatgcagtggtggtgtttgggtgtggcaatggagttggatggttgtgtggaggtggggtgcggtggtcttggaggtttgtgcgagatgcgaccagggttttcttga

SEQ ID NO: 43696 - DNA, 318 bp, Glycine max
  Peptide Sequence Number=SeqID_135381
atgatgaatgaagagttctctcagtaccgaacaagcctagcaaacattttcaggtgctctcaaaatcaatcccaagggattgagttggatgtacataaggagaaggctagcgtggcagtcatgaaaggcagccattggagctcaatgaaagcaccaattgttttgggcacaaaatcaaagaagagaaataggctagctttaagggctaggaccttcagaaagaaaggttacaacataaagttgcgagatctaaagcctgattggtatagttatggactaagctacattgggaagcaaattaagagctttagttcttga

SEQ ID NO: 43697 - DNA, 258 bp, Glycine max
  Peptide Sequence Number=SeqID_135382
atggattttcccttggatcaatcagttggattgcaagtatttgatggaacttcagggattggattcatttgcgaccttaatgacaacattgtagctccatggcccacaacatcatattcgctaccatcctcatgcaatagaactacaaaacttccatctcttcctacagcaacgtcttcacaaaatggtcttttcattaataccttggttttgcctctcctctttacctctatactacttcccaagaggcttctttaa

SEQ ID NO: 43698 - DNA, 2682 bp, Glycine max
  Peptide Sequence Number=SeqID_135383
atgatgcgcggaaacttgaccagtctcccaaagcctggtggcggcgagtttggaaagttctacagtcttccttctctcaatgatccgagaattgacaggttgccatactccatcaggattctccttgaatctgccattcgtaattgtgacaattttcaagtaaaaaaagaagatgttgagaagatccttgactgggaaaacaattctacaaagcaagttgagattccattcaagcccgcccgtgttctcttgcaggattttactggagttcctgctgttgttgacctggcttgcatgcgtgatgctatgaataagcttggaagtgattcaaataagatcaaccctctggttcctgtggatcttgtcattgatcattcagttcaagttgacgttacaaggtcagataatgcagtgcaggccaatatggagcttgaatttcagagaaacaaggagaggtttgcttttcttaaatgggggtcaactgcattccgtaacatgcttgttgttcctcccggttctggtatagtacatcaggtcaatcttgaatatcttggaagggttgtattcaacaatgagggcctactctatcctgacagtgtggttgggactgattcacataccactatgatagatgggcttggtgttgctggatggggagttggaggtattgaagctgaggcagcaatgcttggtcagcctttgagcatggttttgcccggtgttgttgggttcaagttatctggaaaactacgcaatggtgttacagcaacagacttagttctaactgtgactcaaattctcagaaagcatggtgttgtggggaaatttgttgaattttatggtgatggtatgggtgaattatctttggctgacagggccactattgccaatatgtctcctgaatatggtgccaccatgggcttcttccctgtggatcatgttacactacaatatctcaagttaacaggaagaagtgatgagattgtggccatgatagagtcttatctcagggaaaacaaactgtttgttgactataatgagccgcaacaagacagagtgtattcatcgtatcttgaattaaacctttccgatgttgaaccgtgtatttcaggaccaaagagaccccatgatcgggtacctttgaaagaaatgaaggccgattggcatgcttgtcttgataacaaagttgggtttaagggatttgctataccaaaagaggcacaaggaaaagttgcaaaatttgatttccatgggcagccagcggaactcaagcatggcagtgttgtgattgctgcaattacaagctgtacaaatacatcaaacccaagtgttatgcttggtgctggtcttgttgcaaaaaaggctcatgagcttggtttacaggtcaatccttgggttaaaacaagtcttgctccaggctctggagttgttacaaaatatctactccagagtggactgcaaaaatatctaaatgaacaaggttttcatattgttggatttggctgtactacatgtattggcaattctggagagctggaagagtccgttgcttctgccatctcagaaaatgacattgtagcagctgctgtgttgtctgggaatcgtaattttgagggccgagtacatgcattgacaagagctaactaccttgcctctcctcctctagttgttgcttatgctcttgctggcacggttgacattgactttgagaaggagccaattgggacagggaaggatggaaagaatgtctacttgagggatatttggccatctactgaagaaattgctaaggttgtccaatccagtgtgttgcctgagatgtttcgaagtacatatgaggctattaccaaagggaacccaatgtggaatcaactacaagttcctgctgacactctatactcatgggaccctgactcaacatatatccatgaacccccttacttcaagagcatgaccatggatcctcctggacctcatggtgtaaaagatgcttattgcctactgaattttggtgacagtataaccactgatcatatttctccagctggaagcattcacaaggacagtcctgctgccaaataccttgttgagcatggggtggaacgcaaggacttcaattcttatggaagtcgtcgaggcaatgatgaggtgatggcaagggggacttttgccaacattcgtcttgttaacaagcttttgaatggggaagttggcccgaagacaattcacattccaacaggggaaaaactttatgtgtttgatgcagctacgagatacaaggcttctgggcaagacaccattgtgctagctggagctgaatatggcagtggaagttctagagattgggctgccaagggtccaatgctactgggagtcaaagctgtgatagccaagagtttcgagagaattcatcgcagtaacttggtaggaatgggtatcattcctctttgcttcaaacccggtgaggatgcggacacattgggattaactggtcatgaacgttatacaattgaactaccaagtattatcaatgagattaggcctggccaagatgtgacagtcacaaccgataatggaaaatctttcacttgcacagcacgctttgacactgaggtcgaacttgcttacttcaaccacggaggcatacttccatatgtcataaggaacctcattaagcagtga

SEQ ID NO: 43699 - DNA, 267 bp, Glycine max
  Peptide Sequence Number=SeqID_135384
atgtcttgtctagaatgtagtctatggcgctctgagttttctccagcttggtggttttgcaaagtcaccgcaaagaagcgtccaacaggcaaggatatagttacctattggagttcatggcttgggatctctggagttcgtcctatgcccaagttccaggctgattctctcaagtacacaatacctaataataataataataataacaacaacaacaacaacaacaacaaaatacacattactaattatcatattgtgaatgtatga

SEQ ID NO: 43700 - DNA, 108 bp, Glycine max
  Peptide Sequence Number=SeqID_135385
atggacactcgtctccgtgtgattggtgatcccatgaatggagttcaacgggttagtttccaacggtcatatttccaacggtgcatatttgtttgttgcttaaggtga

SEQ ID NO: 43701 - DNA, 150 bp, Glycine max
  Peptide Sequence Number=SeqID_135386
atgggtgttttcagtgacggagacttgcgtgaagctaataatggtgatcttacggatagccgcgttgcgaacaatgtcgctgtcaaccaccatggtaacgcctttaacgatgatgtggagggtgaagagtatgaccatgaggatccatga

SEQ ID NO: 43702 - DNA, 594 bp, Glycine max
  Peptide Sequence Number=SeqID_135387
atgagcggtcaccgcctccaccgtgccctcagcaaactgaaactcatcgaagaagaaaatgaccaacgctcacaagatgcgcgtggcattcaccgtcgtcacattcaccgccgcagccgccgtcatctccgtcttcttcgccgcgcgaaggcgcaagcagtaaaagtccttgccgtgctatttacactccgaacagaaaccaaagtgcgcgttcaagcgcgtcttagcggacaactcctactctccgttcaatcatctcagcaacgacggtacattccacactcgtttctgggtttggttactgagaaaccgaaggaaaatatgaaagttcacgctgagtttaggggttttcttacagagaatgctttgaattcgcatccatatgaggcagagattacggcattgttgaaaaatcctctgcctaaaattgagcttggaactgagatcgcagacttggaaatgaaggattcctatgtttgggttcataccgagttaaatgaactaattgatgttttgagcgaagagaggttctttgctgtggacacggaacaacatagcttacgatcttttttaggctttacaacattggttcag

SEQ ID NO: 43703 - DNA, 198 bp, Glycine max
  Peptide Sequence Number=SeqID_135388
atgaagtccgatgcaacgtgcctagaggaagcagaagttcttaatactcgtggggtagatgttttggttcccagggttcattatagagatgtgagaagacaaaagataccgaatctaggtggagaagaaaagttggtggcaagcaacacaagagattttgtgaccaagatcaatatctatacatcctacctaacatag

SEQ ID NO: 43704 - DNA, 237 bp, Glycine max
  Peptide Sequence Number=SeqID_135389
atgacacaatacaaggttaagcacctaagattgtggatatttgagtgtagagagccaagtcatcaaggcttcatgttggggttgggtgctgcagtgcttttgggactagcccatgccatagccaacttgcttggtggctgcaattgcatttgttctcaacaagagtttgagaaggcttccaactgcttgcctaattttaacttggtagtgcatacctttctctgtttcgtccgttga

SEQ ID NO: 43705 - DNA, 270 bp, Glycine max
  Peptide Sequence Number=SeqID_135390
atgtggaccaccacgggggagaagcttgcctcccagctcgcccaggcgagcaagctttcgaagaagttacggaaacttaaagattgcgcaaaaacaccttttttcgacttccgccacattacggaatttcacggatcgcgcaagcctgcttcctttagatttctgagacgtctcgggacttcatttattgtgcaacaaaggacgccaagtatcccaaagcggctaaccaaaggttgcatgtcatcaagtaataatcccggacgaaattag

SEQ ID NO: 43706 - DNA, 564 bp, Glycine max
  Peptide Sequence Number=SeqID_135391
atggtctctggtaatcgattaccaagggagtgtaatcgattaccaggcttgaaaacgaggcttagaaatgggactggaggattatggaggcctctgaggaataggccactggtaatcgattaccagatcgcgatggtggcgcaactaatccatgatcgagtggagatggagtgcctagagggagcttgggagaccctcgaaggcaatacgaggtgccgatttcggggcacgattcgattcacggctacttcattggtgcatccagatgaacccgcgcatacgcttcagcgcactgtggagtggatattacccacgcctacaccatatcgtctagtggagctagtccaagtgatcgaggtgacgtcatccgaggaagaccctgaggaggatcctgaggagctacctcctgagcctgctgtggatgctcttgactttctagagggtgatgaggatccacttcctgaggtggattctcccgaggacgtcatgtcggcatctgaggcagactctacggaggatagtggccctggagagatggcaatcagtggaggctcttcatcatag

SEQ ID NO: 43707 - DNA, 192 bp, Glycine max
  Peptide Sequence Number=SeqID_135392
atgcgtctaccggggaaggatctgctgatgaaatctcccataaccctaggtcaagttttggatgttagcgatttcaggtttctaaatgactttagacatggaaacactggtggttcgacaaaaatagagaaatccactcaaagtgtatcaatctcgcacagggcttcccttgggaatgggttctgtgattag

SEQ ID NO: 43708 - DNA, 623 bp, Glycine max
  Peptide Sequence Number=SeqID_135393
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcttgttcttgaattacctattcaatttaattccatcggtgaatagacatgatgattcttacgctgtgtacgcccatgtgcttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 43709 - DNA, 815 bp, Glycine max
  Peptide Sequence Number=SeqID_135394
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctaaagaaaccaaacatcactagccaaaactataaactggtgctatttgcagaagaatgcatgagaccaaatggcacagagcgtgttcgctccatgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43710 - DNA, 279 bp, Glycine max
  Peptide Sequence Number=SeqID_135395
atgaccggccctctccatgagtcgatctcttgctttctcataagggtggacccttgggtactagtacctgtcgcctctagaggactacctgtcctcgcctttagaggactacacgtcttcgcctttagaggactacacgtcctcaccatcagagggttgcacgccctcacctttagaggactagacttcctcgccttcagaggacttcatgtcctcagcttcggaggacaacacgtcctcaccctcgccttcgtagggctacacgccctcaccttctga

SEQ ID NO: 43711 - DNA, 370 bp, Glycine max
  Peptide Sequence Number=SeqID_135396
atgacggaagggtgtggtgaagggttttgccttgcaaaccttcccggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgcacaagggggaggaggggggtttgttggtgatttggaggggagggacgaatcaaagcgacaagggctgaatctcagtggatcgtggcagcaaggccactctgccacttacaataccccgtcgc

SEQ ID NO: 43712 - DNA, 587 bp, Glycine max
  Peptide Sequence Number=SeqID_135397
tgggaagtgcccctcctgctatggctgaaaatggaaagttggatcagatagaggaaagactaaaggtcattgaaggaagtggagattatgcctttgctaacctagaagagttgttcctagtgcccaatgtcgtcacccctcccaagttcaaggtgccggactttgacaagtacaaggagactacttgccctaaaaaccatctaaaagatgtattgtcggaagatggggatctggcaacccaggtggcacccccaatcacgaaaaggaagatgataaccgtgatagtatacacattaccagtgttctactatgaaaagatgatgggctacacactttcaagctttgccgatttagttttcatcgacgaatggatcgaaatgggtctgaaaagaggaaaatttaatcatcctgcttggacaaatgagaaaactggggcaaatgaagaggatgagaaaaaaggagaaacccatgctgcaactgtcgttcctacatggaaaatcccccaccagctcaacaacatcattactcagccaatatcaacccttctcattacccaccacccagtcatccacaaaggccatccctaa

SEQ ID NO: 43713 - DNA, 510 bp, Glycine max
  Peptide Sequence Number=SeqID_135398
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattcttgggggaaatgattgtaaatttggatgcatctcccgtcatatgcttggaacatccactatcgatgtaccacttctgatggaagcttgcttgtgtggcttctatggaggctggatctttgagcttcaatga

SEQ ID NO: 43714 - DNA, 249 bp, Glycine max
  Peptide Sequence Number=SeqID_135399
atgtgttggtcttcctactgggcgactcatgctactaaagatgttctctacctaacaacgtttctgtgttctatgttgtctcctggattgctaagccccgatgtctcgtgcatgtttagcctaatcctaatcaagcatcgtcctcagatccctcttgttggactaaacttgaccagaactgcattaagacatacataccaacaactaggttattgtaccccgatccctcgtgaaaatacgataaactag

SEQ ID NO: 43715 - DNA, 153 bp, Glycine max
  Peptide Sequence Number=SeqID_135400
atgggtgtaatcgattaccatgcttataaagggaactgggagatggtagaggtctctggtaatcgattactaggctgtgcaatcgattacacagagggatgggtcactgataatcgattaccagatcgtgatggcggcgcagctaatccgtga

SEQ ID NO: 43716 - DNA, 408 bp, Glycine max
  Peptide Sequence Number=SeqID_135401
atgggtaaagcggaggaggtacaagagtatatagaggccaacatggaggccatgaaagagcaaatggtcgcaatgatggaggccatgaggagcatgaagaagataatggaagccaatgcggttgcaattgccgctaccagcgttgttgctaaggtgaacccgatgtccccatccgacatcaaccaaatgaatcatccaacctcagatatggtaggcaaagatttgggaagtacgggcggcccccatgatgtgcaaattcaaaacgagcacgccttcccgccatatggcttgcctctcaactatacgccacccaatgtggcgtacactcccaataaaaatgccaataactccactcctatacccattgagagccaacaaccccaaactgatcatgcccatgtctcttaa

SEQ ID NO: 43717 - DNA, 369 bp, Glycine max
  Peptide Sequence Number=SeqID_135402
atgagatctgatcagtctgaagatatctgtcactccatgaatagacattcaaggcttgagtttccaagtgccaatttcctcttcttttgtccagtcttcttctggctattcaagtcctcatgggtttcctttaagtgtccagcatcttggattcgttcccagcctttgatagacagcttccaggttctgctatccagtgattctgttaaagatataaggccaccatccttatgcttgtccagtattcatagttcgggttccatccagaattggtcctggacatctgttcacgtggtcctccttctttctccatgttcatcagaatttatctccctagatctcactcgtgcatttgtgcgcccaatctga

SEQ ID NO: 43718 - DNA, 348 bp, Glycine max
  Peptide Sequence Number=SeqID_135403
atgacaaccctagctcagacatggagtgttctttccttctctaacttgattcctacctcccacacttctaacgttactcttgatagggccaaactcatctatggcattattatgaagatggatatgaatgtgggaggatctaggaaggccaggggcaagagatctgaggccccttccacagcatcatcagaggcaccagcaccttcttcttctacacttcctccttcttcctccacagagatcccagtgattcctcctacacctacacataaaccactaccagcttctttttctacaggtccaacagattttattttcactcctaagatgcttcactccatgctctag

SEQ ID NO: 43719 - DNA, 156 bp, Glycine max
  Peptide Sequence Number=SeqID_135404
atggggacaaatcaaaacggaaaaagattttatcaagtcaagattaagagtctagatgtcaccagccttgaggagttgggacggttgatgggacccctccaaaggcaagccttccggcaagtgtacggaaagattttggatctgatcgcagcagag

SEQ ID NO: 43720 - DNA, 553 bp, Glycine max
  Peptide Sequence Number=SeqID_135405
atgttgctaagtagcaatgtcatctatatctgtgcaagagtggtcatgttggtgcgcatgatccgcactcgtctctttccagcggcacgggtgaaatcttgccccggtatgcatagtagctgtgtgatagcctccctctctggttgtattcgcacagttggcccccctccaatatcagggggtgcggatgtgagcacattgaaaatgaggacacgtagccctctaaaggtaagggcgtgcagccctctcaaggcaaggatgtgtagtcctctggaggtaagggcgtgcagccctctgttggcgaggacgtgtagtcctctcaaggtgagggcgtgcagccctctgttggtgaggacgtgtagtcctctcaaggtgagggcgtgcagccctctgttggcgaggacgtgtagtcctctaaaggtgagggcgtgtagttctctgatggcgagagcgtgtagccctcagaaggtgagggcgtgcacccctctgacggtgagggtgagggcgtgcagccctctgatggtgaggacgtgtagtcctctcaacggtgagg

SEQ ID NO: 43721 - DNA, 494 bp, Glycine max
  Peptide Sequence Number=SeqID_135406
atggacccttgggtactagtacctgtcacctttagaggactatatgtcctcgcctgcagagggctgcacgccctcgcctttagagggctacgcgtcctcattttcattcctaggccaccccctgatattggagggcgaccaactgtgcgagcacatccagagaagaaggctatcacgcatcaactatgcataccggggcaagatttcacctgtgccgctgcaaaaagacgagtgtggatcatgcgcaccaacatgaccacttttacatggatatggatgacgttgctatttagtaacattctgcccggcgaccacaatgccaatctccccctgcagatgtatcggttggaatcgcacccacaaagacacccagtggactcggagaagtccaatagggccctgggggtttccagctctgggatcgcgcctgcaaaacacccagtggacccgaagaagtccaacagggtcttggaattgtcaagctctgattacgg

SEQ ID NO: 43722 - DNA, 339 bp, Glycine max
  Peptide Sequence Number=SeqID_135407
atgcttgttctttcctcctccctaaatccaactctcaaaaggagtagttccatctgtttgtctatattcttcaacactcatactcccttgtctaagcctttggagcttgtccataagctccctttcatagtgggagggaatgtgcctcttcctaagggcactcttaagatcattccaatactctactggaggatccctatgaatctttccttccctaacaagggaagtccaccaatagagggcatacccttgaaagctaagggtagccaatggagctcttctctcttgactaatatgatggcaagcaaagagttgttcaaccttcatttcccaatctag

SEQ ID NO: 43723 - DNA, 486 bp, Glycine max
  Peptide Sequence Number=SeqID_135408
atgggtcagctccaacgacaagctttccgtaaagcttacggtaagatctgggacctagccatggcagaggtctccaccgaggccattgcctccctcgtccaatattatgaccaactgttgaggtgctttacctttggggactcccagttatcacccacggtggaagagtttgaagaaatcctgggatgccctctgggagaaaggaaaccatacctcttctcaggattctatccctctttagctagaatttttaagatagtccaaatcttgacgcaggaattagaccaccgaaagcaagtcgaaaatggggtggttggagtaccgaggaaatgtttggaagcaaaagcaagagtcttggcaggtaaaggtgaatgggcccttttcatagacatcctcgcacttttgatcttcggaggagtcctctttccaaatatggatgggttagtggaccaggcagcgattgacgctttttctcgcctttcatga

SEQ ID NO: 43724 - DNA, 219 bp, Glycine max
  Peptide Sequence Number=SeqID_135409
atggtgagctttgctagggtttccgaaataagagtttcagaggcaacaagtcaagaggaggatcttctccatagaagtacaaagaagattaaggaaggtgcaaaggtttatatgaagggatcctctatgtcctttgcagataaaattcttcaacctgtgggacgggctggcatgtctatggagacggctatgaatttgcataaggatgtgatgaattaa

SEQ ID NO: 43725 - DNA, 315 bp, Glycine max
  Peptide Sequence Number=SeqID_135410
atgacggcgactgggtttggctccatcttaggaaggatagattccctactaaaaggaaatccaagcttagccctagaggggatggaccttttcaggttttggagaggatcaataacaatgcctataggtggagctgatattgaggaggaactaacagatttgaggtctaatcctcttcaaggggaaggggatgatgcaatcctccctaggaagggaccagtcactagagccatgagcaagaggctccaagaggattgggctagaaccgctaaagaaggccctaaggttctcatgaacctcagggtagatttctga

SEQ ID NO: 43726 - DNA, 355 bp, Glycine max
  Peptide Sequence Number=SeqID_135411
atgactaggggcaatccaggtgatttacaaccctttgatcctgaaatagatagaacctttcatagattagttaggcatagtgtgcatccagatcattttgagtattctgagcattccgtgcattctgagcattttgtttctggtgattctgaacattcagattttgagcattcggctattaattttcatactgagaacatggctcaatctccacctcgtgagaggactcttagggagatggttgcacctgacttcacttatgaaagcttgtgcattcaatatcctgatgaggatgttccatatgttctcaagactggactaatacatttgctgcccaagtttcatggtcttgcag

SEQ ID NO: 43727 - DNA, 454 bp, Glycine max
  Peptide Sequence Number=SeqID_135412
gcaaaaaacaaagatgtttattgacccaaacaatgcaaacacaactaaattgataacgatcttatccgaagagcaagagaggatcactaagcctgtggcacatggtccagcatcagagcgtcgatttcccccacaacagtttcacatgcttcagtcaagtgttgaaactcggggttttgacagacgaagggaggttgttgaagcggaagatttttcccaacaaatggagcaacgtggccatggaatgtattacacaccaccaacattttctcagtatccttcgcagatgtatcagtatcctttcgaaggtcatgacactgatatgtctgcaagcgaacattcgtttggtggtgttgcggaaacacatcctcatttttcatggccgactatgaccccttcgcaacaacatgatgccccaatggcaacacctaatgccccattagctctgcaatga

SEQ ID NO: 43728 - DNA, 354 bp, Glycine max
  Peptide Sequence Number=SeqID_135413
atgccaatctccccctgcagatggaacgcgctccagaagacacccagtggacccgaagaagtccaacagggccctggggtttccagctctggttacgggcctctgtcagtcctaccgggtgcccattccccccggcaaggtcatgcatcgtgcatagggatcggacctcaagacacccagtggacccgaagaagtccaacagggtctgggagttgtcaagctctaattacgggtctctgtcagttctacggagtacctgtcacctccagcaagggcatcaggccccctactaatcgagctttcatcaagaagtactgcgtctccaggcaggcgcagggcgaaacaccacagtag

SEQ ID NO: 43729 - DNA, 102 bp, Glycine max
  Peptide Sequence Number=SeqID_135414
atggaggtgtgcaaacgtttgggtgtatatgggaaaaagaaagctatgatgcgaagggcatttctctcatctcagacattatttcgcaaattccaatggtga

SEQ ID NO: 43730 - DNA, 277 bp, Glycine max
  Peptide Sequence Number=SeqID_135415
atggtggcacgggtgatgctcaagcacggttatgagcccggaatgggtctgggcaaggacagcctcgggaatgccgatgtggttgacattaggggaaacccgtacaaatatgggttggggtatgaatctgggatgccgggaaggaggaatgcgctgtcaagactcagggcagataaggcatggcccggccatgttagccagtgtttcaccagtgccgggataatgtttgaggaagaggtggcggcaataggagaggagtctccacaagacccgccaa

SEQ ID NO: 43731 - DNA, 815 bp, Glycine max
  Peptide Sequence Number=SeqID_135416
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggcggtagtggtgcacgaggacgtggaaattcaaaaggcgatcgaggagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 43732 - DNA, 246 bp, Glycine max
  Peptide Sequence Number=SeqID_135417
atggagaaaaatgaagaaacaaaaatggaagagaagctcttgtgctctgattaccacttgatggaagcttgcttgtggggcttctatggaggctggatctttgagcttcaatggggtcctttaatggtgattttccaccatggagatgcagcgaaagacaaaggaaaagaggtgagaggaggcgccatccattatggaataagccatggaggaaggagcttcaccaccaagatgagccttggataa

SEQ ID NO: 43733 - DNA, 685 bp, Glycine max
  Peptide Sequence Number=SeqID_135418
tgttctctcatactccaacctggctcctacttcccacacctcggatctgatagtagatcgagctaggctgatctttggcctagtctctcagatggacatgaatgtgggagctctcatctctggtcagattgcatctatggcctacctggtcttcgaacgcctgagcccgatcattaacttggcctatatcaggaaaaactgttggaaccctgatgatctggaagttactatcagaggggccaagagagcgaggacaaggccagttgaagccctttccacatctatagctcctcctccagcacgtaccctagcagctccttctacctcaactcctgcagattttcagcgttttgaaaccatgcttcaaagcatccatcaggggaagattatcttattacaaagtttacagatggtggcacctccagactctattccttcagtagagcagtttaatgagatgaagacagatcaaacacaagaagctgcaaccacttatgagaaatctcttgaggccacttctgagccttcaaaaccagtggcagatatagcttcacttcagcaggaagcagacccttccactcctaaggatcagactacgccagtcctatctccgaacacttctcctacagctacccctgtgcttcacgtaacagacgaggaggatgttcagacacaggatacttag

SEQ ID NO: 43734 - DNA, 189 bp, Glycine max
  Peptide Sequence Number=SeqID_135419
atgaaagataagagggatgaggaagaaaaactagaaaaacaaaagaaaaagaaggatagtaaggccttgtcttcaaaggccaaggggaaggaaaaagaggaaaaggattcttccaagaatattgttaagaaggaaaatcattttgcaacaaaagtgatcaaggagttcccacgaatgctaagagaataa

SEQ ID NO: 43735 - DNA, 300 bp, Glycine max
  Peptide Sequence Number=SeqID_135420
atggaggccatgaaagagaaaatggccacaatgatggaggccatgatgagcatgaaaaggataatggaagccaatgcggttgcagttgccgctaccagcgctgttgctaaggtgaacccgacgcccccatctggcctcaaccaaatgaatcatccaacctcagatatgcatacactcccaatgaggatgtcaataactccactcccatactcattgagagccgacgacctcatcatgcacatgtctcttaacccatgggggagacatatgaataccccaccacaatctagccgactttga

SEQ ID NO: 43736 - DNA, 195 bp, Glycine max
  Peptide Sequence Number=SeqID_135421
tggctaagcgcgaggaagaatctaaaagaagatgagctgtcaggttcattgagcgcaccgctccaggtcatcaagcgcaccgcttcagctcatccgctaagcgagagaagcgcgctgagccaaaaatcactaacgtgcgctaagcggtccatatgtgtgctaagcgcacgagcacgaacaaggccacctatttaa

SEQ ID NO: 43737 - DNA, 528 bp, Glycine max
  Peptide Sequence Number=SeqID_135422
atggctccgaggaagctttccgcaaagagatctaggagggatgccgcggctgaaggaaccagtgccgctctcgagtttgacaatcatcgtttcaggagcgccgagcaccagcagcgtttcgaggccatcaaagggtggtcgttccacagggagagacgcgttcagctcaaggacgatgagtacacagattttcaggaagagatagctcgccggcgttggacgtcgctggtcactcccatggctaagtttgacccagatatagtcctagagttttacgcaaatgcttggcccacggaggagggcgtacgggacatgcggtcaggggtaaggggccaatggattccttttgatgcagacgccctcagccagttcctgggtgacccgctagtgttagaggaaggccaggagtgcgagtttagatttttcccggaccgctgccgggaggcgggtgcggatcatgcgcaccagcatgaccaccttgacccagatgtggatgacgttgctgctcagcaatgtcctgcccagtga

SEQ ID NO: 43738 - DNA, 384 bp, Glycine max
  Peptide Sequence Number=SeqID_135423
atgaaaggaaggcataggtcacatcttagacctcactcccataggagagaaaaggaaagaaagcctcaagaggctaacattaacctcccatacttccatgggaaggacaatgtagaggctaacttagattgggaaataagggtagagcaacaacttaaaaggcaaaaagaccaaggtcaaggcatcttatgggtgacaccttctaagcccaaagatgataagggaaagacaatagaaaagcaaccccttaaggctagtatgcaagagaagactagctccatgaagtgctttaaatgtcatggaagaggacacattacttctcaatgccccaccaagaaaaccatgattatgaggggccaagacatttatagtagccaagatgag

SEQ ID NO: 43739 - DNA, 466 bp, Glycine max
  Peptide Sequence Number=SeqID_135424
atggcgaaaaggtttgcggatgacaataatttatctctgcatgtcatcgggctcgccgcttctgcattacaaaaggtgcagaatgaccataatttgtctctgcgtgccactggactcgatcgtctctggatgacaaaaggtgaaagtgaccataatttttctctggttccgtgctcgatcgtctctggatgggataaaggtttgcgaatgaccataatttgtctccgcatgtcatcgggctcgccgcctctggatgacaaaaggatggcgaaaaggtttgcggatgacaataatttatctctgcatgtcatcgggctcgccgcttctgcattacaaaaggtgcagaatgatcataatttgtctctgcgtgccaccggactcgatcgtctctggatgacaaaaggtgaagaggaccataatttatctctgcgtgactccggactcgattgtctctggatggcaaaag

SEQ ID NO: 43740 - DNA, 195 bp, Glycine max
  Peptide Sequence Number=SeqID_135425
ggaccgtcggccttgctgatagcaggatcgacgttgaccacagatctttctaccctaggtggtctagtggccaatgatcatagttgtgtcaccttgcgtgtctgcttcaacgtagatggagatgctgatgcgtctacaggaggaggaggaggaggaggaggaggcgaggcaggtggagtagtcatggtcctttaa

SEQ ID NO: 43741 - DNA, 306 bp, Glycine max
  Peptide Sequence Number=SeqID_135426
atgcaattaccgcaagagcccttgaacaagagaccaagaaggctcgcaaggaagagtatggccggaacaaatttcgcggagctctatggggtagcaataatgaactcaagttgcgaagggaagaaagggaccagtcgcgagcacatagcatggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaaagaggctag

SEQ ID NO: 43742 - DNA, 171 bp, Glycine max
  Peptide Sequence Number=SeqID_135427
atgtcttccattgcaagcttagtagcagttacagaagtcaatatttacgccaataactatgatcattttaccttacctattttccatcatggccttggttcaggcattctacattatatgactcccttggattgtcaatctccaactaatcagcctgaatcaacaccaaag

SEQ ID NO: 43743 - DNA, 423 bp, Glycine max
  misc_feature (404)..(404): n is a, c, g, or t
  Peptide Sequence Number=SeqID_135428
atgacccgcactaagaaaactggccaaatgacatctgaggcaacaaaggattttgctaacaagattgattccttggaggagcaggcctcacagggtttctttgtcgcccatagacgtcagggtgtgctgactgctgccattaggcaaccaaaacaccctggtggtgtgcgtgctactggagttgatgtcacgatcaaacaatactttggatcggctccaaggacctcccacatgtcttcgtccatggttcctgaagacttggaaaacttaatgcaaaaaatcagggaccaactggaggagtcgatcactgaaaaagtgactcgacaactaatgttgtccttcaaccagatgcaatcccagtttcaatcgtatatgcaatcacagggactcgcactgtctcttangccagaggttgtcctttag

SEQ ID NO: 43744 - DNA, 348 bp, Glycine max
  Peptide Sequence Number=SeqID_135429
atgacggtgaaaacctctgacacatgcagctccggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccttcattcaagaaaaatctacaccaaattttgaagtgaagggccatagagccacaaaaatcttatga

SEQ ID NO: 43745 - DNA, 906 bp, Glycine max
  Peptide Sequence Number=SeqID_135430
atgctgctgcgcacccactatctgtcgctcgacccgtatatgcgtggccgcatggatgacagcaaatcctacgcgccgccggcgcaactcgaccagccgatggtcggcggcaccgtatgccaggtggcggaatcgcagcatccggacttcagcgccggcgactgggtactggcggccagcggctggcagagctatgccctgtccgatggcactggcgtgactaaaatcggtcatctgccccatccatcctgggcgctgggcattctgggtatgccgggctttaccgcctacatgggcctgatggatatcggtcagcccaaagccggtgaaacgctggttgtcgccgccgccaccggaccggtgggtgccacggtcggtcagctcggtaagctgaatggctgccgcgtcgtcggcgtggccggcggtgaggagaagtgccgctacgcgattgacaccctcggtttttccgcctgtatcgatcatcatcgtgacgatttcgcggaacagctggcggccgcctgcccggacggtatcgacatctattttgaaaacgtcggcggcaaagtattcgatgccgtcttcccgctgctcaacaccgccgcgcgcgtgccggtgtgtggcctggtgtcgggctacagcagtcgcgaactgccacccggccccgatcgcacgccgctgatcatgggcgggattctgaaacgccgcatccgtatgcagggcttcatcatcttccaggattatggcgatcgctatccggaattcctgcaggctatgacgccgctggtcgagcaacaaaaagtgttgtaccgcgaacacatggtagaagggctggagcatgcgccgcaggcgtttattgacatgctgaaaggcaaaaacttcggcaaaaccgtggtgaaagtggcgtag

SEQ ID NO: 43746 - DNA, 882 bp, Glycine max
  Peptide Sequence Number=SeqID_135431
atgctgcccaactcatccacgcgcctgaataaatacatcagcgagagcggaatctgctcgcgccgtgacgccgatcgttacatcgaacaaggcaacgttttcattaacggcaaacgcgccagcgtcggtgcgcaggtgttcgccggggatgaggtcaaagtcaacgggcggctgattgaaccgcgcaacgaagacgatctggtattaatcgccctcaacaagccggtgggcattgtcaccaccatggaagagggcgagcgtgacaacattggtgacttcgttaaccacagcaagcgcgtgttcccgattggccggctggataaagactcgcaggggctgattttcctcaccaatcacggcgatctggtgaataaaatcctgcgcgccggtaacaatcacgaaaaggagtacgtggtcacggtggataagccgatcaccgacgagtttattgccggtatggcggcgggcgtaccgatgctcggcacagtgacgaaaaaatgcaaagtgaagcgggagtcgacctttgtatttcgtattatcctggtgcagggactgaaccggcagattcgccgcatggccaaacactttggctatgaagtgacgaagctggagcgcacgcgcatcatgaacgtgagcctgaaaggtatcccgctcggtgagtggcgcgatctgacggacgatgaactgatcgacctgtttaagctgattgaggattcgtcgtcagaagatcaaaaaacgcagcaggcacaggcgaagaagaaagcggcgacgcccgccgcgaaaaaaccggccgtcagcgcaccgaaacagagtgacaaagcgggtcagggcgcgaaccgcaagcgctttacccagccgggacgcaagaaaaaagggcgttaa

SEQ ID NO: 43747 - DNA, 3625 bp, Glycine max
  Peptide Sequence Number=SeqID_135432
atgtctgcgatccgtttctcgcctctggcttgtgtcgttatgctgtgtgcctccgcgtcggtgtttgctgctgagccggtgaagttacagatgtactatccgattgcggtcggcggtaaagtcagccacaccgtggaagccctggtggcggattttgaaaaacagcaccctgagatcagcattcagccggtctacaccggcgattacgccaccaccgtgaccaaagcgctgacggcttttcgcggcggtaacgcaccgcaactggcggtgatgggcgatattgaagcctggtcgctgatggatgccggtgccatcgtcgccgccagcgatttagccacgggtgaagaggacaaacagtggatcgacagcttctatccggcctttttgcgtcgcattgagggcaaagtgtggggcgtgccttttcagcgctcaaccgtggtgatgtactggaacaaacaggcatttgagaaagccggcctcgatccgaatacaccgcccgccacctggcagcaggtggtggcattcagcaaaaaactgacgctgaaacaggccagcggcgtcagccagtggggcattgagatcccttccacgccgaacggctactggaatttccaggggctggctgccaccaatggcggacggctggataacggtaagggaaacgccgtgtatttcaacacgccgggcaacgtggaaaccctgcagtggctgaccgacctcggccagaaagaggaagtctcgccgaaaggcgcgattgcctggggcaccacgccgcaggactttatcagtggtaaaacggccatgatggtcaccaccaccggtaacctgaccaacgtgcacgataacgcgaccttcccgtttggcgtcgccatgctgccggagaaaacccagcgcggcagcccgaccggtggcggcaacctgtacgtgttcaaaagcgcctcaccggcgcagcagcaggcggcgatgcgcttcatccgctgggtcaccgcaccggaacaggccgcgcgctggagtatcgctaccggctatgtcgccacctcgccggcagcgtgggacacggcggcaatgaaagcctatgtgcagcaggtgcctcaggcactggtggcgcgtgagcagctaaaatatgctcagccggagctctcgacctacaacagcgtgcagattcaggacgcgctcaatcacgccattgaagcagcgcgccgccacgctgcgcccgcgcgggtggtcactgcagctcagcggctatttgctgctgctgcccgcgctcagcttcctgctgctgtttacccattatccggcgctggccacgctgtggcagagccttcgctgtggaataacctgctgtatgcgctgatcaccattccgctggcggtgacgctggcgctgctgatggcgctggcggtcaatcgtcggctgcgcggcaacgcgctggtgcgtgcggccttcttcattccgtcgctgctgccgatgatcgccatcgccaacctgtggctgtttttctacacgccgcagcttggcatcctgaatagcctgctggcatggttttcgctaccggcggttaactggctcggcgagccggataccacgctgtactgcctgatggcggtttcggtatggcgcgaggcgggttttttcatgatcttttatctcgccgccctgcagcagatcgatccgcgcctcagcgaagccgccgccattgaaggcgcatcgcgcggttactttttccgccgcgtgcagtggccgctgctgttgccaaccacgctgtttgtgctgatcaacgcctcgatgaacgccttccgcattgtcgatcaggtgattgccatgaccaacggcggcccgaacaacagcagtagcctgctgctgttttatatctatcgtaccgcgttcagtttctgggacatgccagccgcgtcggccatgacggtggtgctgctgcccattatcaatgaaagctgcatcctctccgggcggttttgcgctcaacctgctgatttggctggccgcgctgctgtggagcctgccgatgctggtggcgctaacttcatcaatgcctggcacgcgggcaccgtttgcccgctacttcctcaataccacgctgctggtgctgatgattgtggtggtccagctggtgctggccacgctggccgcatatgcactggtgcgctgatgatcagcccggatgtgctgattctgaataattaccgcaccatcagcgcgctcgggctacgcgataccctgaccggcattgcgctgccgagccagccggttttacattctgcgccacatctacattccgctggcaaagccaatctatgtggcattcgcgctggtctcgatcagcttccactggaacgattttctctggccgctggtgatcaccgactcggttcaggtgcgtccgttaaccgtcgggctgcagctgttttccgcgccggagcagggcgtgcagtgggcgctgattggggcagcaacgctgatgaccaccttgccgttgctgctgctgtttttgctgttccagcggcaccagagatgggatatgcccatgcgctaaccgcagcgcaacgccagcggctcggtgatgtcgctgagctgtatcagttaccggatttacgcgcggcaccgctcgacggcacgctgcgcttcgggctgctggccgatccgcaatatgctgacgttgaggcggatgtcccggcgaatctctactatcgtcatgcgctgcataagctgccgcaggcgataaccgcgctcaatcagcagccgctggattttgtcgttacgctcggcgatctggtggatcgccactgggccagctatgccacgctgctgccgctctacgatcggctactccatccacatgccgtggtgctggggaatcacgacgcccagaccatcgcgcagcacctcgatgacgcgctgccgctgccaaaaagttactatgcctttcagctgccgggctggcgctttattgtctacgacggcaacgatatcagcctgtactgcaatcaacacaacggcgacgatcgccagcgcgcggccgcactgctggctgatttacaggcgcgccagcaaccgcaggcgcagccgtggaatggcgcggtcggtgcgactcagctggcgtggctggaaacgcagcttatcgaggcccgcgcctgcggccagcaggtagtggtgttcggccattatccgctggcaccgggctacagccacagtcttctcaacggtgcgcagctggcagagctgttctgccgctatgacgtgcgcgcctgttttgccggccacgatcaccgtggcggctatcaccgccgtgcggataccgtgtttataaccctgcaggggatgctggatggcccgtcgcgcgtgccctttgcggtggtggaactgacgggcgagacgttgcggctgagcggatggggcggcgaaatcagccgcgaagaggtatacggtgccgcgccgatggctagccggccagcccgggaaatatacctcgccatcgaccagcgaagcgatcgtctgcggcgagactttaatattgacgatttcaatcaggctatcatccggtcggcccagcttgctgctgaaagcgcggccataagaattccagctcagtctgatactgctgtttcag

SEQ ID NO: 43748 - DNA, 477 bp, Glycine max
  Peptide Sequence Number=SeqID_135433
atgtgggctttccttaccagtcgtcagatcgactgggctcacctggtttggtaccgaatgcatagggcattacgggccaatgcacctcttccatatcctcaattggtcaccctctttctccgtcattttcaaattcctcttgatgatgaaccttttgttcaagtcaagcgttcctttgctataggtgctggtgcagtcacttcatttggttacagtaaggatcgtaatggtcaatggctgaagaaagatgcacttcctccacaagatgagcgtactccttctcctcctcctcagcgagatgattcagcccttatgactgaagttcttttagagttacggggtcttcgcacttatgttggtgaacgttttgattctttggatactcactttgcaggaatggatatccatctcacacagcttgaagaagatgtgggttatattcgtcagagctttgatcttccaccaccacattcttag

SEQ ID NO: 43749 - DNA, 201 bp, Glycine max
  Peptide Sequence Number=SeqID_135434
atggcctctagtaatcgattaccaaggagggatgggtcactggtaatcgattaccagatcgtgatggcggcgcagctaatccgtgatcgagtagagatggagtgcctagagggagcctgggagaccctcgaaggcaaacacgaggtgctgatttcggggcacgattcgattcacggctacttcattggtgcatccagatga

SEQ ID NO: 43750 - DNA, 381 bp, Glycine max
  Peptide Sequence Number=SeqID_135435
atggagactatgaaagagcaaatgaccacaatgagcgaagccatgatgagtatgagaaaagcaatggaggtcaacatggctacaatcattgctgcaagtaccgccactgaggtggacccgactcacctatctggcctcaatcaagtaaatcatccagtctcagatatggtaggtcagggaggcggggcattgggaagtatgagaggcccccattttgtgcaggtccagagcaagcattccttcccaccatatggcttgcctctcaatgatacaccacccaatgttgcacacgcttctgacgggaatgtcgataacttcgctcctatacccattgagagccaacaccccaatccggtcatgcacaggtccctcaacccatga

SEQ ID NO: 43751 - DNA, 123 bp, Glycine max
  Peptide Sequence Number=SeqID_135436
atgactaaagcacgtcaacaaggggtacgaaaaggaaaagagggacaagcttgccacccagctcgcccaggcgagctaggttgcttcctccagaaggcaccaccttctagaggaacatcctaa

SEQ ID NO: 43752 - DNA, 546 bp, Glycine max
  Peptide Sequence Number=SeqID_135437
atggcacacaaaagcgatcaactgaaaaaaccacataacgctcatccgtgtcagagttggcatacaccagctgacacttcggcagagggaggtcagagttatgtaatcgctgggcaggacgttgctaagcagcaacgtcatcacatctgggtcaaggtggtcatgctggccatgcactcctggccctcctctaacactacgggtcacccaggaactgctctaagggcgtctgcatcaaaaggaatccactggccctttacccatgacctaagacatgtcccgcatgccctcctccgtgggccaagccttagcctggacgcgtctctctcggtgcaacgaccatcctttgatggcctcgaaacgctgctggtgctctgcgctcctgaaatggctggatcaagcctcgatgaggtggtgactgcggtgcgtcctgcagcctgcggtgcatcaccctgcgcttgtctaggcgtgcaatacttctcaatgaaggcccgggtgatcggcggtcaaatcaccttactaggtgttgacgggaaccccgaatga

SEQ ID NO: 43753 - DNA, 362 bp, Glycine max
  Peptide Sequence Number=SeqID_135438
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatcccatgatgtggaacagtggaaacaaagtcgggaaacctgtcgtgccagctgcattaatgaatcggccaacgcgcggggagaggcggtttgcgtattgggcgctcttccgcttcctcgctcactga

SEQ ID NO: 43754 - DNA, 318 bp, Glycine max
  Peptide Sequence Number=SeqID_135439
atgaaagaggcagttgattctcgcaaaaagaatttttcaaagacgagaaatagtttgaaggatttttcagttgacaggagcgcaggtcgcttgagcaaacaaaccaatggcttgcacccacattctagtggaagcaaagatgattcaacaagtgattctcctcaaatttcagccagcccgcatcaattagaccttgcaccttatgtatcagggcactacaatgctcaatggaatgccccggggctcctccatgatatgcacatgttgcattcgagtcgtatcctcgaaaaaaaggaggttgaggaaaccttggctggg

SEQ ID NO: 43755 - DNA, 336 bp, Glycine max
  Peptide Sequence Number=SeqID_135440
atggagtggatagtacctacacctactccatatcgactagtggagccaattcaagtgatagaggtgtcatcctctaaaggggatcttgaagaggaccagaggagttacctcctaaacctgctgtggatgcccttgacttacctgaggatgatgaagacccactccttgatgttgattccccagaggatattatgtcagcatctgaggcagactctacagaggagagtggccctggagggacagcgaatagtgacaactcttcatcatagcagacgactcctttcactaggtgtacatactttttggtgggtgagtgtatctagttcagactgctag

SEQ ID NO: 43756 - DNA, 324 bp, Glycine max
  Peptide Sequence Number=SeqID_135441
atgcacacacaaagtttcacaattccacaattctttaaaataggcctaactcacaaaaagtccccagtggagtcgccaactgtcgcaacgtgccctttgcgggcgagcgaaggcgaggctcacgggtgcgctttccaaaggaggaaaagatgcgcggagtcgccaccaacgtttatttgtagaaaacgtcggaaaaaccgaaggaaaccggtcaaaatgaaaattctaagttcgggagttgtatttacatttgaggaaggtcgacaaaagcggggcttttgctcctacgtaccctctattgaagaggaaatcagacctacgtag

SEQ ID NO: 43757 - DNA, 264 bp, Glycine max
  Peptide Sequence Number=SeqID_135442
atgctgtcgcaggagaaccagcaggtgtttgtgcttaacggcattcagacgatgagcggctacgtctataaccttggcaacgagttaacctcgatgcacggtctggtggatatggtgcgcctgtcgccgatgggcagcgagaccttcgccatgctcgacgccttccgcgccaacgaaaatggcgctgcgccgctggatctcaccgctaacagcgattgcaacggctactggaaacggctggccgggctggagctgcaggcgtaa

SEQ ID NO: 43758 - DNA, 750 bp, Glycine max
  Peptide Sequence Number=SeqID_135443
atggaacgaggtggtggagaagttcttgaagaaatatttcccagagtccaagaccattgggggaaagtccagctcaacatctttattgatggcatgcaaccccattccaagcaactccttgacgcctcagccggtgggaagatcaagttaaagactccagaagaagctattgagctaatagagaatatggcggccaatgattatgtcattctacgtgaccaagagcccagcccacaggaagaaagcactaggctagaagaattgctggtacaattcatgcaggaaacaaggtcacatcagaagagcactgatgcagcaatcagaaatctggaagtacaattagctaagctagttcctgaaaggcccaccgaaacctttgcggtaaatactaagatgaagcccaaaaaggagtgcaaggtaattttaactaaggaagatgtggaagaagaaaagaaggaagagatagaaagaaatgaggagaaaacacaacaatgggagaagcactcacaagtaaaaattcaacaagaaagtattctccaagtcaataccactcctcatcaactgatagtcaaggaagaaagacatggaaaacatgataaacccttaagtgtccttcccttcttgaccaccagcacttttcttgctacaatatggaaggtgtttccagtatacatgagtttcatggcgtctctagctaagaggcgaaaatgcaaggaagatgtgttctacgtgaccttcatgccaccttga

SEQ ID NO: 43759 - DNA, 541 bp, Glycine max
  Peptide Sequence Number=SeqID_135444
atgaaggaaggcataggtcacatcttagacctcactcccataggagagaaaatgaaagaaagcctcaagaggatagagcaacaacttaaaaggaagtctacttcaaaatcttatggctctcactcttatccaaataaagaccaaggtcaaggaatcttaggggtgagaccttctaagcccaaagatgataagggaaagacaatagaaaagcaaccccttaaggctagtatgcaagagaagactagctccatgaagtgctttaaatgtcttggaagaggacacattacttctcaatgccccaccaagaaaatcatgattatgagggggcaagacatttatagtacccaagatgaggctactacttcaccttcctctagtaaaagtgaagaagcaaaaggggaagaatctagtgaagagatctacccccaagaagaaggacaacctttaatggttaaggaggagtgtaaggagacacttgttagcattgccacatctcttaggcttgagtttattcctcaagtaaaggagttgttggatgagg

SEQ ID NO: 43760 - DNA, 411 bp, Glycine max
  Peptide Sequence Number=SeqID_135445
atggcagcccaagcactcaaagcctcctcctcaatacaagaagaagaagaaaaagatgaagaatcaaaagatgaagaagacttctcactctttgtgaagaagtttcacaaatttttcaagaagagaagaatcgagaggcgtcaaaatttcaaccatggaaaaagattccaagtagactctccaactcttagatgctacaagtgcaaccaacttggtcacatcaaagcaaattgcccctcaaacgagcaatggcttgagaagaatgataagaaaagccatgaagaaagaaggaccaagaaggcttacatcgcttgggatgacaatgattcatccgaaggatctgaaaaggaggaaatcaaccttctaacaaaagactatgaaagtgaagaggacatcactcagagggactaa

SEQ ID NO: 43761 - DNA, 493 bp, Glycine max
  Peptide Sequence Number=SeqID_135446
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgatgcgccttatccgg

SEQ ID NO: 43762 - DNA, 291 bp, Glycine max
  Peptide Sequence Number=SeqID_135447
atgtcaggagtacgacgcgattctcctcaaatttcagccagcccgcatcaattagaccttgcaccttacgcttcaggcccctacaatgctcaatggaatgccccggggcttctccatgacaagcacacgttgcgttcgagtcgtattctcggagaaatggaggttgatgaaccttggttggggttatggctaccattgaattatcaagtggtgtttgtcattggaagtgcggtaggtagactttgtggttgttttagggatggcctttgtggaaaactgggtggtgggtaa

SEQ ID NO: 43763 - DNA, 219 bp, Glycine max
  Peptide Sequence Number=SeqID_135448
atgtcggctttgaaagagcaaatggcttccatgatagataccatgtttggaatgagacaacttatggagaataacatggccaccgctgccactgttagttcggctgccgaagcagacccaactctcccagctaccgcgcaccatcctctcccaaacgtggtaggacgagaaggaagcacactggggcacatcagcaacccctatttgggatacaactga

SEQ ID NO: 43764 - DNA, 192 bp, Glycine max
  Peptide Sequence Number=SeqID_135449
atgggagatcccgtgagcttggccttgttgacgtcgatcggaggaagagatggtgacggtgagatactagccgaggagcatcggcggggagtagtcggagggtcgccggcggtagcggggcgaagacgttttagttgtggacttgtggtacagtggtggttgcatttggtaacatttgtccgtaagcaataa

SEQ ID NO: 43765 - DNA, 51 bp, Glycine max
  Peptide Sequence Number=SeqID_135450
atggagccaattgatgcagcaactatatcttccgcggatgcttatgcatga

SEQ ID NO: 43766 - DNA, 903 bp, Glycine max
  Peptide Sequence Number=SeqID_135451
atgggtccagttttgccagactcgctgagacccttcttgggaggtgatgtgcgcaaaaaggcacaggccagccagaagcagaacactgccccccacgttttgtctcgtgggggttatgactatttggagcagaagctcctggctgagaagacgaagaagaagctggaggaagttgcacagtcaggaagcgttgatgacgtcatcgaccctccatccccggtcagacgccacgtgaagtggaagatggcccgtacgaagaaaacaagggagatgatgactgaggccgcaaaggaaatcgctgtgaagatcgattcctttaaggagcaggtgacacagggatccttcatcccccacggacgtcaggatgttctcaccactgctattggacgtccagagcaccctggacgtgtctgtgctgttggaaccggtgtcaccatcaagcaatactttggatcggctccacggacgtcccgcagctcttcctccctgcctcctgaagaattgcagcagctgacccaacaaatcagggaccaactagaggagtccatcacagaaagagtgacgcggcagctcatggcatccttcagccagatgcagtcccagatgcaatctcagggacttgcactacctcccgagcctctggttggtccctccgctcctcgagtaagcacaaaggggagttgtgttgatccctcaggaaacgatcttgagatgggtgactcagataggtgcggcttgtacattgaaggagatcatgcccgcctggtttccctagggagagtttatgagggatccactgttgttcataacactcctttgttgcctggccaagtaaaggtgggtgtcgaggaggttacagatgcagatgctccagttcctgtacccactgatgagtttccttaa

SEQ ID NO: 43767 - DNA, 655 bp, Glycine max
  Peptide Sequence Number=SeqID_135452
accaacagatggagtggtggatattactgtctctgagcaccaaattgccaaggaaatcactgccaaacaagtccagcattggccaaagaaagggaagctgtctgcagggaagctaagtgtgaaatatgcaatcctgcacaggattggagctgcaaactgggtacccaccaatcatacttccactgttgccacagaatcctttgctgtcaaattacccattgccttcccaactgtattgtgtggcattatgttgagtcaacatccaaacattttaaactacactgactctgtgatgaagagagaatctcctctatccctgcattacaaattgtttgaggggacacatgtcccagacattgtctcgacatcaggaaaagctgctgcctcaggtgctgtgtccaaggatgctctgattgctgaactcaaggacacatgcaaggtgctggaagcaaccatcaaagccaccacagagaagaagatggagctggaacggctgatcaataggctctcagaaagtggcattaatgatggagaagcagctgagcaagaagatgaagtagctgaggaagaagtagaagcagccgaggaagaagaagaagctgctgaggaagaggaagatgcagcatcagatgatgattctgaagccaccccatga

SEQ ID NO: 43768 - DNA, 249 bp, Glycine max
  Peptide Sequence Number=SeqID_135453
atgaagctaaaggcagaaaacggaacagaaacgaaattgcaattagaagcagaaaatggaaaatgcattcacgtgaacattttgaccgtgatgaggatcacattgcagcaggaggagttcaaagaaaatcaagattttcgacctcatgctatttcaagcgattctgttgacatccagtacccagtagttgagatatcaaataaatcaaagcttagttgtgtcaataaatcaaagcttaatcatgaataa

SEQ ID NO: 43769 - DNA, 483 bp, Glycine max
  Peptide Sequence Number=SeqID_135454
atgaccggtagattgctggccaggtcattaacctttgattgtcgcatcatgcactatattattgttagaattttgctttcccgttcttcaaatttggctcaagcctttgaggaggacttgattttgatgtgggctttccttaccggtcgtcagatcgactgggctcacttggttaggtaccaaatgcataaggcattatgggccaatgcacctcttccttatcctcaattggtcactgtctttctccgtcattttcaaattcctcttaatgatgaaccttttgttcaagtcaagcgatcctttgctattgatgctggtgctaaggatgcactccctccacaagatgagtgtactccttctgatgcaatcctccctaggaagggaccagtcactagaaccatgagcaagaggctccaagaagattgggctagagctgctgaagaaggccctagggttctcatgaacctcagggtacatttctga

SEQ ID NO: 43770 - DNA, 297 bp, Glycine max
  Peptide Sequence Number=SeqID_135455
atgcatgatatgaatgcattttacggacacgagagcccggaaaattatctcttcttacttgcgcatttgggggcgcagtgccccatgtgtacaattaagaagatttgggagccaatccagtccttgtgttcggactctcagccacttatgatagccgccgatgatcccattactgcttcccctaagctctctgtcctttcttcacgccgcatcccatgccttgcgaactccttggagtaccctcgcgttgtggtcactaaaaccccgtgcgatgaaaggcgtgatgctttcgtctaa

SEQ ID NO: 43771 - DNA, 840 bp, Glycine max
  Peptide Sequence Number=SeqID_135456
atgcgggaggaactgcaaatttccgccggcgcggtgagcgccagcctgagcatcttcctggccggcttcgccttcgcgcagctgctgtgggggccgctctccgaccgtctgggccgcaaaccggtattattgatcgggctgacgctgttcgccctcggctgcctgggcatgctgtgggtggaaaacgccgtgcagctctggatcctgcgctttattcaggccgtcggcgtctgcgccgccgccgccatctggcaagcgctggtggttgaccgttaccgcgaaggccaggccaaccgcgtgttcgccaccattatgccgctggtagcgctgtcgccggcgctggcgccgctgctcggcgcctggttgctgaaccacgccagctggcgcgcgatcttcgccgcactgttggccatcaccgcgctgctgctgctgccgacgctgctgctcaaagagcgcgccaaaacgcagcccagcgccgatgcgccaaaaaacggcgtcagcttttggcaactgttgagatccccggtgttcagcggcaacgtcgccatgtacgccgcctgctcggccggcttcttcgcctggctgaccggctcgccgttcatcctcggtgatatgggctacagcccgaacgatatcggcctgagctatgtgccgcaaacgctggccttcctgctgggtggctacggctgccgcgccgcgctcaagcgcatcaatggcaaaaccctgctgccgtggctgctggtagcttatggtgtcagcatggtggcgctgtatctggtggccaccctgaccgatccgacgctcaccacgctgctgatcccattctgcgtgatggcgctg

SEQ ID NO: 43772 - DNA, 234 bp, Glycine max
  Peptide Sequence Number=SeqID_135457
atgatggttcccagggcatctcatgtcaatctcagaattgcatttgttgtgcatagcataatattggcgatcaaaattgctattcccttggattatagggttgaatcaagcactttttttaaaggaaaaattcatcaagtcaaggtcaagtatggaagtaaccagcttgcaaagttggggcagaaggtggatcgggttacatcgcctttttgtctattgccaacacatgattga

SEQ ID NO: 43773 - DNA, 370 bp, Glycine max
  Peptide Sequence Number=SeqID_135458
atgagatggaaaattgtaggaggagataaggtcaggctttgggaagataaatggaatcagcaacagcaacctttagcagagaggtatcctagactataccaaatatctacacagcaaaaccaaaccattagacagatgggacaacacctgcaatcaggttgggagtggcagcttcggtggagaagaccgctatttgaaaatgaaatcgagtcagcaatcaatttcctaaaggatatcgaaggtatacacattcagcagcaaggatcagatgaatgggaatggttaggtgatcaaacaaggaattattccacacgcaacgcctacaatctggttttggaagcttctacaggtggtcagcaagaggaatggt

SEQ ID NO: 43774 - DNA, 679 bp, Glycine max
  Peptide Sequence Number=SeqID_135459
caaccaccaaagtaaagcgaaagtactgaggaacgagattggaacttctccacggagattattgagagcattttgccggaggatctccaggcgacggcgaaaatgtgcattgacggcctccaatcgcatcagtggcggtgaagcacttcgcagcagcgaaactctagctactagccaaaaatcatgccgacaatcgcgttctgattgtgaagtctggcatgtccccttcctcattccgcttctccggtgcagcgactcatggacgcaagaacacgctgtcaccgcactgttaaacctctctctccatgaggacaacaaaatgtcgataaccaatgttggagcagttaagtctctaatttatgttctaaaaactggaattggaactttgaagcagaacgcggcgtgtgcactcttaagccttgcattggtggaagagaacaagggctcgatcggggctttcgatgcaataccgccgctggtttcttttcttttgaacggtttgagcagaggggagaaggacgcgctgacgacgctttataagctgtgttttgttaggcataacaaggaaaaagcggtgagtgtcgatgcggtgaagccgctggtggagctcgtggcagaacaggggaacgacatggcagagaaggccatggtggtgctgaacagcctggtggggatttag

SEQ ID NO: 43775 - DNA, 261 bp, Glycine max
  Peptide Sequence Number=SeqID_135460
atgcaaaaaataccaaaaataaggggcaaaagggtcttttacttggttttcttggaccctagctcgcccaggctagcctctagctcgtctaggccaccaaatagcttcatggtgaagaaaccagctcacctaggtgagctcactgcttcagggcatcctaggggtgttttaaagggttccaaggttcaggaggtgagggaattgagagaagagagaaagaagaggaaacaaggccgaggcactaccgaatcgcgaccgtga

SEQ ID NO: 43776 - DNA, 405 bp, Glycine max
  Peptide Sequence Number=SeqID_135461
gtcgactctagaggatccccgatccactctggcttgtctaaagcattctgggcagaagcaataaacacaacagcatatctcatcaatagaggaccatcagttcctttgaattatcagctgcccgaagaagtatggtctagaaaggagagtacaggtgtagaggttgagtctgaaccagaaccatcaactcctccaagaaaatctagcagaatttcagtaccaccagataagtattctccttcattgcattatttgttgttaattgatgctggtgagccagaatgtttcagtgaggctacgcaagggaatgactctattgagtgggagctagcaatgaaagatgagatgacatcccttcagaagaataagacgtggtctttaaggaaagaaagcgttacaaaataa

SEQ ID NO: 43777 - DNA, 327 bp, Glycine max
  Peptide Sequence Number=SeqID_135462
atggctatgggggatttcatcagcagactctccttccctgaaaacaccgagactttttcaagtctcgcaagttatccagaactacgtaggtctgagttcctcattggaggatacgtaggagcaaaagccttgcttttgtcgaccacactgctttctgttaccatgacccaagagctggtagcccgcggagataccttacgggttatccgcacccttttgtcatccagaggcggtgggcccgatgacacgcagagacaaatttggtcattctgcacccttgtgtcatccagaggcggcgagcccgatgacacgcgcagataccttatg

SEQ ID NO: 43778 - DNA, 639 bp, Glycine max
  Peptide Sequence Number=SeqID_135463
atgccaatctccccctgcagatgtatcagttgggatcgcgcccacaagacgcctagtggacccgaagaagtccaacagggccctggggtttccagctctggttacgggcctttgtcagtcctacagggtgcccatccccccaacgagggatcgcacccacaaagacacccagtggacccggagaagtccaatagggccctggggtttcctgctttggttacgggcctctgtcgtcctacggggtgcccgttccccccggcaaggtcacgtcatcatgacatagggatcgcgcctacagacacccagtggacccgaagaagtccagcagggtcttggagttgtcaagctctaattacgggtctctgtcagttctacggagtgcctgtcacctccagcaagggcatcaggccccctactaatcgagctttcatcaagaagtactgcgtccccaggcaggcacagggcaaaataccaaagcagcctggggatgggcggcagcggggcaacagacgcaccgccaacacctctagagttcacctcagctcatccacaaaaaggttagagcgttgttacgacccatgggcggccaataggcgaccaagtccaaagtcaaaagcaagcaaagtactaggttcgtga

SEQ ID NO: 43779 - DNA, 258 bp, Glycine max
  Peptide Sequence Number=SeqID_135464
atgctcaatggaacaccccggggcttctccatgacaagcacacgttgtgtttcgagtcgtattctcggagaaatggaggttgatgaaccttggctagggttatggctaccattgaattatcaagtagatatgggagcaagtcagcataggacaacggaatttggggtgaaccctacaggctttttgctgcaaaattcctttttgtttgtgtataaagggatggcctttgtggataactgggtagtgggtaaggaggag

SEQ ID NO: 43780 - DNA, 813 bp, Glycine max
  Peptide Sequence Number=SeqID_135465
gaattctacaccaacctctatgaccccgaggaaaaattgcctaagcaggtgagggtgagaggtcatcttattaaattagatgaggatacacttaatactttcttgaagaccccagttgttgtggaagagggggaatcactctgtgcttattccagatttgcactcctgaggcctgatcctcaggagttggctgctaagctttgtatctcggggaggggattcgagcttaatgctgatgggcagcccctaaagattttaaggaagaacatgaccaccttagctcagacatggagtgttctttccttctctaacttgattcccacctcccactcttctgatgtcactctagacagggccagactcatttatggcattattatgaagatggatatgaatgtagggggagttcagtctgactctagatcctgggagagcctgagtcctgccattaatttggcttatattaagaagaactgttggaatcttgatgatccaatagtaactttcaaaggacccaggaaggctagagggaagagatctgaggccccttccatagcaccattagaggcaccaacaccttcttcttctacacttccttcttcttcctccacagatatcccaatgattcctcctacacccacacagataccactaccagctcctctttctacaggtccagcaaattttgttttcactcctcagatgcttcactccatgctccagagcatccatagagggcagtccatcatcatgaaaagccttcagggcatgggcttgccctccattatgagcatggaggagtttgacacatag

SEQ ID NO: 43781 - DNA, 445 bp, Glycine max
  Peptide Sequence Number=SeqID_135466
gcttttcgtcttgcagatagcaaaaaagaatgtttatacggataactactcgggtatttttgcccgtcagcgtgactcaaaagtcagtatgacagatcttgtgagcgcggaagatgacgtaaatctccgcgtgtcaacgggcttgtcggccgcgattgacgaagggcttttcgtcttacagatagcaaaaaataatgtttatacggataaccactcgggtatttccgcccgtcagcgtgactcaaaagtcagtatgacagatcttgtgagcgcggaagatgacatagcaaaaaataatgtttatacggataaccactcgggtatttccgcccatcagcgtgactcaaaagtcagtatgacagatcttgtgaaggtggccaacaaaagcgaggctctttctcctacgtatcctccaatgaggaactcagacctacgtagttcttga

SEQ ID NO: 43782 - DNA, 93 bp, Glycine max
  Peptide Sequence Number=SeqID_135467
atggaacacgcatcccgcgagtcacgcgtcgccctcccgccgaagggaaatggccccaaggaagctttcctcaaagagatccaggaaggataa

SEQ ID NO: 43783 - DNA, 80 bp, Glycine max
  Peptide Sequence Number=SeqID_135468
atggcattaggggtcatagcagctcaccttggcgagctgttgcttcaacctgaagtaaccttgctcacccaggcaagctg

SEQ ID NO: 43784 - DNA, 1200 bp, Glycine max
  Peptide Sequence Number=SeqID_135469
catggggacaaatcaaaccggcaagaggttttaccaagtcaaggttaaaggcctagataccaccagcatcaaagaattagggcggttgatggaacctctccaaatgcaagctttccgcaagatttacggaaagatcttagagttgaccatagcagagatatccatagaagccattgcatcactcacccaatactacgaccagcctttgagatgcttcacgtacgaagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaatggcatagcgggcctaccacggaggtacctagaagacaaggtgaggggtatggccaatcaaggagattgggtcccgtttatggatgtattagctttgctaatttttggggtcgtcctctttccaaacgtggatggtttggtggacctagctgcaatcgacgctttccttgcataccaccatagcaaggaaagtgcgaaaagagtagcgcacggatcatctgttgcttgcccgctctctgtgtttggttggtttcacacctgttccagcaagacgcgaggcatccatgtccgctccagagccatcgctcggtacccaaacattccgctaataggaacgaggggttgtattaactacaatcccgcgctcgctataagacaactagggtaccccatgaggggagcaccgacggaagaaagcatgaaagatcaagaacttaggggcattcgtaacggcatcatcggtggttaccatgaatggctgaaagttcatatacgaggtttagattggctcgccaagttaaaagtcgtcagcgaagagagttttgaagcaccggaagaggacgaagaagtccaagctctcaaaagcgagttaggaaaggcgaaacttgccaaggagaagttcaagttggccgctacacacatccggaaggagtgtgccggattatgggaagagaatgcaactaccgcaagagcccttgaacaagaggccaagagggctcgcaaggaagagtatggccggaacaaatttcgcggagctttgtggggtagcaacaatgaactcaagctacgaagggaagagagggacca

SEQ ID NO: 43785 - DNA, 249 bp, Glycine max
  Peptide Sequence Number=SeqID_135470
atggaagaggcacgaggaggagctttggcttcgcagcaacattggtttcgtagacttcctgttcttgatgtaatcgagttacactggatggtatatggtcaagaaggattccaaaatcaaaaagttgttgcttcatccataagatttgtgcacaacaactaccggcagaaatatattccacttctgcagtggataaagcaacactattttgtttcttactgtgccaagaaactagagcagatccaatga

SEQ ID NO: 43786 - DNA, 369 bp, Glycine max
  Peptide Sequence Number=SeqID_135471
atgccgatctcccctgcaaaagtatcggttggtctgtgtcatcccgacataggtatggatcacacccacaagacacccagtggacccagaggagcccaacagggccctggggtttccagctcgggttacgggcctctgtcagtcatacagggtgcccgtcccccccagcaagggatcgcacccgcaagacacccagtggacccaaagaagtccaacagggtcctagggtttccagctctgattacgggcctctgccagttctacggagtgcccgtcgaccccagcaagttcatcaggccccctattaaccagactttcatcaagaaatactgcgcccccaggcaggcgcagggcgagacaccacaatag

SEQ ID NO: 43787 - DNA, 219 bp, Glycine max
  Peptide Sequence Number=SeqID_135472
atgagggacgagaagaggtcttcgtacgtcattgggagtggggtgaattctggaattggcttcgggggaaagttcctcattgcgttggaattgccgtccgggcgagccgtggttggagccggagcttggggggcctccctctggataggggcgggcgccttaggctgtactggcgctgaattggaggagttcccagcgcgagctaaaaagctcgaatga

SEQ ID NO: 43788 - DNA, 345 bp, Glycine max
  Peptide Sequence Number=SeqID_135473
atgatgatcacgacattgacctataaaaataggcgtatcacgaggccctttcgtctcgcgcgtttcggtgatgacggtgaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 43789 - DNA, 225 bp, Glycine max
  Peptide Sequence Number=SeqID_135474
atgcggagataccttatggttatcctcaccttttgtcagcttgaggcaagcgagcctgttgacacgttggtggaagctccattggagcttgtaggcctaggatcttcttcatcaatggattcctttgcttcttggaagataaatggcagcggaatggagaaggaagagagagaggagaagccacttcaaggagaagatgagtctagaagaagctcaccaccatag

SEQ ID NO: 43790 - DNA, 249 bp, Glycine max
  Peptide Sequence Number=SeqID_135475
atggaagctcttgagaatctcaaagggtcatcacttttcactcagaggtccattttaggcgcatcacatatagacacgctcgaaattgcacaagggaagctctcgagatattcaaagggtcaacactttaaactgggagctccgtttcaggcacatagtatatcgagacgcccgaaattgcacaacggaagctctagcaaaatcaaatggccattacttttaactcgggggtccgattcaggcgcataa

SEQ ID NO: 43791 - DNA, 360 bp, Glycine max
  Peptide Sequence Number=SeqID_135476
atggcagcgcaattcatccatgaccgagtggagatggagtgcctagagggagtttgggagaccctcgaaggcaatgaaccagcacgcacgcttcagcgcactgtggagttgatattacctacacctactccatatctactagtggagccagtccaagtgattgaggtgacgtcatctgaggaagaccttgaggagctacctcctaagcctgctgtggatgctcttgactttctagagggtgatgaggacccacttcctgaggtggattctcccgagaacatcatgtcggcatctaaggcagactctacggaggagagcggtcccggagggatagcgactagtggaggttcttcgtcatag

SEQ ID NO: 43792 - DNA, 264 bp, Glycine max
  Peptide Sequence Number=SeqID_135477
atggatagaggactccaagtagatgggccagagatgcaagagaagacccttaaggcgagcgaggcgaggctcacaggtgcgttttccaaaggaggaaaatgcgcggagtcgccaccaacgaaggtcgacaaaagcggggctcttgctcctacgtaccctccatcgaagaggaaatcagacctacgtagttcttttttaaggaacagcccccttcggcctatttataggaaaaagggggaggaggttgccgcccagctcgcccag

SEQ ID NO: 43793 - DNA, 270 bp, Glycine max
  Peptide Sequence Number=SeqID_135478
atgtcattgcctagcgctgttcatgtgtcctccacctttgagtctggagccccgcgaatgtcattgcctagcgctcttcgccaattctccattctccacctttatttggagacccatgaatgtcattgcctagcgctgttcatgtgtcctccattatcaagcgcggagcctctgcaaaaaagaaggagtagagatgagaatcgtcatcacggaaagggcaggacggacgaaatcagtgtcttatctttgctttcctcttatctccgatga

SEQ ID NO: 43794 - DNA, 463 bp, Glycine max
  Peptide Sequence Number=SeqID_135479
gttgtaccatctatggtgaggctcatgaaacaggccaatgtattcctattgaagaaaacactcaagaatttcactatatgggaaatcaacaaagacaaggatatactcaaggaggattctcaggcttccagcaaggtccttataaccaacaaggacagtggagatcacaccctggcaaacaattcaacaaggactagggtggaccttccaacaggccaattcaacaaggcactgaaaaaccttgaggtccaggtgggacaactggccaagcacatagctgacaagtcatctaacagttttgtggcgaatacagaaaagaatcccaaggaggaatgcaaagctatgatgacaaggagtaagaggtttgtggaggcggaggatgaggacagtgttgtcatgcccaagaagaaagctgctgaaaagaaaagtactgatgataagaaaaatgatgtgagaggtgaag

SEQ ID NO: 43795 - DNA, 93 bp, Glycine max
  Peptide Sequence Number=SeqID_135480
atggagtcgtttgatgctcatgcacggtgcccctcattgccccagtgtaaggctttgaggtaccaatcgttgcctttcgtcatgaccttgtag

SEQ ID NO: 43796 - DNA, 363 bp, Glycine max
  Peptide Sequence Number=SeqID_135481
gtcgactctagaggatccccgtcttcaaaggccaagtggaaggaaaaagaggaaaaggattcctccaagaagattgttaagaaggaaaatcattttgcaacaaaaggtgatatcaaaagagcaatccttcttaaacaatctttctaccttctcctatcaagggaaacatcctttagcactgtcatacttcttgagcttgagtttattcctcaagtaaaggagttgttagatgagggtttggttcgtgttgcaggaagaagcccagagtttcaagaatctctggatttgaggtcaaatccttttcaagggggagggaatgatgcaatcctacccccaagggcattggataagtttgagacttag

SEQ ID NO: 43797 - DNA, 412 bp, Glycine max
  Peptide Sequence Number=SeqID_135482
agtcacgagatgctatcttgatgaacaaaggtttacatctatacctaggccaaaggacatgaattccatgtcgaaagtctcagttaatattgaggatatgccttcaactagtactgaaactagaaagatatcgagagtaagaaaggactgttgttacacttgctgctatccacaatctgatgattcaccaaatggatgtgaaaactgtcattcgggtttaaatggtgaattggatgaagagatatacatgaaacaacctgaaggggctgtagtcaggcttacagaacctaaaaggaaaaccataggtgaaagaggtatagattgcatatttattggatatgctgaacattctaaagcatatagattctatgtgctagaatctaatgattctgttgctgtgactcggttatag

SEQ ID NO: 43798 - DNA, 891 bp, Glycine max
  Peptide Sequence Number=SeqID_135483
atgacggagagggagatgatcacaattatggtagatacgttacccacgttctactatgaaaagctgataggctacatgccagctaactttgtggatctcgtcttcgccggagaaaggattgaatccggattacgaaaaggcaagttcgaatatgctgccaatatggcccccaacaacaacagaagagcctcagtagtgggcgcaaggaaaaaggaaggagacgcccacgcggtcaccaccgccccaacatggatgaaagcaccccaaaatatccaaagctcataccagcccaatcccccaaattttttaatccgagccgggaattccctcccgactcaagtgaaaggaccacccgcagcagaaagagcgccggcccaacgcacagctccagccgcactccggccagttaataatgacagcccccggcgtgacctatggatatgcacagcacccgaaagacaacttccctcctattcccatggcatattccgagttatggccttcattattggagaatcacttggtggtggccatacccgggaaggttctccagccaccctaccccaagtggaagaaggcccaaatgttaaaatcaacccgctagctagtcatggaggtgctagcgtgaacgccatcgaagaggacgggccgtcacggacaaagaggataggagacgtggctacttctagacgcttcatctatcaatcactgcaagcggcgtgcatggtctcccgaggtggagatgaaagggatgaatgtttgtttcacctcggggagtcgcatgacatggaaacctgtctcgtggtggaagaattgcttcagcggctcatggattgcgggcagcttgaagtgttcataggagggaaggaagaaccacaaatttgcatgtag

SEQ ID NO: 43799 - DNA, 270 bp, Glycine max
  Peptide Sequence Number=SeqID_135484
atgtaccctcccttgttctctttgaacctagtggatgtaccctccactagaactgatccacaagagatgtaccctctcttgttctcagtcaacaacccaagtgttagtcctttgacacttttgtataagggatggaagaatcaaaagattctcagactgtgtcgttttgaattcttgacaagggagaagggagacacaagattcaggcggttagtccttcgttcttttgaaaagggagaagagagacagaaaaataattcaggcggttag

SEQ ID NO: 43800 - DNA, 49 bp, Glycine max
  Peptide Sequence Number=SeqID_135485
gtaccaattgttgtctttcgtcatgaccttgtagatgggaacctatcgg

SEQ ID NO: 43801 - DNA, 423 bp, Glycine max
  Peptide Sequence Number=SeqID_135486
atgactaggggtaatccatctgacttacaaccctttgatcctgagatagataggacatttcatagattagttaggcatcattttgtaccttttgagcatcctgagcattctattattggtgagtctgagcattttgtggttggtaattttgaacatcctgattttgagcattatagttttgaacattctgagaatatggcacaacctcctccccgtgagaggaccctaagggaaatggctgcacctgatttcacctacgaaagcttatgcatccaataccctgatgaggatgtcccatatgttcttaaaactggactgatccatttgcttccaaagtttcatggccttgcagagggagtggcaaaggactggctatattaccttgctccaaagtccattacaagctgggatgacctcaagaga

SEQ ID NO: 43802 - DNA, 150 bp, Glycine max
  Peptide Sequence Number=SeqID_135487
attcgccctcattctgaatggatctctagagcttccaaggctgttagccagagcctaggccatggcagatgtatacccagctctcgaggaagttcatgggcttttcgattactgccaacatatggtcgagttgatgtcccacataattag

SEQ ID NO: 43803 - DNA, 198 bp, Glycine max
  Peptide Sequence Number=SeqID_135488
atggagtcgccatctgtcgcaacctaccctacgacgggagtgcgggcaaaaagccaaatgagcgtcttccaaaaggaaaaatgcgtgggagttgccaccaacgtttatttaagggaaaacgttagaaaaaccaaaaagagggtgtttcccttactcctacgtatcctcaggtgcaatgaggaattcagacctacgtag

SEQ ID NO: 43804 - DNA, 429 bp, Glycine max
  Peptide Sequence Number=SeqID_135489
atgggcgaaagcctgacggagcaatgccgcgtgaaggtagaaggcctacgggtcatgaacttcttttcccggagaagaagcaatgacgcagccgcggtaagacagaggatgcaagcgttatccggaatgattgggcgtaaagcgtctgtaggtggctttttaagttcgccgtcaaatcccagggctcaaccctggacaggcggtggaaactaccaagctggagtacgataccccagtagtcctagccgtaaacgatggatactaggcgctgtgcgtatcgacccgtgcaatgctgtagctaacgcgttaagtatcccgcctggggagtacgttcgcaagaatgaactcaaggaattgacgggggcccgcacaagcggtggagcatgtggtttaattcgatgcaaagcgaagaaccttaccagggcttga

SEQ ID NO: 43805 - DNA, 285 bp, Glycine max
  Peptide Sequence Number=SeqID_135490
atgataacaaaagatgatgacaaaggtgatgacaaaaagctcaaaggtcaatcaaagaatgagttcaagatgttcaagatagaatcaagaacacttcaagattcaagaggaaagttgaattcaagagtcaagaatcaagattcaagagatcaaggttcaagactcaagattcaagaatcaagaaaaggctattcaagaatcaagaaaaagcttaatcaagataagtatgaaaaggtttttctaaaagttataactcttcaaaatgatcctcttgaccagacatga

SEQ ID NO: 43806 - DNA, 369 bp, Glycine max
  Peptide Sequence Number=SeqID_135491
atggagtttggttcggaaagatctggtcatgaagtcaaggatgagaagagaagtgaatctagtgttggagatgaagaaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 43807 - DNA, 537 bp, Glycine max
  Peptide Sequence Number=SeqID_135492
atggaaaaaggtgggctacacaccttcaaagctttgaggatttggtctttgccagtcgaaaggatcgatgtgggtctgaaaaaaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaaccataaccctagccaaggttcatcaacctccatttatccgagaatacgactcgaacgcaacgtgtgcttgtcacggagaagccccggggcgttccattgagcatggtagggctctgaagcgtaaggtgcaaggtctaattgatacgggctggctgaaatttgaggagaattgcgtgtaa

SEQ ID NO: 43808 - DNA, 372 bp, Glycine max
  Peptide Sequence Number=SeqID_135493
atgggagtttttgcaaaagaggacaagaactcaaggggcacccacgtgcaaggtttggattggcttccaagtttgagaaccgctaaaagagaggaagtggaggcaccggaggaagacgaagaggtgcaggcccttagggcggaactcgaacaagcccaaacagttaaagaaaggttcaaatcagcagctctgaaaatccaaaaggagaataccgaactgagagatgtaaatgtggctaccaccaaagccttggaacgagaaaccaagagggcttgtagggaagaacacggccggaacaaattccgaggggctctgtgggtagcaacagtgagcttaaactctgaagagaggaaaaggaccaatcacgagtag

SEQ ID NO: 43809 - DNA, 300 bp, Glycine max
  Peptide Sequence Number=SeqID_135494
atgacccagggtgagaatgtcaatccttatcctcggaagcaaaaagaagagaagaaaaatttccaatcaaagagaaagcaaaaaaagaagagaaggaaaatttccaatcaaagagaaagcaaaaaaaagggaaaggaaattcccaatcaaagagtgggagaaagcaaaaagaaaagaaagaaaattcccaaccaaaaaatgggagaaagtaaaaaaaggaaggaaagaaagctcctgatcaaggatcgaaagaaaccagaagaaatatgcagaaaggtctttggaccagacaatatctga

SEQ ID NO: 43810 - DNA, 711 bp, Glycine max
  misc_feature (664)..(664): n is a, c, g, or t
  Peptide Sequence Number=SeqID_135495
atggccccgaggaagcttgcctcaagaggtccaggaaggacaaggcggccgaaggaactagttccgctccggagtacgacagtcaccgctttaggagcgctgtacaccagcagcgcttcgaagccatcaagggatggtcgtttctccgggagcgatgcgtccagctcagggacgacgagtatactgatttcaggaggaaatagggcgccggcggtgggcaccactgaggagggcgtgcgtgacatgagatcctgggttaggggtcagtggatcccgttcgatgccgacgctatcagccagctcctgggatatccgatggtgttagaagagggccaggagtgcgagtatggccagaggaggaaccggtctgatgggttcgatgaggaggccatcgcccagttgctatgtataccggggcaggattttgcccggactgctgccggaagacgggtgcggatcatgcgcaccaacatgaccaccgtgactcagatatggatgactctgctgctcagcaacatcctgcccaccgatcataattccgacctccccatgccgaagtgccagctggtgtacgccatcctgacagggctccgcttagcatttacggagctggggcatttgacatggagcagtatttacggcatttggttcgccagcaggcggncaaccaccgagcacatgtacggacccatgactgtctgtaccagatga

SEQ ID NO: 43811 - DNA, 450 bp, Glycine max
  Peptide Sequence Number=SeqID_135496
atggcaaggacatatagtcctctaaaggtgataggtactagtacccaagggtccaccgttatgagaagcaagagatcgactcatcgagagggccggtcatccaacaagattggacacgaaatattgactgtccttttgaaaaaggtgataattcatgcaaccctatcctatcttttgcaaatctctccgggaactccctcaaagtgtgatgcaagctccattggagcttgtaggcctaggatcttcttcatcaatggattcctttgcttcttggaagatgaatggcagcagaatggagaaagggagagagagaggagacgccacttcaaggagaagataagtctagaagaagctcaccaccataggaggccatggataagagcttgtaggaagaaggagatgaatgaagggagagggagagaagagcacgaaattttgtgctctaaatga

SEQ ID NO: 43812 - DNA, 352 bp, Glycine max
  Peptide Sequence Number=SeqID_135497
atggaggccgacatggaggccatgaaagagcaaatggccgcaatgatggaggccatgatgagcgtgaagaagataatggaagccgatgcggttgcaattgccgctaccagcgttgttgctaaggtgaacccgacgtccccatccggcatcaaccaaatgaatcatccaacctcagatatggccactgaagggcaagcagttggtgatatacccctgcaaaacactttggagggccctcagtatcacccacgaccacaccccttgcattccacagcgattaaaaaccctcatgctatggcggaaatgggaaaggtggatcatctaaaggaaaggcccagggccattgaaggag

SEQ ID NO: 43813 - DNA, 348 bp, Glycine max
  Peptide Sequence Number=SeqID_135498
atgcgcacaactctttcactcctcaagtggatttatatagtgaacaacaacgatctcatcagttttcctctcaacatcaaaggaattctcaaaccttcacgtcaactgggagaggatttcaagatcaacaacccaagagccaaaataaaaaaaccaactcaatctgatgatatacctcaagcacttgcagcccttaccttagacaacacaattgctgaaacaaaatggacctctgacaccgaggcctctaatcacatgataagtaaagctagtatgttgagtaatatccaacaatattcaggaacgagaaacagggaaaccgattatcaccgggaggtgcaagggtga

SEQ ID NO: 43814 - DNA, 497 bp, Glycine max
  Peptide Sequence Number=SeqID_135499
agccggcgggcccgatgatacgcggagataccttacggttatccgcacccttttgtcatccagaggcggcgggcccgatggcaagcagagaccaaagaccaagtttggtcattctgcacccttgtatcatccagaggcggcgggcccgatgacaagcagagaccaagtttggtcattctgcacccttgtatcatccagaggcggcgggcccgatgatacacggagataccttacggttattcgcacccttttgtcatccagaggcggcgggcccgatgacaagcagagaccaaagaccaagtttggtcattctgcacccttgtatcatccagaggcggcgggcccgatgatacgcggagataccttacggttatccgcacccttttgtcatccagaggcggcagggcccgatgacaagcagagaccaaaggcggcgcttgatagcatgcagaggctgatacagtcttctgcaccttttgttcctccgggaacaacaa

SEQ ID NO: 43815 - DNA, 489 bp, Glycine max
  Peptide Sequence Number=SeqID_135500
atggcgcctaccaggcaccctctggacccagataagtccaacagggccctgggatttcccgccttgatcacaggactctgccagtcgttcggcgtccccgtcgcacctagcaaggtgattcggccgcccatcacccgagcttttattgagaagtactgcacgcagagacaggtccagggtgatgcaccacaggccgcggacgcgccaccacctcatcaggctggtctagccggatcgtttgatacggagcagtatttgcggcatttgatgagtctcagcctgcagagccagggctttacttcttttccgtgccctactccggaccagttcagggcagaggtcgcatggcctggagattggcctgaggcccaggcaggagaggcaccagcaggggcaccagcagaggctcccgacgaggcagatgaggcccgcgaggacaaagagatgaatgatttacttgatttcttaggagggagcggggccacatga

SEQ ID NO: 43816 - DNA, 480 bp, Glycine max
  Peptide Sequence Number=SeqID_135501
atggcatccaggaaaaggaaaagcgccacttccaggcctcaagctcagtatgataccaagagattccaatccttggaagcctggaaccgatacacagataacattctggactggaggatccttccggaaaagaatgttaagatctatcataccgaatttgacgagtttaaggcagagatggagaggcgtaacttacacaaacgcctcgccaatctccaagatggaagcatagatgtagctgtggtgaaggagttttatgctaacttatacagcccggaagaccagacccctaaacaagtgagggtaagaagacatttaatcaagattgatgctgacagcctgaataccttcttagagacccctgtagttttggaggaagggccatccttggaagcttctgaggaaagatctcaccactcttgcacagacatggagtgttttctcctacaacaacctgactcccacttcccacacctctga

SEQ ID NO: 43817 - DNA, 213 bp, Glycine max
  Peptide Sequence Number=SeqID_135502
atggtaaccataatcccagcaaagattcctcaacctccattttcccaaggatacaactcgaatgcaacatgtgcttatcatggaggtgttccggggcatttcattgagcattgtgtgaccttgaaacataagttgacctgcactcttgagttgatctccaagtttgttcaatcagaaattgctcgttctacacgtttggtgggggtgccataa

SEQ ID NO: 43818 - DNA, 700 bp, Glycine max
  Peptide Sequence Number=SeqID_135503
ttcagagggctacacgccctcgccatcagaaggactgcatgtcctcaccttcagagggttacacgccctcgccatcagaggactgcatgtcctcaccttcgtagggctacacgccctcacctttagaggactacacgtcctcgccaacagagggctgcacgccttcaccttgagaggactacacgtcctcaccaacgtagggctacacgccctcacctttagaggactacacgtcctcgccaacagagggctgcacgccctcacctttagaggactacacatcctcgccttcagaggactccacgtcctcaccttgagaggactacacgtcctcaccttgagaggactaaacatcctcgccttgagaggactacatgtcctcaccatcagagggctgcacgccctcacctccagaggattacacgtccttgccttgagaggaccacacgtcctcaccatcagagggctacacgccctcacctccagaggactacacgtcttcaccttgagagggctacgtcccctcgccttggggctacacgccctcacctttagaggaccacacgtcctcaccttcagagggctacacgccctcgccatcagaggactgcatgtcctcgccttcgtagggctacacgccctcacctttagaggactacacgtcctcgtccaacagagggctacacgccctcacctttag

SEQ ID NO: 43819 - DNA, 420 bp, Glycine max
  Peptide Sequence Number=SeqID_135504
atgaaggaaggcataggtcacatcttagattggaaaataagggtagagcaacaacttaaaaggaagtctacttcaaaatcttatggctatcactcttatccaaagaaataccaacgtcaaggcatcttaggggtgacaccttctaagcccaatgatgataaggagaagacaatagaaaagcaactcattaaggctagtatgcaagagaagactagctccatgaagtgctttaaatgtcttggaagaggacacattacttctcaatgccccaccaagaaaaccatgattatatggggccaagacatttatagtagccaagatgaggctactacttcaccttcctctagtaaaagtgaagaacaaaaggggaagaatctagtgaagagatctagccccaatgaagaaggacaagctttaatg

SEQ ID NO: 43820 - DNA, 125 bp, Glycine max
  Peptide Sequence Number=SeqID_135505
atggaccttccggcttcccgtgacaaagggcgagaccaacatacaatgcatgctagagataaaatgtgtctgccattgccttggccttggctaacaagtggggaagttcttgactcccgttcaag

SEQ ID NO: 43821 - DNA, 216 bp, Glycine max
  Peptide Sequence Number=SeqID_135506
atgggatcaagtcaaaagccttcgcttaaaaagaggttttatcaagtcaaaatcaagagcttagaggtcactagtttacgagagttggggcaattaatgggtcaacttcaacggcaagccttccgcaaagcctatggtaagatttgggacctagctagggtagaagtctcccatggaaccaattgcctccctcgcccagtattggggatcctctag

SEQ ID NO: 43822 - DNA, 1251 bp, Glycine max
  Peptide Sequence Number=SeqID_135507
atggccccgaggaagcttgcctcaaagagtcccaggaaggacaaggcggtcgaaggaactagttccgctcctgagtatgacagtcaccgctttaggagcgctgtacaccagcagcgcttcgaggccatcaagggatggtcatttctccgggagcgacgcgtccagctcagggatgacgagtatactgatttccaggaggagataggtcgccagcggtgggcatcactggttacccccatggccaagttcgatccagaagtagtccttgagttttatgccaatgcttggccaacagaggagggcgtgcgtgacatgaggtcctgggtgaggggtcagtggatcccgtttgatgcagatgctatcggccagctcctgggatatccgttggtgctggaagagggccaggagtgcgagtatgaccagaggaggaaccagtctgatgggttcgatgaggaggccatcgcccaattgctatgtataccggggcaggattttgcccggactgctgcagggaggcgagtgcgaattatgcgcaccaacatgaccaccttgactcagatatggatgactttgctgctcagcaacatcctgccaaccgaccataattccaacctccccctgccgaagtgtcagctggtgtacgccatcctgacgcggatgagcatccatgtggctcagttaatcgctgatgccatctatatttttgcaggtatggcgcctaccaggcaccctttggatccagataagtccaacagggccctgggatttcccgcgctgatcacaggactctgccagtcgttcggagtccccgtggcacctaccaaggtgattcggccgcccatcacccgggcttttattgagaagtactgcacccagagacaggctcagggggatgctccacaggccgcgggcgcaccaccaccacctcatcaggctggcccggctaggtcatttgcatggagcagtatttacaaacatttggttcgccagcaggcggccaaccaccgggcacatgtacaaacccatgattgtctgtaccagatgagcctcagcatgcagagccagggcttcgcttctttttcatgccctactccagaccagttcagggcagaggtcgcatggcccggggattggcctgaggtccaagcaggagaggcacccccggaagttcccggcgatggagaggaggcccacgaggacgaggagatggccgatttgcttgacttcttgggaaggagtggagctacatga

SEQ ID NO: 43823 - DNA, 624 bp, Glycine max
  Peptide Sequence Number=SeqID_135508
atgacggggatcaagggagccccgtatcagagacgtttggatgccctgactgtgactgacgtgtgctggatgccctatggtgagcaccggggagtcagggcctttgacttgatatcgtcgtacaccggccagcttatatggggtcagattgtggtgtacgttcgacctgagcgggttcttcgacagtttggctaccttcagacaatccctccgccgccgatttgtgattctttgacggaccatttggtgcctttaggggagctctgtgtagttcctggacaggtggcgctagactacatggagtggttttttcagatatcgcacccattcgtcacgcggactgaggagattgctgcgtcgagacatccgcctccccctcatcatggggagttcgtcgagccacccatccccgaggtttcagtcgcgaccgatctccctacgcattcagtggggatggctcaggatttaggagcgattgctgaggatttggagcgggtcatcaacctcaggatggtcactgagggcactgacttacatgacatcatgactcgttgtctgaggagagttagaggtgacgccgcagatggaagtcttaggccgcgccagagacaccgcatagattag

SEQ ID NO: 43824 - DNA, 79 bp, Glycine max
  Peptide Sequence Number=SeqID_135509
atgacgggagatgcatcaaaatttactcatacatctcccaagaaaagtggacatgtgacttatggagacaacaacaaag

SEQ ID NO: 43825 - DNA, 861 bp, Glycine max
  Peptide Sequence Number=SeqID_135510
gggagcaccgacggaagaaagcatgtctcctttcctggtgagggatctcggcgcacaaaattccgagactatacaaagaatccataaggcatgggaaacctcgttaaggaaagatcaagagcttagaggcattcgtaatggcatcattggtggggaccacgaatggctgaaagttcgcatactaggtttaaattggctcgccaagttaaaagtcgtcagtgaagagaattttgaagcaccggaagaggacgaagaactccaaactctcaaaagcgagttaggaaaggcaaaacttgccaaggagaagttcaagttggccgctacacacgttcggaaggagtgtgccgggttacgggaagagaatgcaattactgcaagagcccttgaacaagagaccaagagggctcgcaaggaagagtatggccggaacaaatttcgcggagctctatggggtagcaatagtgaactcaagttgcgaagggaagaaagagaccagtcgcgagcacatagcatggttctgaaagaggagttaattgcttgttcaaggtccaaaagaagcttgtctcagcatttatgcgagacagagaccaacatgctagctatcatcgccaagtaccaagaagagttaggtctagccatggcccacgagcatagaatcgcggatgagtatgctcaagtatatgcggaaaagaggctagaggaaggtgatcgactctttacaccaagaggcaaccatgtggatggaccgatttgctcttactttgaacaggagtcaagaacttccccgattgctagccaaggccaaagcaatggcggacacctactctgcccccaagaagatccacggacttctcagctatt

SEQ ID NO: 43826 - DNA, 624 bp, Glycine max
  Peptide Sequence Number=SeqID_135511
atggcagtaaccaatacaataagcgcggtatcagccgcgttagcgctgatgacctttcaggcgcaggcggtcaatgtgaccgtggcttatcagacgtcggcggaaccggccaaagtggcgcaggctgacaatacctttgccaaagagagcggtgccacggttgactggcgcaaattcgacagcggcgccagcgtcctgcgcgcgttagcctcgggcgatgtgcaaattggcaacatcggttccagcccgctggcggtggccgccacgcaacagctgccgattgaagctttcctgctggcttcacagctgggcaattctgaagcgctggtggtgaaaaaaggcatcagctcacccaaagatttgatcggcaaacgcattgctgttcccttcatctccaccacccattacagcctgctggctgcgctgaaacactggggcatcaaaccgacccaggtgcaactggttaatctgcagccaccggcgatcattgctgcctggcagcgcggtgatatcgacggcgcctatgtctgggcacccgccgtcaatgaactggagaaagacggcaaggtgctgaccgactcgtcgcaggtcgggcagtggggctcaccgacgctcgacgtctgg

SEQ ID NO: 43827 - DNA, 114 bp, Glycine max
  Peptide Sequence Number=SeqID_135512
atggagaaaaatgaagaaacaacaacggaggagaaggccttggatcttcttcatcaatggagtcctttgcttcttgaagatcatggcagtggaatggagaaggaagaaagatga

SEQ ID NO: 43828 - DNA, 219 bp, Glycine max
  Peptide Sequence Number=SeqID_135513
aaggctgttgcttctggaggaagcaaccctgctcgcctggtcgagctggacggcaaccacctcccctattttgctataaataggggaggaagggaagaaggaagggccgaggcgcttccgagacgtttccataacgttttccgtgaggaatttcgcaaagatttcaaccgttcttcgacgttcttcattcgttcttcatcgttcttcgatcttcaacgg

SEQ ID NO: 43829 - DNA, 249 bp, Glycine max
  Peptide Sequence Number=SeqID_135514
caccctgtaggactgatagaggcccgtaaccagagctggaaaccccagggccctgttggacttttccgggtccactggggggagattggcattgcggtcgctgggcagaatgcacgggtgaaatcttgccccggtatgcatagtagctgtgttatagcctccctctctggttgtcctcgcacagttggccctcctccaatatcagggggtggcccaggaaccgttaaaaggaaactactggccccttaa

SEQ ID NO: 43830 - DNA, 453 bp, Glycine max
  Peptide Sequence Number=SeqID_135515
atgacattgctacttagcaacattctgcccagtgaccgcattgccaatctccccctgcaaaagtatcagttggtctgtgtcgtcccgacatggggatcgcacccacaaagacacccagtggacctgaagaagtccaacagggccctggggtttccagctctggttacgggcctctgtcggccctatagggcgcccgtccccccagcaagttcatgtcgtcgtggcatagggattgcgcccgcaggacacccggtggacccaaagaagtccaacagggtcctggggtttccagctctgattacgggcctctgtcagttctacggagtgcccgtcgcccctacaaggtcattaggccccgcattaaccgggctttcatcaagaagtactgcgcccccaggcaggcgcagggcaaaacaccacatcagcattgggatggccggtagcgggcaatag

SEQ ID NO: 43831 - DNA, 297 bp, Glycine max
  Peptide Sequence Number=SeqID_135516
atgacttatctttcatctctggaagtggcatccctctccgtcaacaatcatgtatcaaacgttccgcccctttgtgcggacttggttcacggtgcaaaggacaaacaactcagggttaaggaacctgtcaggactcatctaatatgtaatccttctagacctttggtgactcatctaatctgcaatccttccattatgcattgcatattgtcataccctaatttcgtccggggacctttgcttgatgacatgcgacctttctttggtccttgtgaggtgcttggcatccatcattag

SEQ ID NO: 43832 - DNA, 387 bp, Glycine max
  Peptide Sequence Number=SeqID_135517
atgtacgtagcatttgccaatcattatggtggatatgacaaagtggggtttattaggaaagatatttacaatcaagaagtgcacatgagaaagcaacatacctcttatgcaagtggtgcattgaagtatttacatgatttacgcacaaaagatccaatgatgtatgtttcatgcaccgcggatgaaggctcaagactacaacgattgttttggtgtgatgctgagagacaattgctttatgagtcctcaagcaacccacttgagattttccactctctttgtaaaaatccttttacaaagtctgaatcacacagggacaacccttcccttgtgttcaagaatccttacaacttaagagaccctcggtcccttaatcaatctctttga

SEQ ID NO: 43833 - DNA, 381 bp, Glycine max
  Peptide Sequence Number=SeqID_135518
atgcatttgccaaatcattatggtggatatgacaaagtggggtttattaggaaagatatttacaatcaagaagtgcacatgagaaagcaacatacctcttatgcaagtggtgcattgaagtatttacatgatttacgcacaaaagatccaatgatgtatgtttcatgcaccgcggatgaaggctcaagactacaacgattgttttggtgtgatgctgagagacaattgctttatgagtcctcaagcaacccacttgagattttccactctctttgtaaaaatccttttacaaagtctgaatcacacagggacaacccttcccttgtgttcaagaatccttacaacttaagagaccctcggtcccttaatcaatctctttga

SEQ ID NO: 43834 - DNA, 219 bp, Glycine max
  Peptide Sequence Number=SeqID_135519
atgaagatcctccagaagaagtcaaatccaatgatgaacattccaaaagaatggaaagcttcaaaagatcatccccttgacaaccttattggtgatatctcaaaagggaacatggttattgaacacaatttttctgcacctaggacccctcaacaaaatggagttgttgagaggaaaaataggtcattggaagaaattgctagaactttgattaaatga

SEQ ID NO: 43835 - DNA, 381 bp, Glycine max
  Peptide Sequence Number=SeqID_135520
atgagtcttcattcttcatctagtgttaatggtgagggttctactcctaaggacccctttagtcataactcttgcaagagcctaagtgaagaacttcgtgactattatgaaggcaggaataagtcacatcttagacctcactctcataggagagaaaatgaaagaaagcctcaagaggctaacattaacctcccatacttccatgggaaggacaatgtagaggcttacttagattgggaaataaggatagagcaaaaacttaaaagaaagcctactttaaaatcttatggatctcattattatccaaagaaagaccaaggtctaggcatcttaggggcaacaccttctaagcccaaagatgataaggggaagacaatataa

SEQ ID NO: 43836 - DNA, 963 bp, Glycine max
  Peptide Sequence Number=SeqID_135521
atggatatattagcattgttaatctttggggttgtcctctttccaaacgtggatggtttggtggacctagccgcaattgatgctttccttgcatatcaccatagcaaagaaagcctggtggtagctgtcttggcagacttatttgacacatttgatcgaaggtgcgaaaaaagtagtgcacggatcatctgttgtttacccgctctttgtgtatggttggtttcacacttattccaacaagacataaggcatccatgtccgctccaaagccatcgctcatgtgtcgagaaaagaagagtagattgggaccaacacttggaagggataggaggcagaacagtcaattggtttccacgatggaaagaaggaaaggagggtgttctcttctcatgtgggggctacccaaacatcccgttgataggaacgagaggttgcattaactataatccctcacttgctataagacagttagggtaccccatgaggggagcaccgacggaagaaagcctatctcttttccttgtgagagattttggcgcgcaaaatttcaaggttatacaaagagtccataaggcgtgggacagcccattaaggaaagataaagaacttaggggcatttgtaatggcatcattggtggttatcatgaatggctgaaagttcgtacacggggtttaggttggctcaccaagttaaagattatcagcgaagagaatttcgaagctccggaagaagatgaagaagttcgggctctgaaaaccgaactaggaaaagcgagacttgctaaagaaaaattcaagttagtcgctatagacgtccggaaagagtgtgtcgggttacgagaagagaatgcagctactgcaaaagcccttgaacaagaaaccaagagggctcgcaaggaagagcatggctgtgacaaattccgtggagcattgtggggcagcaatagtgagctcaagctttga

SEQ ID NO: 43837 - DNA, 402 bp, Glycine max
  misc_feature (5)..(5): n is a, c, g, or t
  Peptide Sequence Number=SeqID_135522
atgcnattaccgcaagagcccttgaacgagagaccaagagggctcgcaaggaagagtatggccggaacaaatttcgcggagctctatgggctatcatcgccaaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattattagccaatgccaatgcgatggcagacacctactccgcccccgaagagattcatgggcttctcggctattgtcagcatatgatagacttaatgacccacataattagaaatcgttag

SEQ ID NO: 43838 - DNA, 97 bp, Glycine max
  Peptide Sequence Number=SeqID_135523
atggcttctataggtatcatccccttcgaagaacatactgcagcagtagggactactagcaacaatatgttttcaaagagaaaaactctagatgagg

SEQ ID NO: 43839 - DNA, 267 bp, Glycine max
  Peptide Sequence Number=SeqID_135524
atgagtattcttgcttctttcatctatctatttttctactctgctttacttgcactctctctctactctcacccacaggttttaccaccgcaaccagcgggtacaatcgctggtcataaccaattttcgtcacaccggcattgctcagtttgtgcagtttccaactctgaacacgtgctccaccagagagactctgaatttgggtccaacaccgcattgaaagtcatcgttgtgactcacaatgcccagtgcggcatcaatctgtga

SEQ ID NO: 43840 - DNA, 375 bp, Glycine max
  Peptide Sequence Number=SeqID_135525
atgtttaacgctggcacattgtctatggaatttggtgatattgttgttcattttaacattcttgatgccatgaaacatccatctgaggatcattctatttttcgtcctgagataattgatcagattgttgatgattatatgtttgattttgttcttcatggaagtacatatacttctgactttctttatgaggtacaggctgaggaaccttcttcttctcctaccatagttcctcccactgttcagccaccacccacaccagagttgaagcccttaccagcaaacctcaaatatgcttacttggaggacaaggaaaaatttccagtggtcatctctgcctcccttgatgttgagcaagaggagaagttgttctag

SEQ ID NO: 43841 - DNA, 285 bp, Glycine max
  Peptide Sequence Number=SeqID_135526
atgacattgcaacttgttgatcgttcaattacaagaccctacagtgtggtggaggatgtgttggtcaagaaggttaccttcaatctattcgacgcaattaagcatcccaacgaccatagggcatgttttaagatggaggtagttgagcatgaggtggccatggtagttcaaggtatgacatctcaatctccattggagaaagcattgactaatgctgtggagtgccttacaaaggaagaagaaaaagatttaaagaggtgtctagaagagctggaggggttaaaa

SEQ ID NO: 43842 - DNA, 321 bp, Glycine max
  Peptide Sequence Number=SeqID_135527
atgggttctgtcttgatcccttgtgtaaacaaacgaacggagggtccatatcaccttcttaattgtacacatggggcactgcgcccccaaatgcgcaaaattgccattccttggattatagggttgaaccaagctcatgcttttataaaaaggttcatcaagtcaaaatatggaagtaaccgtcttgcaaaattggggcaaaagatgaatcgagtcacatcactgcttcgtctactgccaaacatatttaggattgttgatgtccttgttacttccattttcaccttgacaaagatgtcatggaccatgttgaaaatctaa

SEQ ID NO: 43843 - DNA, 261 bp, Glycine max
  Peptide Sequence Number=SeqID_135528
atgcctttgagatctctggatagactgtggctcgaggaatccatacacatcgatattcccggctcgcatacttgtctcagtcatatgcctattgttgttaacacaaaatatgctgagacattgaccaccgtgtgcaatttcagacagatcttcatgctttatgtacaaggggaagttttcattaaacaggtcaaacaaggtagcatcccacataacctacaatggcttcagaaaaagccgtgggatggtcaatgtcattag

SEQ ID NO: 43844 - DNA, 331 bp, Glycine max
  Peptide Sequence Number=SeqID_135529
atggccccaaggaagcttgcctcaaagagatccaggaaagacaaagcggctgaaggaaccaattccgctcccgaatatgacagccatcattttaggagcgctgagcaccagcagcgcttcgaggccatcaaaggatggtcattcctccgggagagacgcgtccaacttagggacgacgagtatactgacttccaggaagagatagtttgccggcggtgggcatcgctagttacccccatggccacgttcgacccagacatagtcctcgagttttatgccaatgcttggcctatagaggagggtgtgcgagatatgcgatcttgggtgaggg

SEQ ID NO: 43845 - DNA, 570 bp, Glycine max
  Peptide Sequence Number=SeqID_135530
atgattatgaggggccaagacatttatagtagccaagatgaggctactacttcaccttcctctagtgaaagtgaagaagtaaaatgggaagaatttagtgaagaaatctacccccaagaagaaggacaacctttaatggttaaggagaagtgtaaggaggtaagtgtctcctccaagaggttagctaagaaggaaagtcattttgcaataaagacaaacattaaagaaacttcccctcttagacaacctctacatcttctcctttgtaaaaagacactggtgagcactgccatacctcttgggcttgagattattcctcaactaaaggatttgttggatgagggtttggttcgtattatgaggcaccaaatccctatgataggtggtatgatgaatgtgttgagtggtgcaaccctcatttgtaaaatcacccatgcatccaacatcttcatgattcacatatatagggactcattagcaccactcattgagttggtgaggaaccatgttccctcatggaagatgcccaggaaatgggttttcagaccttaccttactccaacatactaa

SEQ ID NO: 43846 - DNA, 123 bp, Glycine max
  Peptide Sequence Number=SeqID_135531
atggatatggcatgggaattgccagacatgccaactgtttcttgcactgagccagttgatgaagacacaggagatcatatagaagacatgattcgtaatcttggacaagacagtttcgaacaa

SEQ ID NO: 43847 - DNA, 585 bp, Glycine max
  Peptide Sequence Number=SeqID_135532
atggtgtcaccacaagggaggaacacatggacagttgatgatctcatgccttacgtggaaaagttagcgattatatccgaagagcaagagagaatcattgagccagtgtcacatggtccaacatcagagcgtgaattctcagcacaagagtttcacattcttcagtcaagtgttgaaactcggggcataggcagacgaagggagcttgttgaagcggaacaatattcccaacaaatgatggagcgtggtcatggaatgtattacacgccagcaacattttcccaatatccttcacagatgtatcagtattcttttgaaggtcatcacactgatacttctgcgagcgaacattcgttcggtggtgttgcggaaacacagtctcatttttcatggcccactatgactccttcacagcaacacgatgccccaatggcaacacctaacgccccatttgctctgcaatggaatgtacccgaagcaatacctcatatgggcgacttattaggtgttgatttgcgtcaggagttttttgtagaggctgagcaagcagaagcgggagacaacgcggtgcagaagaaatcctga

SEQ ID NO: 43848 - DNA, 56 bp, Glycine max
  Peptide Sequence Number=SeqID_135533
atgagtgttgcgcttagcggacgctcgctaagccagctgattggcttagcgagaag

SEQ ID NO: 43849 - DNA, 228 bp, Glycine max
  Peptide Sequence Number=SeqID_135534
atggacgaagacgtgtgggagtcagtacatcttaacgtccatgggcgacaatggaatcctgtgaagcctgctcctccatggaatcctataaggaacacatttatttgtttactcaatcaaacaataaacataaataattgcaatttacaattgaaagtgacttacaatcttacaaatggacacaaattgaaaggagggttgcagattggtgacagaaaattcagctaa

SEQ ID NO: 43850 - DNA, 273 bp, Glycine max
  Peptide Sequence Number=SeqID_135535
atggtcattgaccagtcccttttctatgacttaaccaaattacccagtgacggtgtaccatttgaaggtacactgaatgacgactggaaatttgatttctctgcccatgatgcccgccagttggtttgcaccaacaatgcggatatgactggacgtcttcttgccaggtcattggcttttgaaagccgcatccttcactatttaattgtgcgtattttgcttccacggtcttccaaccttgcccagggcgtcaacttgaccaggcacacttag

SEQ ID NO: 43851 - DNA, 633 bp, Glycine max
  Peptide Sequence Number=SeqID_135536
atgtgtcacttttggggactttcagttagcaccaaccatagaggagttcgaagggatcttaggatgcccgctagggggaaggaagccataccttttttcctgattctatccttctatggaaagaatagcgaaagtggtcaagatctcggaacaaggataccaaggaaacgcttagaggagaaggcggaagctctagccaaccaaggagagtgggcaacattcatcgatctattagctctactagtgtttcggacagtactattcccaaatgtagacgggttagtagatctagcggtaatcgacgcctttcttgcttatcaccacagcaaggaaagcccgatcatcgctgttttggcagatgcatatgatacattcgacttgagatgcgagaagagcagtgcaagaattgtctgttgtatgcctgttcgttatgtatggttgagaatccgtaaagcatggaatagagtggaaagaaaagataaaggaggaggtgaagaagcagttcgacgctggtttcttggccgttgctcggtacccagaatgggtcaccaatatcgtgccggtcccgaaaaaggatgggaaggtgaaaatgtgtgtggactatcaggatctaaaccaagccagtccaaatga

SEQ ID NO: 43852 - DNA, 576 bp, Glycine max
  Peptide Sequence Number=SeqID_135537
gatgacattatttcttctgaggtgcatggtatttccatgatcattgatcaatctttgttcttttctttgactaaattacccagtcaaggtgcaccttttgagggcaccattgttgatgactggaaatttgattattctagtcatgatgcttgccgtatggcattacgggccaatgcacctctcccttaccctcaattggtcactctgtttctccgtcattttcaaattccacttgatgatgaacctttcattcaagtcaagcgttcctttgctattggtgctggtgcagtcacttcttttagataccgtaaggatcaggatggtcaatggctgaagaaagatgcacttcttccacaggatgagcgtactcctcttcctcctcctcagcgagatgattcagcctttatgactgaagttctttctgagttacgaggtcttcgtacttatgttggtgaacgttttgactctttggataatcgctttgccggaatggatatccgtctcacacagattgaagaagatgtgggttatattcatcagagcttctatcttccaccaccacctccaccttcttag

SEQ ID NO: 43853 - DNA, 309 bp, Glycine max
  Peptide Sequence Number=SeqID_135538
atggaagcatgtttagcagtagaggacctattgcaactgatgatagaccagggccggttggaagtcggcgatgaggggggtgaagagcagcacatatgcatgcagtctgcagatgaggaaggtcttagaaagcctaagcctttggtgatatatttcaccagagacgcagatccccaaatgccgcgatacccctcggtagttagacctattccgtttccataccaaaacagccacgcagttctgtggaggtatgcgcctccaagcgaaaggaaggaaaaagccaccgatatcaactcgttgtcggcaaag

SEQ ID NO: 43854 - DNA, 522 bp, Glycine max
  Peptide Sequence Number=SeqID_135539
atgaatgaaggagtgagtaaggaatcgagatcgatggtggataatggcctcgagaatctaggattgatcatgacgattagggagggctataacaatggtggggacatagaaaagtatttgaatcatgttatagtagttgaggtggatgttgatgctagttattcagagagagggtcagtggagtgccatgtcgatatggtagtcccaacatgtgagttttactttcggtcacaatatggggatgggctactgttggtttttgggccttatgataaagttcaagaaaaggcaaatggggagggtgcacatatgcaagacaactttttcaaaaaggcacacgaaggggattcatataatgtgatgcctttggccaagtgttatgtatcacaacaggggcaagtgtttgagttcatcaaattgttggaatcctcacacgtggatggaaacaaagtggcgcttagccttattcaaaggaaaacttacggaagcaaagtggcgcttagccgtataggtcaagcttag

SEQ ID NO: 43855 - DNA, 621 bp, Glycine max
  misc_feature (531)..(531): n is a, c, g, or t
  Peptide Sequence Number=SeqID_135540
atgggtgaccaagaggagacacaagaacagatgaaagccgacatgtcggctttgaaagagcaaattgcttccatgatggaagccatgttagggatgagaaaactcatggagaataacgtggccaccgctgccgccgttagtttggctgccgaagcaaacccaactctcccagctatagcacaccatcctctcccaaacgcggtaggacgagaaaggagcacactagggcacattagcaacccccatttgggatacaaccgggtggcttacccttatggactaccacctaattacacgccaacagtcatgcgtgatgacgtgggtcatgtcccttcccccgtccttgaaggggagcctcctcgacagtcagacgaggttcgcgaggatcatagagagtatgcccaagtagacgtcgatttctacctctcggtccccgtcgagggtccgacacccaacatactgcctcaacccaacctcccagcacagccaatattcttgtccacagagggaccacccccggtggcagaaganagaaggaaactcgatctcatcgaggagagattgagagctgttgaaggctttggcgactattcgttcgcgaacatggcggatctttgcttg

SEQ ID NO: 43856 - DNA, 99 bp, Glycine max
  Peptide Sequence Number=SeqID_135541
atgccccaagagaaggaccctagggttctaatgagcttaaggaggagtataaggggtgtgaggaaaaaagcccagagtttcaagaacctcgggatttga

SEQ ID NO: 43857 - DNA, 1005 bp, Glycine max
  Peptide Sequence Number=SeqID_135542
atgttgaatacgctgatcgttggtgccagtggttatgctggcgtagagcttgccacctacctgaatcgccacccgcatatgaacataaccgctttggcggtttcagcgcaaagcccggatgccggaaagttactctccgatctccatccgcagctgaaaggcagggtcgatttgccattgcagccgctgggtgatgccgcagagtgggccggcaaggtcgatgtggtgttcctcgccaccgcacacgaagtcagccacgatctggccccggaattcctgaaagccggctgcgtggtgttcgacctctcaggtgcgttccgcgttaacgacgacggcttttatcaacaatattacggtttcagccatcagcaccaggcgtggctcgacaaagccgtttacggcctggccgaatggaaccacgagcagattaaagacgcgcagctggtggcggtaccgggttgctatccgaccgccgcacagctggcgcttaagccgctgattaaggctggcctgcttaatccggctcagtggccggtcatcaatgccaccagcggcgtcagcggtgccggacgtaaagccagcgtcaccaccagcttctgtgaagtcagcctgcagccgtacggccttttcaatcaccgtcaccatccggagattgtggcccatctcggcacgccggtgatcttcacgccgcatctcggtaatttcccgcgcggcattctggaaaccatcacctgtcgtctgaacgccggcgtgagccagcaggatgtggcggcggcgttccacagcgcttaccacgataaaccactggtgcggctgtacgacaaaggcgtaccggcgctgaaagcggtggttggcctgccgttctgcgatatcggctttgccgtgcagggcgagcacctgattgttgccgcagcggaagacaacctgctgaaaggcgcctcctcacaggcggtgcagtgtctcaatattcgtttcggcttccccgaaacgctgtctctgatttaa

SEQ ID NO: 43858 - DNA, 333 bp, Glycine max
  misc_feature (64)..(64): n is a, c, g, or t
  misc_feature (114)..(114): n is a, c, g, or t
  Peptide Sequence Number=SeqID_135543
atgtaccctctacttctaccacaaaggatgtaccctccaatggtgttaagacaaagatatcagncggttaaacctttgatactttgtgaatggggatacaaaagaattctcagncggcggttagtcctttattcttttggaaaagggagaagagagacacaaaaagaattcaggcggttagtccttggcgaattctttttggcaaagggagaagagaatgaagagatgaatagcacaagttttcaaggtttagaaaaccagaaaactttggaaagcttttggcacaaagaagaagaagaagttcaaagagatttagggcttgtaaaagattga

SEQ ID NO: 43859 - DNA, 465 bp, Glycine max
  Peptide Sequence Number=SeqID_135544
atggaggccatgaaagagcaaatggccgccatgattgaggccatgtatatcatgaaggaaataatggaaagcaatgcagttgtagttgccactacaagcgccgccgctgaggtggacccgactcacccatcgggcctcaatcaagtaaatcctctagtcttggatatggtaggtcagggaagagaagcattgggaagtacaagcggtccccatgttgtgcagagcaagatttctttcctaccatacggcttgcctcccaactattcaccacccaatgctgtaccggtgcccaatgaggatgtcaataactctgcacccatacccattaagagtcaacaaccccaatctaatcatgcacatgtctctcaacccatgagggagacatatgaagcaccccgagaccacaatctagccgacgtcgaacctcacctcggatatgccactgaggggcaagcagttggttgt

SEQ ID NO: 43860 - DNA, 144 bp, Glycine max
  Peptide Sequence Number=SeqID_135545
atggagaactcaagaatcatcctcttgacatatcatcggagatatctcaaaagggattctttggaagatatgcataatcaagaaaggaatctaaaaaggaagagaaatgaagaaaacaaggatgttcaagatgacatagcctaa

SEQ ID NO: 43861 - DNA, 1083 bp, Glycine max
  Peptide Sequence Number=SeqID_135546
atggccccaaggaagcttgcctcaaagagatccaggaaagacaaagcggctgaaggaactagttctgctcccgaatatgacaaccatcattttaggagcgcggagcaccagcagcatttcgaggccatcaaaggatggtcattcctccgggagagacgcgtccagcttagggacgacaagtatactgactttcaggaagagatagttcgccggcggtgggcatcgctggttactcccatggacaagttcgacccagacatagtcctcgagttttatgctaatgcttggcctacagaggagggtgtgcgagatatgcgatcttgggtgaggggtcagtggatccctttcgatgcggatgccctcaaccagttcctgggatatcctttagtgctggaggagggccaggagtgcgagtatggtcagaggaggaatcaggctgatgggtttgatgaggaggccatcgcccagttgctgtgtataccggggcaggattttgcccggaccgctgccgggaggcgggtgcgaatcatgcgcaccaatatgactaccttgactcagacatggatgacgttgctgcttagcaacatcctacccagcgatcataattctgacctccccttgccgaagtgtcagctggtgtatgccattctgacatggatgagcgttcatgtggctcagttgatcgctgatgccatttatctatttgtaggtatgccgcctaccaggcaccttctggacccggataagtccaacagggtctgccagtcgtttggagtccccgtcgcacctagtaaggtgattcggccacccatcacccgatcttttattgagaagtattgcacgcagagacaggcacagggtggtgaccctcaggccccagatgcaccgcctccacctcctcaggctgacccagctgagtcatttgacacggagcggtatttacggcatttggttcgccagcaggcggccaaccacagggcgcacgtgcagacccatgactctctatatcagcttagcctcagcctgcagagccagggttttgcttcttttccatgccctactccggatcagttcaggagagag

SEQ ID NO: 43862 - DNA, 1297 bp, Glycine max
  Peptide Sequence Number=SeqID_135547
atggaacccctccaaatgcaagccttccgcaagacttacggaaagatcttagagttgaccatagcagaggtgtccatagaagccattgcatcacttacccaatactacgaccagcctttgaggtgtttcacattcgcagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaagacaagccgaggggtatggccaatcaaggagactgggtcccgtttatggatgtgttagctttgctaatttttggggtcgtcctctttccaaacgtggatggtttggtagacctagcagcaatcgacgctttccttgcctaccaccatagcaaggaaagtccggtggtagttgtcttggcagatctatttgacacgtttgaccgaaggtgcgaaaagagtagcgcacggatcatctgttgcttacccgccctctgtgaggtagaacaatcagttggttcccctcgatggaaggaaggaaaagaaggagtccttttctcatgtggaagatacccaaacattccgctggtaggaacgagaggttgtattaactacaatcccgcgctcgctataagacaactagggtaccctatgaggggagcaccgacggaagaaagcatgtctcctttccttatgagaggcattcgtaatggcatcattggtgggtaccacgaatggctgaaagttcatatacgaggtttagagtggctcgccaagttaaaagtcgtcagtgaagagaattttgaagcaccggaagaggacgaagaagtccaagctctcaaaagcgagttaggaaaggcaaaacttgccaaggagaagttcaagttggccgctacacacgttcagaaggagtgtgccgggttacgggaagagaatgcaatttccgcaagagcccttgaacaagagaccaagagggctcgcaaggaagagtatggccggaacaaatttcgtggagctctatggggtagcaatagtgaactcaagttgcgaagggaagaaagggaccagtcgcgagcacatagcatggttttgaaagaggagttagttgcctgttcaaggtccaaaagaagcttgtctcagcgtttatgcgagacagagaccaacatgctagctatcatcgccaagtaccaagaagagttag

SEQ ID NO: 43863 - DNA, 456 bp, Glycine max
  Peptide Sequence Number=SeqID_135548
ctttccgccgatgaggttgccgcgacgcgatccctgcgcggcagccgctacgattcaccggagcgcactagcctgccggtgatggagttccgccagcgtaaaacgctgtccgtctggctggccacgccgccgtgggatctgaaagggggcgagaccgttatgctgaagctgcaggttcgcagcacgcacggcatccgtcagatccactggctgggggatacgcaggcattgagcctgacgtcgccggccaaaagtaacagcgcagacggctggagcgtgattatacctgcctggaatgaacaggaaggtgcgacaaaccgctggcacctctcggcagtggtagaagatgagaaaggccagcgcgtctcgtccaatgagatcacgcttgctgtggtgcagccgctggtcgcattgcctgatgacgacccgcgctggaagctgctgccggaggagtaa

SEQ ID NO: 43864 - DNA, 234 bp, Glycine max
  Peptide Sequence Number=SeqID_135549
atgactcactataatccttaccctcgaaagcaaaaaaggaaagaaggaaaatttccaatcaaagagaaagcaaaaagaaaagaaaggaaattcccaatcaaagagtgggagaaagcaaaaagaaaagaaaggaaattcccaatcaaagagtgggagaaagcaaaaagaaaagaaagaaaattcccaaccaaagaatgggagaaagtaaaaaaaggaaggaaagaaagttcttga

SEQ ID NO: 43865 - DNA, 572 bp, Glycine max
  Peptide Sequence Number=SeqID_135550
cggatgccgggagcagacaagcccgtcagggcgcgtcagcgggtgttgacgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctcttcaatccatggacaccatcaacccaaccccaaatccccatcccctccctccctatgatccatcagagtatcacaacctgacacaacatcaatcagaaactagacaaaatggtaatgacaccaaccacaaaaaatcatcaaagaacaacaaccaggtcaaggaggagacctccaacaagcaccattatagttgccggtgggacccgtaa

SEQ ID NO: 43866 - DNA, 50 bp, Glycine max
  Peptide Sequence Number=SeqID_135551
aagaagctaacaaggctgcttcaaatgataagcatttgcttcaagaataa

SEQ ID NO: 43867 - DNA, 660 bp, Glycine max
  Peptide Sequence Number=SeqID_135552
atggtggaagaatttgaagagatcctaggatgtcttctagggggaaggagaccatacctcttctcagggttctatccctcattagctagaatttccaagatagaccaaatctcggcgcaggaattagaccacaggaagcaagtcgaaaatggggtggttggaataccgagaaaatatttggaggcaaaagcaagaatcttggcagcgatcgacgtttttctcacctatcataaccacaaggaaagcccggttgtcgctatgctagccgacctatatgacaccttcgaccgaagatgtgaagagagcaatgcaaggattgtttgttgtactccagctctttatgtatggttagtttcacacctttttcgccaagaggtgaggcatgcttgcccgctagaaagtcatcgttcatgcacagagaaaggaggggcaaattgggaccaactcttagcaagcaaagaagaagcatctgtcaactggttccctcgatggaaggaaggaagaaccggagttcttatttcatgcggaggatttccaaatgttcccttgatggtgatgaggggttgcatcagctacaatcccattcttgcaataagacaacttggctaccctatgagaggggcgccactagaggatgggctcgcgcctgtcatttcatga

SEQ ID NO: 43868 - DNA, 303 bp, Glycine max
  Peptide Sequence Number=SeqID_135553
atgtcgctggttgagtcatttgcctcacaagttcttcaagggaaggttgcagaggagcctcaactgtttgctgtttctggggctgttgctgttgttgctgctggattggtggaggaacgtatggattcaaccatcgaaggttgggatgattcctccacccgggattgtacctgttgcttgagaggtcataattgttctgttgtggctaattttgctgctgaggttgaggagattgttgcccagaggggcaaaggtctgtgtggtggtcgacagagggagctaaaccatagagtctggcgatag

SEQ ID NO: 43869 - DNA, 255 bp, Glycine max
  Peptide Sequence Number=SeqID_135554
atggtgccgtttcaggcgttgcagatgatcggccattgggtggacgccgtgtgtcccggcaaagccgtcggcgactacatcatgaccgcgatccacgattttgacggcgcgcaaacctacagcgagaaacccggccaccgtttcaccctgaacgccgacttcgccaccgccaaagaagagcactacgatgcgctcttgatccccggcggccgggcgccggaatacctgcgcctgaatcccgacgtgatcgcgctg

SEQ ID NO: 43870 - DNA, 162 bp, Glycine max
  Peptide Sequence Number=SeqID_135555
atggaggttgaggaaccttggttggggttatggctaccattgaattatcgagtggatatgggagtggcgttcgtgattggaagtgtggtagacaggggatcctctagagtcgacctgcaggcatgcaagcttggcactggccgtcgttttacaacgtcgtga

SEQ ID NO: 43871 - DNA, 178 bp, Glycine max
  Peptide Sequence Number=SeqID_135556
aggcagaatcgtcttaggcaacgatcagaggtcgagacaaggtcaaaggcagaaaccaatcaaggtacttagggacagacgcaaggagaggctagggtcacgaccaataggtcgtcatccttggcttagcccgggaccaacggaaagcgtcactgcgaagcaacccagtatcctttaa

SEQ ID NO: 43872 - DNA, 147 bp, Glycine max
  Peptide Sequence Number=SeqID_135557
atgaaaggcaccatgcatgagcctcaagcgaaactaggggcagatcagaagttcttacccggagtagagcgtaacccaaaaggtacaagcaacgctcttgaggttcttactcaatataaccctcaaacactctttgagcctctctaa

SEQ ID NO: 43873 - DNA, 1259 bp, Glycine max
  Peptide Sequence Number=SeqID_135558
accacgtcttttctggtttttccgacgttttcctcaaataaacgttggtggcgactccgcgcgtattcctttcttggaagatgcacccgcgagtaacgcatcgccctctcgccgaaggggtcatcaagatatacttaacacggccatagggagatcaaatcatggaggtcgtgttcgtgcagctgggtctggggcttggaaaaatgagttgaaggtttccatcattactgacatatttaagggagataaggtctcaacatcggctaattttgatttaaatttgttagctccacgcatgagcactaaggagagctatgttgaaattgctgtgaacccgtctggggaagaacatgttggtcgtgtaacaccgtctacggggttgtacgtccaaagtcaagattgtacaaagctggtggcattgcaaaaaatttatgatggaccctttaccatacattgcgtggtgtatgcagatgatgtcgtaagggttagcgtcaaaaaagtaattgatggtgaagctaaagtcccatttgcaacatcagaaattaagtatgtgagagaggcccttaacacattcattgcatggccattgcctttggtaaaactggtatcaaatgagcattctggcatgactccaaacaaagttgcaaaagttgccgaattaaacaatgatgttcctaaacaggaccccttgtgtgagttgattaagaccctcattaagatttatgacaagcctgttgagtttgtgtgggatcttactgaatttgggattccaaatgtaaattcatctttgttcttaatgtatactgatgtcagcgaaataacatcagacgataaatgcttgaacatagccatacatagccatacttcaattgtggaccatactcacgttcaatgcggaggctatgagtgtgggtattatgtgatgcattggatgtggaacataattggcgcagagttaaagagtgattggagtgtgtggttcggtgatggcttgacactagacccggaggcgatcacaacattatgtaaaaaatgggcagcttactttttgaaagtgctatcttcatgtacgagaggtcgcaaacatacagtagttactgcagagaccatcaagattgagattgacagcaagttcttggaattacaacagataatggattacagcctccttctaggtgttcattatcgagctccccagcagttgcatccatacaaccaaagtagaaatgcagatggattggcaattcttgcagaggaag

SEQ ID NO: 43874 - DNA, 210 bp, Glycine max
  Peptide Sequence Number=SeqID_135559
atgggtgaccaagaggagacacaggaacagatgaaagtcgacatgtcggctttgaaagagcaaatggcttctatgatggaggccatgctaggaatgaggcaactcatggagaaaaacgtggctaccgctgccgctgttagttcggctgccgaagcagacccaactttcctagctaccacgcaccatcctcccctaaatgcggtaggatga

SEQ ID NO: 43875 - DNA, 837 bp, Glycine max
  Peptide Sequence Number=SeqID_135560
atgcctgccaagcgaaccgcaccttccgccgcgcccacgctgttgtccggcggcaatccgcagatcgccaagggcgagggcaatgccccggtgcaggcgtatatcgcggcgatgccggactggaaacgtctgatcggcgaacagctggatgcgctgattgaacaagccgtacccggggtgcacaaggcggtgaagtggaactcgccgatgtatgcggtggccgcgggcgaaggctggtttctcagcttccattgcttcacccgctacatcaaggtggcgttcttccgcggcgctgcactgacgcccgtgccgccggagccgtccaagagtgccgatacgcggtacctgcacatcccgcaggatggcgcgctggatgaagcgcagttcctcgactgggtgcgccaggccgccgcgctgcccgagctgctgatggccacgcatgcaccgaaccctgccgatgccggaaccccggcaactgaactgatcgatgcgcgcatcgccgagctgggcgactggcgtggcgaagtgctggcacgcgtgcgtgcgttgatccatgaagcgctgccggacgtgcaggaaacctggaagtggcgcggtacaccggtgtgggagcacaacggcatcctgtgcaccggcgagacctacaagcaggcggtgaagctgaccttcgccaacggggcggcgctggccgatccgaaaggcctgttcaacgccagcctggagggcaacacgcggcgcgcgatcgacatccatgaaggtgcgatgccgaatgccgctgcgttgaaggcgttgctgcgcgcggcggcggcgttcaacgcggcgaagaagaaacgctga

SEQ ID NO: 43876 - DNA, 543 bp, Glycine max
  Peptide Sequence Number=SeqID_135561
atgggtgatcaagaggagacacaggaacagatgaaagccgacatgtcggctctgaaagaacagatggccgccatgatggaggccatgttaggaatgaggcagctcatggagaaaaacgcggccaccgctgccgctgtcagttcggctgccgaagcaggacccaactctcttggcaactgcgcaccatcctccctcaaacatacggcttacccttatggattgccgcccaactactcaccacccgtcttgcaagacgatgcgggccatattgcttctctcgtccttgaaagagagcctcctcaacagcccgaagaggtctacaaagaccctcaagactatgctcgaagggatgtcgagttctatcccccgatccccgaagggccagcacccagcacgttgcctcaacccaacatcgcgacacaaccaatagtttttgtccacgaaaggaccgcccccggtactgaagaaaggaggaagctcgatctcctcgaggaaagattgagagccgtggaagatttggggactatccgttcgcaaacatga

SEQ ID NO: 43877 - DNA, 252 bp, Glycine max
  Peptide Sequence Number=SeqID_135562
atgtactatacgtcaccaacattttctcagtatccttcgcagatgtatcaatatcctttcgaaggtcatgatactgatatgtctgcaagcgaacattcgtttggtggtgttgatttgcgtcacgagttttctgctgaggctgagcagcaagggcggcgacagtgggcaagaagaaatcctgatcgtgaagcccgaaggtgggatcgaccatgtggcacaggctcacgccatcacggacaccataatgactga

SEQ ID NO: 43878 - DNA, 291 bp, Glycine max
  Peptide Sequence Number=SeqID_135563
atgaagttgctgagaggtaaagagatcgcgttggtgaaagtgcagtggggacccgacgagggtgattcaacctgggagttagaggataaggtgagagagttgtacccagagaaacgtgaagaactggaattagagaggcgacacgcaaaccgagacaggatttcagcatccaaaaaggtccagtttttttcttcttttatggctgagtatgtggtcaagtcaaaggtaagggtggacttctcctcacttgaaatctgtgggtgttgggttcttgggagctataatgggtag

SEQ ID NO: 43879 - DNA, 66 bp, Glycine max
  Peptide Sequence Number=SeqID_135564
atggcaagtgcctttccttgtgtggatcctatttcacgggaacttgatgagttgatccgactacgc

SEQ ID NO: 43880 - DNA, 575 bp, Glycine max
  Peptide Sequence Number=SeqID_135565
gatcctattcgtaaaattgtacctcagggtacacaagaagatgaaatagtagaatctgaagatcatcatttgtctttcaatgctttgaaaggtggtaggggagttggtactatcaagttcatagattatattgaaaatttaccagtgaccgtgttgattgatggtcatgctcaaggaaatacctttcaattaccaatatttttgcttcctatttttggtgttgatctcattttaggagctagttggttgaagactattggctctcacattgctgattatgatgctttgcaattgaagcttttgtggaaggatattgtacataagtctatgcttgacttaccagttatgatggagcctgaattagccttattattgcacacttatagtgtggttaagccttacagatacccctatagtcaaaaggaagaaattgagagattggtgtcacgaatggcgtgtattgattataaggctcttaatgcaattactatcaaggacaacttccttattccgactgtggatgagttgattgatgagttttttggagcttccttcttttctaaattggatctaag

SEQ ID NO: 43881 - DNA, 297 bp, Glycine max
  Peptide Sequence Number=SeqID_135566
aggttttgtttctttactaaagcatgtttgcattttagtgaaagaacaccgagactttttagtctcacaccgctttttgtagaagcaaagcttcatgatgaatcaagattgattcaaagatgttttgatgataacaaaggtgatgacaaaaagctcaacggtcaaccaaagaatgagttcaagatgttcaagatagaatcaagaacacttcaagattcaagaggaaagttgaattcaagaatcaagagaagacttaatcatgataagtatgaaaaggttttttcaaaaactgagtag

SEQ ID NO: 43882 - DNA, 402 bp, Glycine max
  Peptide Sequence Number=SeqID_135567
atggcatccttcagccagcttcagtcacagatgcaatctcagggacttgcagtgcctcttgagcctctggttggtcttggtccctccggtccgagagtaagcacaaaggggagttgtgttgatccctcaggaaacgatgctgagacgggtgactctgacaggtgcggcttgtacatagaagcagatcctgcccgcctggtcgccgtggggaaagtttatgagggatccactcttgttcataacactcctttgttgcctggtcaagtaaaggtgagtgtggacgaggttaaagatgcagatgctccagttcctatacccactgatgaggtttccttagtggggcaggcacttcacaacttccttgcttggtcgacacatctggtcaagtctttattacactag

SEQ ID NO: 43883 - DNA, 654 bp, Glycine max
  Peptide Sequence Number=SeqID_135568
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccatcagttcaccactgacatgatggtattactggaatttcacatattcacccttggaaggggtaccgagctcgaattcgtaatcatggtcatagctgtttcctgctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaacgctgcgccttatccggtaactatcgtcttgagtccaaccg

SEQ ID NO: 43884 - DNA, 189 bp, Glycine max
  Peptide Sequence Number=SeqID_135569
atggtgcacattggcaaatgtgctttgaaaggattcaacgacagccaaggaagtaaatccaaggctgctactagatggattgtagttaaatattttactgatcaaataccattagaaccaaagagaatgaaggcaatttgcattcagtgggcaagatattatttgaaagttaaaaatcaaacactatga

SEQ ID NO: 43885 - DNA, 267 bp, Glycine max
  Peptide Sequence Number=SeqID_135570
atggctcggagctctgagaagaaggatccaaaagaattggagttgctggagctagagggagatgagagatttgcgggttcctcgaaaagtgaccgaagggtcatcccgattccaacaattctttttaatataagccaaattaatggctgggctcagggttcaaaggtcagagaatcagatgtgactcctcgggccttgcataaagcagtaataagggctggaaaacctagcctcgaggagtcatgttgtgcgatgagagaaatctga

SEQ ID NO: 43886 - DNA, 219 bp, Glycine max
  Peptide Sequence Number=SeqID_135571
atgatgcatgcacttgacctcaactctcagatgcaatgcggtatgtaccgtatccaataccaaggaaatagccctaagcgtgtctacacgacacctcacttaggaaaccatgcagtatttgtcgagggacgtccgacaaggtcaatgcacccccccatggacatacacgatatacgacgtatgaacgtggacaccatcaagtacagtgaccatggatga

SEQ ID NO: 43887 - DNA, 423 bp, Glycine max
  Peptide Sequence Number=SeqID_135572
atggataatgaagagggcgtgcaggaacagatgaaggccgatctatcggctttaaaagatcaaatggcttccatctcggaggtcatgttaaaactccagaaaactatagaggataaagtcacgacaattgcctccagtacagttagggaagtggagccggtgctgcaacccgccttaaatccgggccgagacagaaacacggcagtgtttggtcgaaggtatagcccgcaagcttatccttatggcttgcctccagacttcactccccgtgccgccccggaagatttaagccaagcccctactttcgaggggcactccaaccttatgatgactatcccgggcaagacgatgaggaaggagatacccatcttgggcccctgctccacctcaaagatccgtccccccatgaactaccccaactga

SEQ ID NO: 43888 - DNA, 493 bp, Glycine max
  Peptide Sequence Number=SeqID_135573
atgtattatcctagttatcaccaacatcaatcatatgcggaacctaatgtacctccagtgcatgttcttggatttatgtcccaacatcatccatcacaagcacaatatcaatcaacaagtttttctggtcatgcgtctcaaggatgtcaacaaagttttcaaccactggggttctcatcatatatacctcaatactcattaaaagtcccttctacctcaaatgttttttatggctcctcacaaatgtttgccaccactttcaacactccaccatctacatataatcttgcaccatcgagttcttgttattgttcatcattacctactcaaatatgtgacatgagtcaagaagatgaggacgaggatgaggataacaacaataacaacgatgacaatgatgatggtgatggtgttgatgatgatgacaacaatggtcatcatgttcctcaacaacaacggacaattacacgtcaacatcctagaacaagaggag

SEQ ID NO: 43889 - DNA, 309 bp, Glycine max
  Peptide Sequence Number=SeqID_135574
aaagagtattgtagtgttgatagtgttgacaaatctgatgaactactcaatcctgcttttggagtactaacacttgagtttcttaacaccttgaaaacatcagggatacctaatcacaagctaagaatcaagattggtactcccatcatgctactccgaaatttggaccaggcagatggtttatgcaatggaactcggctaattgtcaccaaacttggaaccaatgtagttgaagcagaggagtatagctcgagcgccggcacaggcaaaacactagtaaacattaaaaatgcagtatctaggaagtga

SEQ ID NO: 43890 - DNA, 228 bp, Glycine max
  Peptide Sequence Number=SeqID_135575
acacttgttagcattgccacatctcttaggcttgagtttattcctcaagtaaaggagttgttggatgagggtttggttcgcaagagattaaatccttgtgctttgttggtgcccaaaataggtgttaagggaaggagcccagagtatcaagaaccacaggatttgaggtcaaatccttttcaagggggagggaatgatgcaatcctactccgcaagggcattggatag

SEQ ID NO: 43891 - DNA, 141 bp, Glycine max
  Peptide Sequence Number=SeqID_135576
atggaacgagaagagaaaagcgaggaagtggaaaatggaggaggggatgatgcgtttcctgagcctcagaatgttgttcgcttcgactcgaagaacccttgcgcttctttgatggttcctccatttgaggaagttctttga

SEQ ID NO: 43892 - DNA, 678 bp, Glycine max
  Peptide Sequence Number=SeqID_135577
atgtcagctagtgatcatgccattctacaagacagaacccatcaacccatgaagaaaagcttgttagagctatcatcacatgacgctttattggcacagaacaagttgctttctaagcaacttgagattttaacagaaacacttggtaagctgccaactaagttgtctatgggtcaacctacgcactcttctgttttgcagaaaacactcaagaaattcattatatgggaaatcaacaacaacaagggtatactcaaggaggattttcaagcttccagtagggtccctataatcaacaaggacagtggaggacacaccctggcaaccaattcaacaaagaccagagtggaccttcaaacaggccaaattcaaaaaggacctaacatattccagaggattactaagctggaggagaccttcactcagttcatgcagcagaatcccaataaggaatgcaaagctgtgatgaccaggagtaaaaggtttgtggaggctgaggatgaggatagtgttgtgcataagaaggaaactgctgacaagaaaggtactgatggcaagaaaaatgaggaaaacatcatagtggacggaaactgcagtgctgtgatccaaaagatccttccacctaagcataaagatcctgggagtgtaactattccttgttcaattggagaagtcaat

SEQ ID NO: 43893 - DNA, 324 bp, Glycine max
  Peptide Sequence Number=SeqID_135578
atgcatgaacaacgcttgacaatcaattcgtggcactccggactcgatggtggaggttgcatgaacgacaatcaattcatggggttccgaataagatttgatgatggaggatgtacgaacagtgctaggcaatcaattccattggggttccggactcagtggtggaggatgcatgaacgacgatcaattcatgggactccgaataagattagatggtggaggatgcacgaacagcgcttgacaatcaattcgtggggctccggactcgatggtggaggattcattaatggcaatcaattcatggggcttccgaataagatttga

SEQ ID NO: 43894 - DNA, 699 bp, Glycine max
  Peptide Sequence Number=SeqID_135579
atgacaccttctgactttggcttgagatcaaaggagttatatgtgagggtagttcatcagggtggacaacaagaggtgtatcaccatgcatttccggcatccaagttgacggcgaagtatcccggtatgtgtgttgcaagagcacaagtcttcatggctcctcatcaggcagtgctaaggcctgaagagcatttgctgcttggtcacaagtatgtcgtaatctcgtgtacagatgtggagaaactgaagcgtaagcatcctcagcaatgcaaaaccaaagaacataatggggtggtaacatcggaggtaaacatcattagtgaatgccatcttagtggacacaaaccaaaagagaatgacaaactcagtgtcccaaatgagatgattaacacaaggataactctatctcctactcccagtgaatgcaaaattcatgagaatggtgaagttaaagagccaaacattctagggaaagagaaagtgaatgcagagaaggatgtgtgtcaaggtggagaagatgtagaagttcattgctctgcaaaggacttttatgtaggcaaggataagttatcaagatattcaagaagaaaaggaataaaagtgaagaagccttttttgccacctcttccaaatggaagatcatataggggtttgggatggcaacccagccttgtcactgtgcaagagctctctctatga

SEQ ID NO: 43895 - DNA, 1464 bp, Glycine max
  Peptide Sequence Number=SeqID_135580
atgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattgggacagaaaccactgagcttccctcgtcaggttgttgctttgtgccaagctccattcctacttgatgatcctaatgttggactgctattccctgctgatgcaattgcaagagctaaacactatctttcattgacctcgggcggtttaggcgcttatagtgactcccgcggccttccaggagtgaggaaggaagtggctgagttcatactcaggcgtgatggttatccaactgatccagaactcatatatctcactgatggtgccagcaagggggtgatgcagatattaaatactatcatcagaggtcaagacgatgggattttggttccagtcccacaatacccactctactcagcaacaattgctctgcttggtggtacccttgttccatactaccttgaagagacagcaaattggggtcttgatgttaatgaacttcgtcaatcagttgagcaggctcgctttaaaggaataactgttaaagcaatggtgatcataaatcctggaaaccctactggtcaatgccttagtgaagctaatctaagagaggttttgcaattctgttatcaagaaaatttagccttgcttggagatgaggtttaccagacaaatatatatcaggatgaacgacccttcattagttctagaaaggttttgatggacttggggccacctataagcaaggaagtccagcttatttcttttcactccgtgtcaaaaggttattatggtgaatgtggacagcgaggtggatattttgaaatgaccaacattcctccagaggaccttctgactctacatacagttgatgagatctacaaggttgcatcaatatcacttagtccaaatgttccagcacaaatatttatgggagttatgctccatccacctcaacctggagatatttcttatgacaaatttgttagggagagcaccggaatacttgaatcactgagaagaagagcaaggctaatgactgatggattcaacagttgcagaaatgtggtttgtaattttactgaaggtgccatgtattcattccctcaaatacgtttgccgccaagagctttagaggctgctaaacaggctgcaaaggttccagatgttttctactgcctcaaacttttggaagccactggcatatccactgttcctggttcaggatttggacagagagaaggggtcttccatttgaggactactattttaccagacgaggaagacatgcccgctattatggatagtttcaaaaagttcaatgatgaattcatggagcaatacgaagacaatagaggttattcaaggttgtaa

SEQ ID NO: 43896 - DNA, 1041 bp, Glycine max
  Peptide Sequence Number=SeqID_135581
atggcaataattcagcaggacaaaactacttgcaagcaacatactgaaagcagagatgaagaagaggcgtgcaaacttataacacttagtggagttgccctccaaggctccttaaacaccattcaaatagtttacgttactcccaaacaagtcacaagtttccactttggggccctttctcaagtcccgaagaagttcttgcctcactgggttgcaattgggccagttccaaacacctactcattggcggcaattactcaaagcacatcatttttttttggcttggttggcacttgtgcagatcctctcgactggaatggtggcggcttcgatcaaaccacaatgatgattttcaaggagcattatggcagaaacgtctttggactcaatagactctctatcaaagtaccacaaacaaagttgcacgctgatctggtggaaggaggtggcaacgcaacagggagggaaggtggtgggagagaggaggaagaagtaagacgaggcccagtagcccatagccacgaacaactaactccaaaccctaactcaataaattcccccaatccccaaaccctaatcctgccgcaagcagagatgacaacccgatttaagaagaaccgcaagaagcgcggccacgtcagcgccggccacggccgtattggaaagcaccgcaagcaccccggcggccggggaaatgccggcggcatgcaccaccacaggatcctcttcgacaagtaccacccggggttcttcgggaaggtagggatgaggtactttcataagctccgcaacaaattctactcccccatcgtcaacatcgacaagctatggtctctgataccccaagacgcgaaggacaaagccctaaaatcgaaggacactgcccctctaatcgacgtcactcagcacgggtacttcaaggttctcggaaaaggtgtgctgccccaaaaccagcccattgttgtgaaggccaagcttatttcgaagatcgcggagaagaagatcaaggaagccggtggtgctgttcttcttacggcttag

SEQ ID NO: 43897 - DNA, 1176 bp, Glycine max
  Peptide Sequence Number=SeqID_135582
atggcaggggcagcctctgctctgttcctcctcgacatcaaaggccgcgtcctcatctggcgcgactaccgcggcgatgtctccgccctcgacgccgaacgcttcttcaccaaactcatcgaaaaacaggccgatccgcaagctcaagatccggttgtgcacgacaacggcgtgacctacatgttcatccaacacagcaacgtgtacctcatgatagccaccagacagaactgcaatgccgccagcctcctcttcttcctgcaccgaatcgtcgatgtgttcaagcactactttgaagaattggaagaggaatcgctcagggacaacttcgtcgtcgtgtatgagctacttgatgagattatggactttggctaccctcagtacactgaggcgcagattcttagtgagtttattaagaccgatgcttatagaatggaagttacgcagagacctcctatggctgtgactaatgctgtgtcgtggcgcagcgaagggataaactataagaaaaatgaggttttcttggatgtggtggagagtgttaatatacttgtcaatagcaatggacaaataattagatctgacgtcgttggggcgttgaagatgagaacgtatttgagtggtatgcctgagtgcaaacttggcttaaatgatagagtattgttagaggcacaaggtagaacaaccaagggaaaggctattgacttggaagacataaaatttcatcagtatgttaagcctttaatttgggtggaagcaagtgttgaaaagcattcaaagagtcggattgagattatgagtttattttatagcactgccacaaacgttgagattgagttgcctgtgcctgttgatgcaaccaatcctaatgttcgaacttcaatgggatctgcatcatatgcacctgaaaaagatgcattaatctggaaaattagatccttccctggaggcaaggagtatatgttaagagcagagtttcgtcttcccagtataacggatgaggaagcaactcctgagagaaaagctcctatacgtgtaaaatttgaaataccatattttactgtatctggaatacaggtaagatatttgaaggttattgagaaaagtgggtatcaggctcttccatgggtgagatacataacgatggccggagagtatgaattaaggcttatttaa

SEQ ID NO: 43898 - DNA, 765 bp, Glycine max
  Peptide Sequence Number=SeqID_135583
ctgaagctggtagatcgattgggacctccgtcgataccgtgggtgggagataagggtctgcaacgtcatcttcctgttttttcatctgcgatgagaaggaagaaccgagaggcgcaacgatgccccctagtgaatttctcatcacagttaaagcagagcccttactctagccgactcgccttttccgctgggggagggggttttgctggagatggtaataatggtaggtttgggggtgagagagtggtagaagggggtcacagtgaagagaaactgggtccattgaaagctgaagagcctgcaccttgcgtcgaatgtcaaggtccagtcccgagacaaaataacttaggaggaaaggtgacgacagtccgacaatacgattggctagagtttcaaattgagtcagagaatttcggttgggtcctcgtacggggaatgcgcgaaacgggcctcgattacctgcaggaagctcgtccaggtgggcctaagccgtcgaatcgtgggacatctagtttcatttttggtggattggttaagtgggtaggtggtttaggtatggctgaggacgagaaaggtgaggctactaggggtgaagtgttttcgaggacagtgatgggatgcataaggtcatcaagtttctcaataacgtggatctggttagaggccaatttgactatgacttcttcaaggcgatcccaattggatttggaccgagttgattcagccatggtgagcctcttaatgaaagcaccaaagttgttatga

SEQ ID NO: 43899 - DNA, 456 bp, Glycine max
  Peptide Sequence Number=SeqID_135584
atgaatataaagaatcgatgtggaaagcgcagaacatgccacatggcgatgacgtttgttccttcttcaacttcttccactttccgaccaacgttgattcgctgcgccagcgccaatgagcggcaggcgctgtttagccgcattgctcctgtctatgataacctgaatgatttgctgagccttgggcaacaccggatttggaagagaatggcagtgtcctggactggagcgaaaatgggagactgtgtgttggatgtttgctgtggaagtggggacttatcctttctcttgtccgacaaagttggctctcatggcaaggtgattggtcttgatttctcgaaggatcagctatcctttgccttatctcggcagcaatcactttcaaagaattgcttcatgaatatcgatatcattggtgatatgggaaggctctacagtatctatcctggattttaa

SEQ ID NO: 43900 - DNA, 1035 bp, Glycine max
  Peptide Sequence Number=SeqID_135585
atggtgtctaggttgctagttgggttgcttctgggagaacaaccttatccccaaggttgtaggagccccagagctcttcccaacgttcccacatggtgccctcagggggtagaggttgttgatcaactgcggagggaccgcaatacgatatccgcaacgactcaagatgaagttgtggatacttccactgtccccaagaattatgatgcgatgatgacgaatatgtggtgttgtgtcatcaacacaagctggtggcttcacatttgggtggtccaagttcgagggttcgtcgttgtcggtgatgagaagatggaggcgaggcttgcatttgtggcctacgatccacttctcgtcacattgcaactggtggagaagatgaagggtgaacaagggtgcgaaagtaacagcaatggtcctataatttgtcttcctgaagcatggcgagagccaccgcctgaggcaaagaaagaggccggaaaccaagcaactgaggaggaaagaaagggcaaggcccacgatcctgttcgcgagtcgcttaaactcggtcccttgatagtcaaagaactagaaaattttgaagatccaacccatgggatcctggctgtcaaagcgcaacacctcgagcttcatttgaggggaggagggggtgactgcaaaggcgtccagacattccatgatggaattgagtatggcttccatggtggcttggttctaggtaaggcatctgacggcctcctcggggcgatcaatggttgcatggcgagtattgtgctcagtgggcatccatcacgtggtgcaacgccacttgcttctttgtactctttaattgaaccaagcatgttgtcatactactcttggcacatcgaaaacgtccttagagttgtcaagcattgcaaggagaaattttatgaggttcaaggttatctgcacatgtttttgtgccacgatgatctctacctcgcaggtcttgtagttgttgaagcagaggctgtagatgcgggttgtggaggaggagggagaagagggaaacactga

SEQ ID NO: 43901 - DNA, 1194 bp, Glycine max
  Peptide Sequence Number=SeqID_135586
atggcagccattaagaggaaaactcagaaaatactgcccctgtaccagatggctatgaaggcctcattggaagaacaaacgacacagggtacgtttgtcacccatggacgtgaagacatacttaacactgtcattgggcgactggatcatggagggcatgtttgtgcagcgggcacaaaagggagcaatgcggaggctgctgtcaacccatcttcgccagatcatgttgctcctgtcaaaccgactgtggggttgtatgtccatcgcgaagattgtacagagttggtggccttgggaaaaacatatgacagaggctctaccatacacggtgtggcttatgcacatgatatcctaagggttagtgttgacaaagttattaacggtgaccctgaagtcccattgctgacatcagagattaagtatgttaggcagacgcttgacacattcattgcatggccaacaccacttcttacaggcagtactcaaaataaagtcaatgaagttgttcaaccggtcaatgatgttgatgtagatgaccccttgcgcgagttgattaagagcttggttgacatttatgagaagcttgttgagttagtgtgggatgctatactgaatgcaaaggatagacgaggagaatctcaacaatacattgaaaaatggcttaaggaatcgcaccgagagacattaaaaacgacttatgaggggaaatttgatgaaactacaccacggtggattgaagtgaagagtcacgttccaagcggaggctatgagtgtgactattatgtcatgcattggatgtggaacataatcggttgggagttgaagactgattggatgctgtgtgaaaacgaatacaatgttggttgtttgaggtatcacaacatggcatatttaaaggaactgccagaagacggtgcttacgctagcaccgtctctgaaaacagatatttctatgtcgctgcttatgcgagaaacgacttacaaagcacatcttactacgtcgatgcctacgccagcaccgatttagaaataacgcatttctacataggtgctaaagctaacaccgacttagaaaatccatttttcaaagacggtcatgacgtaaacaacgactttgaaaacacgcgttctaagtcgttgctgacgtcatcactgtattcgaaagtcacctttctacgttggtggtttggataa

SEQ ID NO: 43902 - DNA, 282 bp, Glycine max
  Peptide Sequence Number=SeqID_135587
atgcctaaaccttcttcccctactctttcccgtccaaatccatcccgacctccacatgtagaggattcacttgtcggaatccacagggcaagagtttgccaccattgttgtggtcgactggaaaatcgttgtaacaggctgaatcctctacatttgcggtcagatgaagctctcccaaaacttcaattggggcgcatgataacagatcagtttgtgcagaataattgtattgggcaggaattattttcgatgcttaagcatgttgtaggggttaatagataa

SEQ ID NO: 43903 - DNA, 1089 bp, Glycine max
  Peptide Sequence Number=SeqID_135588
atgtttcattcgttaaacctttgtgcttcctgcgttcctgtgaacagcggaagaatacaccgccacacgctgcaggccctttaccttgtgcttcctgcgttccttacaacagggacggcgatctccttttctcctgcgccaaggaccacaaccccaccgtctggttcgccgacaacggcgaacgcctcggcacctaccgcggccacaacggcgccgtttggtgctgcgacgtctcaagcaagctcttcatcactgttttcaattcatctttttaataatattgatactgatagagattcgggtcggctcataacgggaagtgcggatcagaccgccaagctatggaacgtgcagaccggtcagcagttgttcaccttcaatttcgattccccggcgaggtccgtggatttcgcggtcggcgataagcttgccgttataaccactgatccctttatggaattgccctctgcaatccatgtcaaacgcattgctaacgatcctgctgaacagactggggaatctgtgcttctcattaagggtcctcagggaagaataaatagggctatttggggacctctcaacagaaccattattagtgccggtgaagatgctgttattcgtatttgggattctgagacgggaaaactgcttaaagagtcagacaaggaatctggccataaaaagaccgtgacatcacttgctaagtctgcggatggttcgcatttccttactggctcccttgacaagtctgctaggctttgggatactagaacattgactcttatcaagacatatgtcacagaacggccggtcaatgcagttgcaatgtcacctctacttgatcatgtggtacttggaggtggtcaggatgcatcagctgttactactactgatcatcgtgctggcaaatttgaagccaaattctatgacaagattcttcaagaagaaattgggggtgtaaaagggcattttggaccaattaatgcattggcttttaaccctgatggaaaaagtttttcaagtggaggtgaagatggttatgtacggttgcaccactttgacccagattatttcaacatcaaaatatag

SEQ ID NO: 43904 - DNA, 897 bp, Glycine max
  Peptide Sequence Number=SeqID_135589
atggtgccattagaggcgtttgctgatggtgcccgcatcagagaagagggggctggtggtggtgtagggatatttgtgtccattcaagtctttgggggtgcaagaattgcacttagcctaaatggaattgagcttagcactggattacctgataatgcttttggtgaagatttgatctcacgttgggcacttagcacgattactcttgtgcttagcacagtaatctggaacataaagaagtcatttttaggaactacgattagcacagaagtagttgttgcacttagcacgtcacttatgagttccactgagaaaaccatcacaaccaccaacaataacaacaaaaacacaaacatatatggtttggtgggatttggtgcactggggatccggtttgctaaacgtgccaacgatcccgctagccaaaaaccgatgcagcatcctaagcatcaacgattggcacaaaacatcaacgatttcttctccccagaggttgtgattgagttgttcaaggtaatggctaaactgcgtattgtggcggcaaatcgaatactggtggacacttatttcgatgctcgatttcatatttgggaagataaatgggtccctgtcgtccttgctttgcctagacagagattttctaatgatctctctctctctctcatgtcagttgtgaaagattacagtcgtcctgaattttgtgtggagggcttgcaaagacatcctcccggtgatgtccaatctaaaactccaagtttatcatatctgtttgaggtaacttgcagaggcttgacccgagtgctatggccagaatttgtgatttgctttaggccatttggaaagggaggaatgaatgggacttcaacaaaaagagatttccaatctggctccctctga

SEQ ID NO: 43905 - DNA, 192 bp, Glycine max
  Peptide Sequence Number=SeqID_135590
atgacagagggtgctactgtgatcctgcgtaatgccaaaattgacatgttcaaaggatcaatgaggcttgctgtggacaagtggggccgtgtagaactcacagaacctgctagtttcactgtgaaggaagataataacttgtctctcattgagtatgaattgcttcaaccccagaacatatggtggctgtaa

SEQ ID NO: 43906 - DNA, 264 bp, Glycine max
  Peptide Sequence Number=SeqID_135591
atggcagattcaaaatcaggattgaggaaaccagtgttcatcaaggttgatcagcttcgcccggggacaagtgggcacactttaactgtgaaggtagtcaatgctaagatggtgatgcagagaggtcgttctgatggtcctcaatcccggcaaatgcaaattgctgagtgcttggttggtgatgagactggaatgatcatattcactgccagaaatgatcaaggtttgggtgctttatttcgtcaatttcatgggcatttgtaa

SEQ ID NO: 43907 - DNA, 324 bp, Glycine max
  Peptide Sequence Number=SeqID_135592
atgttagcacaagaggtggcggtggctgcaaggaaaaccattcaaatagcttccgctgccaccagaaccctcctctctcgtcgatcttcatgtcccactaagctcaatggacttgccttttcttattcttctcctcagaaacgtgccctctctttttcccggcttccggtgctgttggttggtgcgcaagtgtctttgacgccgttgcatagtgctactgcctctgccatgttcacttctctgctttctctgcataacactaactggggttgtctttcagaagcttttggagaagttaaaggagagagcatctataaacgttaa

SEQ ID NO: 43908 - DNA, 792 bp, Glycine max
  Peptide Sequence Number=SeqID_135593
atgcgcttcattttctctgcttcgttcgagttcgtgctactgctgtctgcagtgcttatttggttcgtgcttcttgttgcgacgcggtcagtgccagagtgcgacggtgaagggatgagtgtgcgatggtggggtgcaatggtgaagggacgtgttcgatgccggagtgggagtgtgcgacaaagagggcaagaggcacaacaacttgctctaacttttgaaattgatggggctttcaaggtgaaacataaaggtggtaaaggaaaacaaatttttagaaggcaagattgtcctgcacaattattaaaagtcaatttatgtccttgtatggattttgtgtctaatgtttgcttgatttttagtgtaactactcaagatcttgttgacataatcaagagtcaagacacaacttcaaagtttgttataatgagtggaagtgggtctaattcaagcggtggagatacaattacgagtggctcttcttcagttgctagaagtaaatacaaaaatgcccctgggaataagactgatattgggtgggaacatgggattgatgttgacggcaatgttaagaaagtcaaatgcaagtattgttcaaagattgcgagtggtggagttttcagattcaagcgtcatcttgttgggactagaaaagattctgagccttatgctacggtgtcggatgagatcaaattgctgatgatgaaaattgttgttgaatctaaagcaagaaaagaaaagaaaaggagattgaatagtattgatgaagatgaagaaagtgctgaaaggtga

SEQ ID NO: 43909 - DNA, 58 bp, Glycine max
  Peptide Sequence Number=SeqID_135594
atggccaattatctagatggtgttatgtcgggtgtaaccttgttcgtggaccgaccgg

SEQ ID NO: 43910 - DNA, 1032 bp, Glycine max
  Peptide Sequence Number=SeqID_135595
atgctaatgaaggctgtaactgctgatgctcaggcagtacagaggcaccgtgcaacaattatagaatgtgtgaaggattcagatgcttcgattcagaaaagagcccttgaacttgtttatgttttggtgaatgaaactaatgtgaagcccttggcaaaagagcttatagattatctggaagtcagtgatcttgatttcagaggggaccttactgccaaaatttgctccattgtagcaaagtattccccagagaagatctggtatattgatcagatgctcaaggttctgtctcaggctggaaattttgtaaaagatgaagtatggtatgccttaattgttgtgataaccaatgcttctgagcttcatggatatacagtaagagcattatacagagcatttcaaatgtcagctgaacaggagactctagttcgagttacagtgtggtgcattggggagtatggtgacatgttagttaataatgttggaatgcttgacatagaagatccaataacagtgactgagttcgatgcagttgatgtcgtagagattgctataaaacgccatgcatcagatcttaccacaaaatcgatggctttggttgcactattaaagctctcttcacgtttcccttcatgttcagagtatgatctgtttttcaaatggaggatcaaagaaattattgttcagttcaaagggagctttgtgctagaattgcagcagagagctattgaattcaattcgattattgcaaagcatcaaaatattaggtctacacttgtagaaaggatgccagttttggatgaggcaacttccattggtaggagggctgggtctctaccaggtgcagcttcaactccaactgcaccttcatttaatcttccaaatggaacagccaaacctgtggctcctcttgtagatctacttgatctaagttcagatgatgctcctgcacctagctcttctagtggaggagatattcttcaggaccttcttggtgttgatctttcaccagcatcacaacaatctggttag

SEQ ID NO: 43911 - DNA, 2463 bp, Glycine max
  Peptide Sequence Number=SeqID_135596
atgatactgatacctcacttaggaagagaaaaccgaacatttacccaaccaaaaaccctagaaacctctcgcgttactcagtcactaggaaccaaaccgaaaccaaaacccaaacccacagcacaatatgctatgctatgctctctaatccgtatccgccgtcacgctcctttccaccacactctccgctctctcttgccgattaaccgtttctcctcctcctcctcctcctccgcctccgccgccgccgccgccgccatggttgctcacgcgaaggacgaggcgtaccttagcgcggcgattccgaagcgcgtccgtctcttcgagaccatccaggcggagcagcgcacgcagcgcctctcgctttcgccggatcctatcaaggtcactctccccgacggcaacgtcaaggacgcgaagaagtggctctcgacgccgctcgacgtggcgcgcgaaatctcgaagaatttggccaacagcgcgctcatcgcgaaggtcaatggcgtgctctgggacatgacgcgccctctcgaggacgactgccagctccagatcttcaagttcgacgacgacgaaggccgcgacaccttctggcactccagcgctcacattctcggccagtcacttgagacggagtatggatgcaagttatgcattgggccttgcactacaagaggagaggggttctattatgatgcgttttacggggacttgggtctcaatgacgatcactttaagcagattgaggctggagcattgaaggctgttgcggaaaagcaaccctttgagcgcattgaagttacacgcgatcaggcacttgagatgttttcagataataagtttaaggcaagtataacttttttttcttctttgaggatcgagattatcaatgatttgcctgccgacaaaactatcacagtatacagatgtggtcccttggtggatttgtgtcgtgggccccatatacctaatacatcctttgtcaaagcaattgcgtgtttaaaggcttcatcagcatattggaggggggacaaagatcgggaaagtttacaaagagtttatggcatatcttatcctgatcagaaaagtctgaagtgtgtattggaggctgagtttcactggggaggtcttgttgtcctatgttcatgtgatagtgaaagcggaaactggtcctctagacagtcctgtctagcctttataattggaagtcttaaaactggtctcaaaaacgcagaactggtggaatacttgcatcggctggaggaggctaaaaagtatgatcacaggattttgggtgtgaaacaggagcttattcttcatcatgaatggagtccgggaagctggttttttcttccacatggcgctcggatctacaacaaactcatggacttcattcggaatcagtacagggacagaggctatcaagaggtcatatctccaaatgtatttaacatggatctatgggtgcaatctggtcatgctgcaaattatagggaggatatgtttatcttagaggttgacaaacaagagtttgggttgaaaccaatgaattgcccagggcactgcctgatgtttaaacacagggttcgatcatatagagaacttcctcttcgctttgctgattttggggttttgcatcggaatgaggctagtggtgccctgagtggattaacacgtgttaggagatttcagcaggatgatgcacatattttctgcagggagtcccagataaaggatgaagtgaggaatggcttgaatttcatcaattatgtctataagatatttggtttcacgtatgagctgaagctttcaacgaggccagagaaatacctaggagatattgcaacttgggacaaagctgaaagtgctcttaaagaagctttagatgattttggcaagccttggcagttgaatgaaggggatggtgcattctacggaccaaagatagacatcagtgtatctgatgcattgagtaggaaattccagtgtgcaactttgcagcttgacttccagcttcctgatcgttttaagttggaattctcagctgaggatgaagccaaaattgagagacctgtaatgatacacagagccatcctaggatctgttgaacgcatgtttgccatacttttagagcactacaagggtaaatggcctttctggctcagtcctcgtcaagcgattgtatgccctgtgtctgaaaagtcacaatcttatgcactacaggtgcgagatcagatccaccaagcagggtatcacgttgatgctgatacaactgataggaagattcagaaaaaggtacgagaagcacagttagcacaatacaacttcatattggttgttggagaggaggaagctaattcaggacaggtgagtgtacgagttagagacttggcagaacataaggttatgagtattgagaaactacttgaacatttcagagacaaaactgcagctttcgaatga

SEQ ID NO: 43912 - DNA, 210 bp, Glycine max
  Peptide Sequence Number=SeqID_135597
atgacgaaaaaggaaagtgcacatgacaatatagaagagtatagaaggatttcatggaatattcccttaaaggtcgctttcactatggacaaaatgcacatggcattgtcagtactatggatcattcctctccattcagagtatgacatgtcgccttattatttagtgcgcaacaatggtcctttcaagaaatcgacagtgatactgtaa

SEQ ID NO: 43913 - DNA, 441 bp, Glycine max
  Peptide Sequence Number=SeqID_135598
atgacctttttatcagggcaaaacaagcaaaacatgtattttatgttcaagacccttgtgataaaaggtggtcagtggcagatggctagtccacccagttctcctcctcttcctcctcctcctatagaagcagtatcacagtcgttgtctactttgaagcggacaagaaaagccacacggctacgatcattggcgactagactagttggggctgacagaccgatggttcacgttgatcatgtgaccgagaaggccaaaagtccccacaagaagaaattaagaacatatttggggattgttgctcgtgataaggttgacatgacatacgagacttggaagcaagtccctgctgctcagaaggatctgatatgggaggatattcagactgaatttgatatccttgaagcatctgacgttaggacaaagaagaaaatactttag

SEQ ID NO: 43914 - DNA, 315 bp, Glycine max
  Peptide Sequence Number=SeqID_135599
atgaaccctaatgaaaacatccaaagtatgcagaaaagattcacacacatagtcaaccatcttgcctccttaggaaaaatcttccctaatgaagatttaattaataaagttttaagatgcttaagtagggagtggcagcccaaggaacatgaaatggaacttcaacgacttaatcaaaatgaagaaactgacaaaaagaaaagaagcatagcacttaaagcctcctcatcaatgcaagaagaaaatgaagaagaagaatcagaagatgaagaagacttctcactctttgtgaagaagtttcaaaaatttgtctag

SEQ ID NO: 43915 - DNA, 300 bp, Glycine max
  Peptide Sequence Number=SeqID_135600
atggatatctgtgaagatactgacattcctataatattgggaaggccattcatgttaactgcaagctgcatagttgatatgggtagaaagaagctggagatgagttttgaagatcagaaaattgattttgatttgtttattgaagacaaacctgctccagaacaaaatgtttgcttacagcgcaagcctcacgctaagcgcatctttggtcatgcgctaagccgcgagtctcaagcgcttaacgctcagcccttgcatcttaggctgacttggtccgctaagctggctgttagtcgatga

SEQ ID NO: 43916 - DNA, 150 bp, Glycine max
  Peptide Sequence Number=SeqID_135601
atgcgtgctccggttgtagcagtgttgaatgaacggcagccaatcgagtgcggggggtgcagtgctcctcttcatttgttcccgttaacgaccacaaagcccttaactgctcctcctcgctacttgcccttttttactacaaaggtttga

SEQ ID NO: 43917 - DNA, 511 bp, Glycine max
  Peptide Sequence Number=SeqID_135602
ggggacgaatgattttgaacatgattcgttgcgtcaactggttaagagcctatattacatgtacgacaaacctgttgagttgaagtgggatggaagcaaatttgggcttccaaatgttgatgcttcattcttcttaacattctctgatgtaaatgaaatagtagcaggatacaaatgtttgaacatatctatactacagttatggatgttacaactttgggtcatgcttccgtgtatggattcctttagccacaatcgatacaccatgcaaaggaccgacgtgctgaatgtgagcattacttacaagcatggctcaaggaatctcaatgagaggggtcattggcaacttgtagtactgtgtcctgcgaccaatgttgttgcatggttttgttcgttacgtaagaagcctgatactcatatcaaaattgcaattaacaatgcaatgaagacaacaaacacaactaaggatggtacaaataatccaggaactcctaagtggattgaagtcaag

SEQ ID NO: 43918 - DNA, 234 bp, Glycine max
  Peptide Sequence Number=SeqID_135603
atgcccgtttgcgggagagcgaggcgagggtcacgggtgcgctttccaagggaggaaagatgtgtggagtcgccaccaacatttatttgtggaaaacgtcagaaaaaccgaaggaaaccggtcaaaaagaaaattccaagctcgggagttgtatttgcgtttgaggaaggtcgacaaaagcggggctcttgctcctacgtaccctccatcgaagaggaaatcagacctacgtag

SEQ ID NO: 43919 - DNA, 225 bp, Glycine max
  Peptide Sequence Number=SeqID_135604
atgtcatcaggtggtgttgatcctcctcgacccccgtcacatgactccagtgggaaagggacaactgcgaagaaaagacgatacatggttagactattaccacctcgagatagtctgacttcatctatcccatccccgtcttctatgtctatcccagttaggcctctcgatgttgcccgtacaccatctccaccttcgactaaagctagaccatcttcatctcat

SEQ ID NO: 43920 - DNA, 498 bp, Glycine max
  Peptide Sequence Number=SeqID_135605
atggctaattcaccaaaagatacttcatctcctggttcaccctctgtaccatcatctccatcatccaccaaagcaccatcaaaccaggaacaacctgaattccatatccaacccatacaaatgattcctggtcaagcccctgttcctgagaaactggttcccaaaagacaacagggagtgaggatttctgaaaaccctagccttgcaacaagtcctagggaagcagacccggagatggataagaagatccgcagtattgtgagtagcattctgaaaaatgcttctgtccctgatgctgatgaagatgttccaacatcttccaccccaaatgtttctgtgcctgatgctgaaaaagatgttccaacatcttccactccaaatgctgaagtcctcccttcacccagtgaagaggaatcaacagaggaagaggatcaagccacagaggagacccctgcaccaagggcaccaaacctgctccaggtgacctcattgacctag

SEQ ID NO: 43921 - DNA, 903 bp, Glycine max
  Peptide Sequence Number=SeqID_135606
atggttggaacacgaggtttaggtcgtgcgttaggagctggtagaggtagaggcattagtgaggatacgcatgaggctgatgttcctctgcgtcgcagacctactgcttcagcacgtaagcaacgggttcgtctgcgtgaggatgtgacagagagacctgaggatgttcctcatgtgtctgatgccaccccagagatgacaggcgctgccgatgctgttcagacagagggagtggctactgatgggagcttggggtcacctgttgcagatgagagtttccccggtggaccacgcgacccatcaattttgaccgattttgctgagcatgtcgcacacagcatctggagtggacaggaacgacccgatctgaagttggtctcccacggtagaaaagtagataaaattgggagaccagcgcctgagatcgaagggttgattgctggcaccggattgagtccactgattagatgttctgttatcaccactgatcctggactcatatccgcctttgtcgagaggtggcatcgcgagactagcacgttccacctgccagtaggtgagttgacgatcacgttggatgatgtagcgtcactcctacaccttcctatcactgtcgcgctgcatacgttcgagccgcttgttacttcagacgccattggtctactgacgaagcttcttgaggtcagtcatgaggaggctacatttgagacccgacaggctggtggacctcatgtccggttggggtggcttcgggacttgtatcagagccagtgcaggaccagacgatgggttgtagcagcccgcacgtatctacttcacttggtgggttgtactcttttcgccaacaagagttcaacccatgtacatgtcgtgcacctggaggcttttagggaccaggcctag

SEQ ID NO: 43922 - DNA, 315 bp, Glycine max
  Peptide Sequence Number=SeqID_135607
atgcacgaacagcgcttgaaaatcaattcgtggggctacggactcgatggtggaggatgcataaacgacaatcaattcatggggctccgaataagatttgatggtggaagatgcacgaaccgcacttggcaatcaattggtggcgctccggactcgatgggaatcaattcgtggggctacggactcgatggcggaggatggatgaacgataatcaattcatggggctccgaataagatttgatgatggaggatgtacgaccagcgctaggcaatcaattcccggggttccggactcagtggaggaggatgcatga

SEQ ID NO: 43923 - DNA, 276 bp, Glycine max
  Peptide Sequence Number=SeqID_135608
atgacattgctacttagcaacattctgcccagcgaccgcaacgccaatctccccctgcaaaaggatcgcacccacaagacacccagtggacccgaaaaagtccaacagggccctggggtttccagctctggttacgggcctctatcagtcctacacggtgctcgtacccccccggcaaggtcacgtcatcatagttctacggagtacctgtcacctccagcaagggcatcaggccccctactaatcgagctttcatcaagaagtactgcgccctag

SEQ ID NO: 43924 - DNA, 198 bp, Glycine max
  Peptide Sequence Number=SeqID_135609
tgtaatcgacccggtcacataaaggcacactgccccataaatgaatcatggccagagaagaaaagtcatgaagaaagaagatccaagaaggcgtatattgcttgggatgacaatgactcatccgatggttcggagaaggagatcaaccttctatccaaggactatgagagtgatgagaacatctctcaagaagattaa

SEQ ID NO: 43925 - DNA, 297 bp, Glycine max
  Peptide Sequence Number=SeqID_135610
atgtttgatgtcttgatgatgctaaaggatcaagtgcttctaagttttattcaagacaagaatccaagaaaatcaagatatatgatcaagttgatctctagaatctctaggaagaagttccaaattgaaaaaacaaaaggtttgaccaaagaactctatcatttcaaattgagatttgctctctggggattcttgaacacaagggaagggttgtccctgtgtggttcagactttgtagaaggagttttacaaagagagtggaaaatctcaagtgggttgcttgaggactggacgtag

SEQ ID NO: 43926 - DNA, 258 bp, Glycine max
  Peptide Sequence Number=SeqID_135611
atgaagacagtacaagtggaggcttcaatctcttctccatctctctacgtttgggaattctatcgcaacagtcgggggaataactggagggatctcaaggaaccgctagagatgctgttatcgctggctgaagacactgaattatatatgtttgatgaatcagttgatgtcccaatgagaaattgctatgaaattgatgtgttctttgttgagtgtgaacccgttagaaaaattaagctctttttattaacagtgtga

SEQ ID NO: 43927 - DNA, 165 bp, Glycine max
  Peptide Sequence Number=SeqID_135612
atggcttgcttggaccaacaacattctgaaaaagagggacagactgttgttgtcatggaggacttgtccatctcaaatttggatgattcctccaacctggattgtatctattgcttgaaaggtcataattattctgttgttcataagcttcaggttgctcattga

SEQ ID NO: 43928 - DNA, 231 bp, Glycine max
  Peptide Sequence Number=SeqID_135613
atggggacggatgcaagtggggatagggtcacgactgaccgatcgttgccctttctcggtgctaaacaagcagagaacatcgctgcaaggcagcccagtatcctttgcattcgcggttcaagtaggcaaacgctagcccgtaagggaggaggggacatggttaatgttcccctaaaaaaaaaatggcaggttagctcgcctgggcgagcaacccctgcacccaaattataa

SEQ ID NO: 43929 - DNA, 580 bp, Glycine max
  Peptide Sequence Number=SeqID_135614
atgggacatggaaccttcctcagtcaaaccaaatactacatagaactgataaagaaatttggtatgaaaaaatgcaaagaagcatttactcctatggctacatcaacctaccttgacttagatgagaaagataaattagtggatgaatcaagatacagagcagctctcaacaagttggatacgtggttcacaggcgagaataagaagacgaacttcaaaatgatctatgtcgtgaagaacgtaaggattccaaagtttatgaacttggaatggttttctcaacagggattcaactttcccaacttgcttgaagtacaaggtctgtcaacatttatgcagatgaagggaactttctaccctgagttggtaaagatcttgtcgcaaccaaccctttcacgggcgagggaggcgaggctcacgggtgcgtcttccgaaggaggcaaatgcgcggaatcgccaccaacgaaggtattagcacctctcacgtttgtcccaaaggacaacaaccttatattagtgtcataccctaatttcgtccggggacctttgcttgatgacatgcaacttttgtttggtcctg

SEQ ID NO: 43930 - DNA, 222 bp, Glycine max
  Peptide Sequence Number=SeqID_135615
atgtgtatacataggaaatggccccgaggaaacttgcctcaaagagatccaggaaggataaagcagctgaaggaaccagttccgctcccgagtatgacagtcaccgctttaggagcgctgaacaccagcagcgcttcgaggccatcaagggatggtcatttctccgggagtgacgcgtccagctcagggacgacgagtataccgatttccaggaggagatag

SEQ ID NO: 43931 - DNA, 1052 bp, Glycine max
  Peptide Sequence Number=SeqID_135616
atggcttcctcaccaaaagaaacttcagcttctggttcacccgctgtaccatcatctccgcaccaggaacaaccagaattcaacatccaacccatacaaataattcctggtcaagcttctgtccctgagaaactggttcccagaagacaacagggagtgaagatttatgaaaaccctagccttgcaacaagtcctagggaagtagatacggagatggacaagaaaatccgcagtatcgtgagtagcattttgaaagacgcctctgttcctgatgctggtgaagatgttccaacatcttccaccccgaatgtgtctgtgccggatgttgagaaagatgttccaacatcttccgggccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcaaaaaggttacaaagccgaaagggaaaaactcccattaagaggtctggaagaatcaagactatggcccagaagaagagtgctccaatcactcctgccacatccagaagaagcaaggttgctatcccctccaagaaaaggaaagaaatttcctcatccgatactgatgatgatgtcgaactagatgtctcgacatctaagagggccaagacttcagggagaaaggtgcctggaaatgttcctgatgcaccattggacaacatctctttccactccattggcaatgttgaaaagtggaaatatgtgtatcaacgtagacttgccttggaaagagaactgggaagagctgccatggattgcaaggagatcatggacctcatcaaggctgctggactgctgaagactgtcagcaagttgggagattgctatgaaggcttagtcagggaattcattgtcaacattccctctgacatatcaaacagaaaaagtgatgattatcaaagagtgtttgtcagaggaaa

SEQ ID NO: 43932 - DNA, 189 bp, Glycine max
  Peptide Sequence Number=SeqID_135617
atgcgggtttaccatacggttacccgcacctttggtcaaccaggggaaaacgagcccgttggcgcgcggagactaacatcatctcctgcaccttttgtcgtcctgacccgtgaagtcagtcaggtgacatgcggggttaccttatggttacccacaccattcgtcaaccatgggaaaacgagcccatag

SEQ ID NO: 43933 - DNA, 825 bp, Glycine max
  Peptide Sequence Number=SeqID_135618
atgggatcaagtcaaaagccttcgcttaaaaagaggttctatcaagtcaaaatcaagagcttagaggtcaccagtttacgaaagttggggcaattaatgggtcaacttcaacggcaagccttccgcagagcctatggtaagatttgggacctagctagggtagaagtctccatggaaccgattgcatccatcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggagcgatcgacgttttttctcgcctatcataaccacaaggaaagtccggttgtcgctatgctagccgacctatatgacaccttcgaccgacgatgtgaagaaagcaatgcaaggattgtttgttgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttccctcgatgggaacaaggggttgtattaattataatcccgttctcgccataa

SEQ ID NO: 43934 - DNA, 179 bp, Glycine max
  Peptide Sequence Number=SeqID_135619
tgatcaaggggttcccatgaaccctaagagaataaagatcattcctgagtggcccactccaccaacaccactcattgagttggtgagaaaccatgttccttcatgggaagatgcccaggaaatggggaaggagcccagagttaaagaacctcaagatttgaggtcaaatcctttccaag

SEQ ID NO: 43935 - DNA, 297 bp, Glycine max
  Peptide Sequence Number=SeqID_135620
atgctttgggtatgcatgtatgtgaatttagccaaggagatgtgtgtgatgttatatgccatttttgctttaaagagtaacgtcccactggaatggccccgaggaagcttgcctcaaagaggtccaggaaggacaaggtggccgaaggaactagttccgccccggagtacgacagtcaccgctttaggagcgttgtacaccagcagcgcttcgaagccattaagggatggtcgtttctccgggagcgacgcgtccagctcaaggacgacgagtatactgatttccaggaagaaatag

SEQ ID NO: 43936 - DNA, 441 bp, Glycine max
  Peptide Sequence Number=SeqID_135621
gaacatcttgagatgaagctatcttcccatgaaaggaagatggctaagttcgggaggtctgctctagagattgaaggccttgtggctgccaacggactaagtcatttgattgcatgttccctagatatggatgatcgaggactaatgtctgcttatatggaatgctggcataaggaaactaatagtttccatttgcccatcggagaggtgactatcaccttggatgacgtggcatcgttgctacatttgcctatcataaaggcattccatagcttcaaacaacttcatgtcaacgaccctgtcaatatgttggtggaattactcgaggtcaacactacagaggcaagagctgagacgattcaatgtcatgtctctttgtttgactatcgtggctgcgagacgtgtatcagacaaaaattgaggcatatcaccggactgtag

SEQ ID NO: 43937 - DNA, 96 bp, Glycine max
  Peptide Sequence Number=SeqID_135622
tattttaacgatcctagaccattggagccagagagattaaatgtgttgcagatccagtgggcacagtattatcttcgagttcgagatcagacctag

SEQ ID NO: 43938 - DNA, 366 bp, Glycine max
  Peptide Sequence Number=SeqID_135623
atgggtgaccaagaggagacacaggaacagatgaaagccgacatgtcggctttgaaagagcaaatggcttcaatgatagagcccatgttaggaatgagacaactcatagagaataacgtggccactgctgccgttgttagttcggttgccgaagcagacccaactctcccagctatcgcgcaccatcctctcccaaacgcagtaggacgagaaaggagcacactggggcacatcagcaacccccatttgggatacaaccgggtggcttacccttatggattaccacctaattacacgccaccaatcaaacgtgatgacgcgggtcatgtcccttcccccatccttgaaggggagcctcctcgatag

SEQ ID NO: 43939 - DNA, 183 bp, Glycine max
  Peptide Sequence Number=SeqID_135624
atggaggaggagactgccacaaaccaaattctagagtcatctccagtacccatacctgatgattccatgccatctgcaccagcatctgagctagagcagcctatctctcaggattcaccagctgctcaggtgttggatctcaatgagcatgcacaggaacaaccacaggagcaggacatttaa

SEQ ID NO: 43940 - DNA, 231 bp, Glycine max
  Peptide Sequence Number=SeqID_135625
atgaaaaattgcaaaaatacaagtggtgaggatgtctccttcacctctaggatctcacaatcactcacaaactcatctcaagcaatcaaatcggttcctacttcaagctctgttgtcatcatcaaaaagggggagattgtagaagcaaagcttcatggtgaatcaaaggtgattcaaaggtattttgatgataacaatgatgatgacaaaggtgatgacaaaaagctctaa

SEQ ID NO: 43941 - DNA, 867 bp, Glycine max
  Peptide Sequence Number=SeqID_135626
atggcttctaggaaaagaaagacaccctctacagctaccccaactagatttgatagatccagattcacttcccaagaggcttgggagagattcactaacattgtggtgcctcgtaagcttttaccaaagaggaatgaggtagtttactatacagagtttgatgagttcaaggaggaactcgagagatgccactgggatgaggagttgactgactttatggacgacaatattgatgttgccattataaaagaattctatgcaaacctctatgaccctgaggacaaatctcctaagcagggggaaatactttgtgcatattccagatttgcactcctgaagcctgatcctcaggagttggctgctaagctctgtatcccagggaggggattcgagcttaatgttgatggttatcctttgaagtttctgaggaagaacatggctactctagctcagacatggagtgttctttccttctctaacctgattcctacctcccacacatctgatgtcactcttgacaaagccaaactcatttatggcatcattatgaagattgatatgaacctggggtacctcatctcccatcagatctccctcatagcacaacatgacacatctagactaggattccctaccttgagagtaacttttagaggacccaggaaggccaggggtaagagatctgaggccccttccacttcagcatcagaggcaccaacaccttcttcttctacagtaccttcctcttcatccactcagattccagttattcctccagtacctttacagaccccacttccagctcctctctctgcaggtccatcagattttatttttacaccacagatgctgcactccatgctctag

SEQ ID NO: 43942 - DNA, 699 bp, Glycine max
  Peptide Sequence Number=SeqID_135627
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgcccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 43943 - DNA, 321 bp, Glycine max
  Peptide Sequence Number=SeqID_135628
atggaggagttgattaacaaaacacaactctctccccaaaataatgccaacgtcatcacgtcggctaggcggttcctcaacaggatctcatccctgcaacctactgctctcattctgctcccacgaacaaggttcgcgatcatcacagcaaggaaacgtaagcaaacatcacgagcttacacaacattcattatccaacactcacatccaacaattgttcattgtccacatccgacaattactcatcatccatattcaacaattactcatcatccatccatggatccaatcaagactgcacaaaatgatgcatacacctga

SEQ ID NO: 43944 - DNA, 764 bp, Glycine max
  Peptide Sequence Number=SeqID_135629
atgggtactagtaccctcaccttcagaggactacacgtcctcgccttcagagggctgcacgccctcaccttcagagggctacactcccttaccttcagaggactacatgtcctcgccatcagagggtcgcgtacccttaccttcagaggactacatgtcctcaccatcagaggactacatgtcctcgcctttagaggactacacgccctcaccttcagagggccacacaccctcaccgtcagaggagtacacgtcctcggcttcagaggactacatgtcctcaccttcagagggctacatgcgctcgccttcagaggactgaatgtcctcctcttcagagggctacatgccctcgccatcagagaactacacgtcctcaccttcacaggacagcacgtcctcctcttcagagggctacacgtcctcacctttagaggactacacgtcgtcgccttcagagggctgcatgtcctcgcctttagaggattgcacgtggtcgccttcaaaggagggctacacgcccccgcctttagaggactacacatcctcaccttcagaggactacacgtcctctccatcagaggactacacgtcctcaccttcagcgggctgcaagcccttgccatcaaaggactacatgtcctcaccttcagagggctacacgtcctcctcttcagaggacttgacgtcctcgccttcagagggctgcataccctcaccttcagagggctacacgtcctcctctttggaggactacacgtcct

SEQ ID NO: 43945 - DNA, 186 bp, Glycine max
  Peptide Sequence Number=SeqID_135630
atggatcccgtgaaatacatctttgagaaaccggccctcacgggacaaatcgctaggtggaaggggcagtccttgtatccccagatgatcaatgtattccttttcacgaccaggctaggtttcgattgtaccaacaatatggccgaatatgaagcgtgcgcccttgggattcaaggcggccattga

SEQ ID NO: 43946 - DNA, 211 bp, Glycine max
  Peptide Sequence Number=SeqID_135631
tacgggtcgtgtgaacgtgctatcatccttgtctatagcttgtcttgatttcaggtattgtcatcatcaaaaagggggagattgtagacaaaggatcaagctgaaagttttgatgatgccaaaggattacatgaatcatatgcttctcaaagatttactcaagacaaagcaattagagatattcaagatggatgagcaagacagtctatag

SEQ ID NO: 43947 - DNA, 231 bp, Glycine max
  Peptide Sequence Number=SeqID_135632
atgcagaaaagattcacacacatagtcaatcaccttgcctccttaggaaaaacctttcctaatgaagatttaattaataaagttttgagatgcttaagtagggaatggcagcccaaggaacatgaaatggaacttcaacgtctcaaccaaaatgaagagaccgacaaaaggaaaagaagcatagcactcaaaacacttggctactcctatgagcactggttgctaccttga

SEQ ID NO: 43948 - DNA, 321 bp, Glycine max
  Peptide Sequence Number=SeqID_135633
atgtgtctatcggggaaggagaaggaagcactgggttcaacaaaaatagaagaaaatcactcaaagtgtatcaatctcacacagtgcggggcgagaaagtcgcaagcgcacaggattttggttggcaatcaaagggagatgaccactttaggttgtgggcaaggattgacattctcaccctgggtcaaggtttatgataagttgggattttggctcaaggcttgtagaacggctggtcatgatatatgtcagggtttggccagcggttcggggataaaggggatgtcccatattatttccatgatacacatgcaacaatga

SEQ ID NO: 43949 - DNA, 378 bp, Glycine max
  Peptide Sequence Number=SeqID_135634
atgaaagtgagggataaaattttgatattgttggactcatggcaagaggcatttgggggaccaggtggtaaacattctcactactattgggcatatgaggagttaaagcaagtcttagaaggtcagcattcaaagacggtgcttacatcagcactgtctttgaaaggtagcattctaagacggtgcttacatcaacacgtcttagaaggtcagcattcaaagacggtgcttacttcagcactgtctttgaaagacggtgttgcttttggaaggtcgttgaaaactccgacttctaagatggtcattgttgcaccgtcgttgaaggttttgacattccacgacgttggaatctacgacggtcatccaccgttgttgtag

SEQ ID NO: 43950 - DNA, 258 bp, Glycine max
  Peptide Sequence Number=SeqID_135635
atggtgggttacacacgttcaagctttgcggatttggtcttcaccggcagaaggatcaaagcaggtctgaaaagaggaaaatttaatcatcctacttggacgaatgagaaaactggggcaaatgaagagggtgaaaatgaaggagaaacccatgctgcgactgtcattcctacatggccaaacatcccaccaacccaacaatgtcattactcagccaataacaaaccttctccttacccaccacccagttatccataa

SEQ ID NO: 43951 - DNA, 72 bp, Glycine max
  Peptide Sequence Number=SeqID_135636
gaattcgataaaactgaggggcaagctgggcatttgtctgctagaggaattatagcagctactgcaatctga

SEQ ID NO: 43952 - DNA, 141 bp, Glycine max
  Peptide Sequence Number=SeqID_135637
atgtggaccaccacgggggagaagcttgccgcccagctcgcccaggcgagcaaggttgcttcctccagaagcaacagccttctggaggaatcttctggagggcccaagtgggcctggttgcaatttgcaccccctttttaa

SEQ ID NO: 43953 - DNA, 793 bp, Glycine max
  Peptide Sequence Number=SeqID_135638
ccaggcggtagccgaccagtacgctgacttcctgcgtgaaggtttccacgtggtgacgccgaataaaaaggccaacacctcttcactggattactatcaccagttacgccacgccgccagcagctcgcggcgcaaattcctctacgacaccaacgtcggcgcgggtcttccggtcattgaaaacctgcagaacctgctgaatgccggcgatgaactgctgcacttctccgggatcctgtctggctcgctttcattcatttttggtaagctggatgaagggatgagcctctccgaagccactaaactggcgcgtgagatgggctataccgaaccggatccgcgcgacgatctttccggcgtggatgtggcgcgcaagctgctgatccttgcccgcgaaaccgggcgcgagctggagctctcggatattatcgttgagcctgcgctgcctgccgattttgatgccagcggcgatgtcgatagctttatggcgcgcctgccgacgcttgacgatcaattcgccgcgcgggttgctaaagcgcgcgacgagggtaaagtcttacgttacgttggcaatattgaagaagatggcgtctgccgggtgaaaatcgccgaagtggacggtaacgatccgctgtataaggtgaagaacggcgagaacgcgctggcgttttacagccactattatcagccgctgccgctggtgctgcgcggctatggcgcgggtaacgacgtaaccgcggctggcgtgttcgccgacctgctgcgtaccctgtcatggaagttaggagtttaa

SEQ ID NO: 43954 - DNA, 669 bp, Glycine max
  Peptide Sequence Number=SeqID_135639
atgcctaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgggcttttattgagaagtactgccgcaggcgcaccccacctcatcaggctggccaggctggggcatttggcatagagcagtatttacggcatttggttcgccagcaggcggccaaccaccgagcccatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggcgatttgcttgacttcttgggagggagtggagatacgtgactgggagatccccagattcatgttttctttcatatttcttttgtcatttttattctatgttattgttttgacttga

SEQ ID NO: 43955 - DNA, 301 bp, Glycine max
  Peptide Sequence Number=SeqID_135640
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagttaaaggtgtggccttgtgtcattgcggttcaatgatgaatccaagacaacactcctttgaagtagcagtagcagtgagtcacgagaacgacgttctccggcaaagtagcagtgacaagtcatggtttctgcataaggcgt

SEQ ID NO: 43956 - DNA, 453 bp, Glycine max
  Peptide Sequence Number=SeqID_135641
atgcgaggtaacccttctacaggtgatttagctccattggatttggagatagaagccacttgtaggaggaataacgccgagagaaaaagaaaatttttgcaagacaggacagcacaactaggtccggaggaagctcaatcttctgaggcatcttctatctttccagagccaagagaaccagaaataggtgcatctgaggctgatatcatggctgaagatcaacctagaagggttacccttgatgactactctagctcgactgtgccgcaattcttcacaagtatagcacgaccagaagttcaagcacacaatgttacatacctttactccttgatacagttaattcaaggaaatctatttcatggcttgccaaacgaagacccatatgcacacttggcctcatacattgagatttgcaatacagtcaagattgccggtgtgcctgaggacgca

SEQ ID NO: 43957 - DNA, 312 bp, Glycine max
  Peptide Sequence Number=SeqID_135642
atgactaccaaccttgctaaatgtatgaattctgttttgaaaggagcccgagcattacctattgctgccttagtcaatgaaacatttaataaaataaatgattcatttgttactaacggcatcaaaatcatgaatatgataaaggcagggcataggtactccaaagacgtatatgtcatgatgcaagaaaatcaacacattgctacctcgcatttgttcgcatgtatgttcgagaaacaggggagtttgaggttcaagaaattgcaaatacgcgacttgatcgacgagcaatggcatgcactgtcaaattga

SEQ ID NO: 43958 - DNA, 240 bp, Glycine max
  Peptide Sequence Number=SeqID_135643
atggagaatgctaagcatatggccacaccaatgagtactgcttgctatttggataaagatgaaaccggtcagtcaatagacattaagcaatatcgaggaagagcaccagtggaacttgttatttcattggatctgctctggtttcttggcatagtaagaaacaaaatagtgtcgctttatctactgcggaagcgaaatacatttctgctggcaattgttgtgctcaaattctttggatga

SEQ ID NO: 43959 - DNA, 198 bp, Glycine max
  Peptide Sequence Number=SeqID_135644
atgggtaatgtagagaaggtacaagagcagatgaaggccgacatggaggccatgaaagagcaaatggccacaatgatggaggccatgatgagcatgaagaagataatggaagccaatgcggttgcagttaccgctaccaaatcgaattcctgcagccccgggggatccactagttctaggaagcggcccgccaccgcg

SEQ ID NO: 43960 - DNA, 498 bp, Glycine max
  Peptide Sequence Number=SeqID_135645
atggcaagagctggtgacaatggtggtgtatatcatcaactggacgaatctcagcgcttatttttggacacgtggactacacaaatgcaacgtttgttgaaccgtaacaaagaagagccctacagacgaatagtcaaatcttcctcgtttactcttaaacctctatcccctagagaagtgccaacttacaaaagcaatccccaagagactcaacgtaaggatgcacatgccaaagttcagtatgtgaaaagattgtatgaccaagtgaaggtgcaaattgcaaagaagaatgaaagctatgccaagcaagtcaacaagaaaaggaaggcagtggtacttgaatccggtgatgatcctagacatttgaggacaaatgttttccaagaaggagggaatgatgagaatcatgaaactggccaaatacaggctaaaggcccaagtggagaagaacgaaggcccaagtggagaaggacaaagcccccgagtggagaaggatga

SEQ ID NO: 43961 - DNA, 166 bp, Glycine max
  Peptide Sequence Number=SeqID_135646
ctctacattgagtgcatacacagaagcagtgagggagctggcatgtgagatattggagctaatagcagaggggttgggggtcccggacacttggatattcaacaggttcataagggatgttgatagaaaatgcagcaaagaaaatgcaagcatagctcttccttga

SEQ ID NO: 43962 - DNA, 204 bp, Glycine max
  Peptide Sequence Number=SeqID_135647
atggatcttggtttcaggtgggaggcattgaatgcaagtttctccaagatagacgcagagccctattatcttctcgtccctcgatgggatctcctcctcagcaaaggtaaagtagttattggctgtcatattgttgacaatccccttgaagccttctacggagatgtcttgggccacatgggcgtcatccaaaactttaactag

SEQ ID NO: 43963 - DNA, 730 bp, Glycine max
  Peptide Sequence Number=SeqID_135648
gagcgctgaacaccagcagcgcttcgaggccatcaagggatggtcatttcttcgggagcgacgcgtccagctcagggacgacgagtataccgatttccaggaggagatagttcgccgacggtcctgggtgaggggtcagtggatcccgtttgatgcagatgctatcggccagttcctgggataccctttaagtgctagaagagggccaggagtgcgagtatggccagaggaggaaccggtgcggatcatgcacaccaacatgaccaccctgactcagatctggatgactttgctgctcagcaacatccagcccagcgatcataattccgacctccccctgccgaagtgtcagctggtgtatgccatcctgacacggatgagcattcacgtggctcagttaatcgctgatgccatctatctatttgcaggtatggcgcctaccaggcaccctctggacccggataagtccaacagggctctgggatttcccgccttgatcacaggactctgccagttgttcggagtccccgtcgcacctagcaaggtgattcggtcgcccatcacccgagcttttattgagaagtattgcgcacagagacaggcccagggggatgctccgcaggccacagacgcgccgccacctcatcaggctggtccagccggatcgtttgatacggagcagtatttgcggcatttggttcgccagcaggcagccaaccaccgggctcat

SEQ ID NO: 43964 - DNA, 243 bp, Glycine max
  Peptide Sequence Number=SeqID_135649
atgcggggttaccgtatggttacccgcacctttcgtcaaccaggggcaaacgagcccgttgacgcaaagaaactaacatcgtcttctgcaccttttgccatccagggacagcgagtcaggtggcaggcggagataccttatgatcattcgcacctttcgtcaaccgaggagaacgaattcgatgatgtcaggatgatgttttactctcgtcgtccggaaacattcaagcccaatgacgcgtga

SEQ ID NO: 43965 - DNA, 384 bp, Glycine max
  Peptide Sequence Number=SeqID_135650
tcattcggggttcccgtcacccccaataaggtgatccgaccgccgatcccccgggccttcatcgagaagtactgcacgcctaggcaggcgcagggtgatgcacatcaggccgcagacgcatcgccaccacctcagcaggccgatcccgctggatcgctaggcatggagcgttatctacaacacttggttcgccagcacgcggccaaccaccgtgggcaggtgcagatacatgagtgtctctaccggttcagccttagtcagcaggggcagggttttgctccttttgcataccctactccagagcagtttggggctgaggtcgcatggcccggagactggcccgaggcccaggcaggggaggagcccgcaggatcccccggttag

SEQ ID NO: 43966 - DNA, 939 bp, Glycine max
  Peptide Sequence Number=SeqID_135651
atggcggcgcagcacatcttcgatttccggcaacgagacgcgcacgccgcggatcttcacatacccgttcacccgggtggcgaacatgatgttgccgtccgcacggtagtagccctgatcgccggtgcggaaagcgcgcagcggttgcccgtccggcccttcaagggtgacgaagtcatgctgcttcagctccccctgctccagatagcccaacgccaggttgaccccggcggtatgaatgcggccgaccacgccggccgggcagtggctgccgtcgtcatggcagatgaagtagcggttggccggcagcgggcggccgtaaggcacggtgccgctctcctgcggggcgatcgggtgccagatgctccagatggtggtttcggtcggcccgccgagcgagaacagcgcgagatccgggcgcagggtgcgcagggtttgcaccgtcgccggcttgatgtagtcgccgccttgcgccaccaggcgcagcgaacgcaggctgtcggccgttttgcaggtgagcagcatctccagaatggcgggcaccgaacaccacagggtgacccggtgcttttccaccagctggttccagctgatggcgtccttttcctgatgcggcgccggcagtaccagcgtggcgccggcgcacagcgaaccgaacagatcgaacatcgacatgtcatggtgcggcggcgtgacggaaatgaagacgtcgtcggcagtgaccgcccagcgttgctgagtctggtggacgacgttggcggtggcgcggttgttgagcaccacgcatttgggtttaccggtggtgccggaggcgcgcgatccgtcggcgccagcagggccgccggcgttacgccgatcggcgtctccagatcgccgccgtgcaccaccagcgtcggccggcattttccagcagtaggcgtgcgctccggcggcgagtga

SEQ ID NO: 43967 - DNA, 893 bp, Glycine max
  Peptide Sequence Number=SeqID_135652
agggctatacgccctcaccttcaaaggactacacgtcctccccatcagaggactatacgtcctcgcctttagagggctacacgccctcaccttcagaggactacacctacacgccctcgcctttgtagggctacacgccctcaccttcagaggactactcgtcctcaccatcggaggactacacaccctcgcctttagtgggctacacgccctcgcctttagaggactacacgtcctcgccatcagaggactacacgtcctcgccttcagaggatttcacgtcctcacctttagagggctacacaccttcgtcttcgtaggactacacgtcctcacctttagagggccacacgccctcaccttcagaggactacacgtgctcgccttcagaggactacacgtcctcgccatcagaggggtacacgctttcacctttagaggactacgcgtcctcgccatcagaggactacaaattctcacctttagaggactacacgccctcgccatcagaggactgcacgtcctcaccttgagagggctacacgccctcaccttcagaggacgacacgtccttgccatcattcctgggccaccccctgatcctagaggagggcgaactgtgcgagcacaactagaggaggaggctatcacgcagctactatgcataccggggcaagatttcacctgtgcctctgcaaagagacgagtgtggatcatgcacaccaacatgaccactgttacacagatatggatgacggatcgcgcccacaagacacctagtggacccggaggagtccaacagggccctggggtttccagctttggttacgggcctttgtcagtcctacagggtgcccgttcctccccagcaaggtcatgccatcgtgacgtag

SEQ ID NO: 43968 - DNA, 519 bp, Glycine max
  Peptide Sequence Number=SeqID_135653
atggctacacgccctcgccttcagaggaatacgcgtcctcgccttaagaaggctgcacgcctcgccttcagaggactacacatcctcgccttcagagggctacacgccctcacctttagagggctgcacgccctcgccttcagaggactagacggcttcacgccctcgccttcagaggactataagtcctcaccttcagaggattacacgtcctcacgcttcagaggactacacgtcctcaccttcagaggactacacgtcctcgccttcaagagggaaacacgccctctcctcagagggctacacgtcctctcttcagagggctacacgccctcgcctttagatggctgcatgcctttgccttcaagaggactacacatcctcgccttcagaggactacacgtcctcacctttagagggctactgccctcgcctttagaggactacacatcctcgccttcagagggctacacgccctcaccttcagagggctgcatgccctcaccttcagaggactag

SEQ ID NO: 43969 - DNA, 477 bp, Glycine max
  Peptide Sequence Number=SeqID_135654
atggtgaggacatgtagtcctctcaaggcgaggacgtgtagtcctctcaaggtgaggacgtggagtcctctgaaggcgaggatgtgtagtcctctaaaggtgagggcgtgcagccctctgttggcgaggacgtgtagtcctctaaaggtgagggcgtgtagccctacgttggcgaggacccctctgttggcgaggacgtgtagtcctctaaaggtgagggcgtgtagccctacgaaggtgaggacatgcagtcctctgatggcgagggcgtgtaaccctctgaaggtgaggacatgcagtcctctgatggcgagggcgtgtagccctctgaaggtgaggacacgcagtcctctgatggcgagggcgtgtagccttctgaaggtgaggacatgcagtcctctgaaagtgaggacacacagtcctcttaaggtgagggcatgcagtaccaattgttgtcttgttttcacaacctcgtag

SEQ ID NO: 43970 - DNA, 384 bp, Glycine max
  Peptide Sequence Number=SeqID_135655
atggggtgtttcatcagcagactctccttccccgttggaatatttgtctctttaccaaagcatgtgttgcattttagtggagaaaacaccgagactttttcaagtctcacaagttatccagaactacgtaggtctaagttcctcattggaggatacgtaggagcaagagcctcgcttttgtcgaccacaccgctttttgttaccatgacccaagagctggtagcccgcggagacaccttacggttatccgcacctcgtcattcagtgaccccatgtgtgattgatgagcagaggccaatggggtcatctgcgccctttccggaggtgtcagcatctttcggtggagactttttcaagtctcacaatttatctagaactacgtag

SEQ ID NO: 43971 - DNA, 88 bp, Glycine max
  Peptide Sequence Number=SeqID_135656
atgggagaaattaaaaaaaaagaagaagaagaaggaaagaaagctcctgatcaaggattgaaagaaaacagaagaaatgtgcagaaag

SEQ ID NO: 43972 - DNA, 375 bp, Glycine max
  Peptide Sequence Number=SeqID_135657
atgttgtacttggaatgtgatccaattcgaaaagctgttgagaatgaggatgatttagatgatgtacctgttgctggccatgaggaagatgttggtgctggagagcagacagatgctggtgagcagatggatgctgatggtagtgagcagagggatactgatgctggtgagcagagagatgctggtggtgaagagagagatgttgctgatagtgaggaggaaaaggaagttgatagtgatgagtggtttataaatttctcttgtatgatgaatggagttgaagctgaagttgagacagatggttatcattcagaggagcttaatatccccattagtagtgatgatgaagatgaggatgttgaagtttatccttaa

SEQ ID NO: 43973 - DNA, 438 bp, Glycine max
  Peptide Sequence Number=SeqID_135658
atggggtcgaaccaagcgccctcctttaaaaagaggttctatcatgtcaaagtcaagagcctagatctagccagcttgcgagagctagggcaacggatggatcaagttcgatgtcaagccttccacaaagcgtatgggaaaatctgggatttggccctgatagaagtgtccgttgaagccatcgcatccctctctcaatactatgaccagtcgctcagatgcttcacgtttggggactttcagttggtgacggcattagtgaggtgcataggtggcaattcagtgccacgtagactgtccaacgtggcactgaggtctgcatctataaattctctctcacgcaaggttgcttcttcttcttccccaaataaattagggtttacgaagctgctggtttcccacgctgagtcttacgaagctgctggtttcccacgctaa

SEQ ID NO: 43974 - DNA, 285 bp, Glycine max
  Peptide Sequence Number=SeqID_135659
cgcgatatgggtaaactgccgggcacccagaaagcgcacaccatccccagcgcctactggaaagtgattttcatcaacaacagcccggcggtgaaccactatgccgctttcctgttcgatcagaacacgccgaagggtgccgatttttgccaattccgcgtgacggtggacgagatcgagaaacgcaccggtctgatcatctgggccggtctgccggacgacgtacaggcttcgctgaagagcaagcccggcgtcctgccggagttgatgggctgcaaaaactga

SEQ ID NO: 43975 - DNA, 360 bp, Glycine max
  Peptide Sequence Number=SeqID_135660
atgaatatcttgacggcacacgatcaagggtggaaacaagagttaagtccttacaatcaatatgaagaagaaagaactcctaatcttgaaagtgtgtttaaggaattcgtggcataccatgccagctcaaaagctaatcaaaattcaatgaaaaatcatgaaattcattttggtaagagctactcaatagaaaattttcacgggggaccaaagttacaaccttactatcaaaatgaagcagaaaaaggttccaatctggataaattgctgatgcaattcatggaagcaactaaatcaactcaacgagcactccaaagtatagaaatccaggttggtgaactggcagaagcattgacttaa

SEQ ID NO: 43976 - DNA, 501 bp, Glycine max
  Peptide Sequence Number=SeqID_135661
atggatcagctccaacatcaagctttctgcgagacctatggaaagatctgggatctagctatgatagaagtctctgttgaagccattgcatccctcactcagtattatgatcagctgctaagagatcttgggatgcctgctaggaggaagaaagccatatcttttctctgggttctacccctccatggcaaggatatccaaggtggtatcgtcctctttccaaatgaggatgggctagtggacctagcggcgattgacgccttccttgcttatcaccatagcaaggaaagtccaaagatgcgagaagagcggcacccgtttgtcccctgcaaggtcaccgcatatgtgtcgacaaagggaaggccaattgggagcaactcttggaagtatgggttttgtccttatgtgagggatgtcgcaacctacccttcggcgagagagcgacgcgaggctcacgggagcgtcttccaaggaaggaaaatgcgcgaagtcgccaccaat

SEQ ID NO: 43977 - DNA, 748 bp, Glycine max
  Peptide Sequence Number=SeqID_135662
gggcaggatcatcttgagctaccttctggggtagagacaaaacatgaacagcagaaaccaatcaaggtacacaggaacggatgcaagtggggatggggtcacgaccgactgatcgtcgcccctttctccacgctaagcaagcggagaacatcgctgcaaggcagccccgatcaacattttgcgcattttttgattccgttttgcgcctttgttcatcaccaacaagaaatggccccgaggaagcttgcctcaaagaggtccaggaaggataaggcggccgaagggactagttccgctcctgagtatgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtggacatcactggttactcccatggccaagttcgatccagaaatagtccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaggaatgcgagtatggccagaggaggaaccggtctgacgggttcgatgaggaggccatcgcccaactgctatgtaccaccggggcaggattttgcccggactgctacagggaggcga

SEQ ID NO: 43978 - DNA, 375 bp, Glycine max
  Peptide Sequence Number=SeqID_135663
atggaagggttagtggacctagcagcgattgacgctttcctcgcctttcatcatggcaaggaaagcccggtcgtcgccattttggccatgtatgacacgttcgaccggggatgtgaaagagcggcgcaagaattgtttgttgtgcactggctctctatgtgtgactggtttcacacctttttctccaagaaggtaggcccgtctatccgctacaaggaaggaagaatcaggattctatcttcatgcgaaggatgcccaaatgttcccttgatggaacaaggggagttcacaaggcatgtgatgcggtgtgaagaaaggacagagagcttaggggaagcagtaatgggagcatcggcggctatcataagtggctga

SEQ ID NO: 43979 - DNA, 321 bp, Glycine max
  Peptide Sequence Number=SeqID_135664
atgccagaatttacaagcgattatcctcaaatttcagccagcccgcatcaattagacattgcatattatgcttcagggtcctacaatgctcaatggaatgccctggaactcctccatggtaagcacatgttgtgctcgagtcgtatcctcagaaaaatggaggttgaggaaccttggctggggttatggctaccattgaattatcgagtagatatgggaacaagctttttcgttggaaaactccctctcgggttggtgttttggtttgtgttatgggtggtgtttggcattggatgtgcggcaggtgggctttgtggctga

SEQ ID NO: 43980 - DNA, 755 bp, Glycine max
  Peptide Sequence Number=SeqID_135665
atgagtctggatatcgaccagattgccctgcatcagttgatcaaacgtgatgaacagaatctggaactggtgctacgcgagtcgctgctggaaccaaatgccactgtcgtggagatgatggccgaactgcatcgtgtctacagcgcaaaaagcaaagcctatggcctctttaatgaagagagcgagctggcgcaagcgttgcgtttacagcgtcagggtgaagaagaatttcttcctttcagccgtgcggccaccggccgcctgcgcgatgagctggcgaagtatccatttgccgaaggcggcattgtgctgttctgtcagtatcgttacctggcggtcgagtatctgctggtggcggtgctcaataatctgagcagcatgcgcgttaacgaagagctggatatcagttccacccattacctggacatcaaccatgccgacatcgtggcgcgcatcgatctgaccgagtgggaaaccaatcccgaatcgacccgttatctgaccttcctgaaagggcgggtggggcgtaaagtcgccgatttcttcatggacttcctcggcgccagcgaagggctcaatgccaaagcgcagaaccgcggtctgttgcaggcggtggatgatttcgccgctgacgcgcagctggataaatccgagcgccagaacgtgcgccagcaggtgtacgcctactgtaacgaacagctgcaggcaggcgacgagatcgagctggagtcgttgtccgaaaagagctctccggc

SEQ ID NO: 43981 - DNA, 536 bp, Glycine max
  Peptide Sequence Number=SeqID_135666
atggaggccgacatggaggccatgaaagagcaaatggccacaatgatggaggccaagatgatcatgaagaagataatggaagccaatgtggttacaattgccgctaccagcactgttgctaaggtgaacccgatgcccccatccggcatcaaccaaatgaatcatccaacctcagatatgacacatgaaattcctcaccataatctagccgacttcgagccttgcctcggatatgccactgaagggcaagcagttggtggtatacccctgcaaaacactttggagggtcctcagtatcacccacaactacacctcttgcattccacaataagtaaaaaccctcatgctatggcagaaatgggaaagttggatcatctagaggaaaggctcagggccattgaaggaggtgaagattatgcctttgctaacctagaagagttgttcctagtacccaatatcatcacccctcctaagttcaaggtgctggactttgacaagtacaaagggactacttgccccaagaaccatctaaagat

SEQ ID NO: 43982 - DNA, 519 bp, Glycine max
  Peptide Sequence Number=SeqID_135667
atgtccccacgtgcttcccggtggttgacgtcgaaggcgcacatgaagggaatcacaggagcaccttacagggcacgttgtgatgctttgaccgtcacagatgtgtcctggttgccgtacactaagcatcgagggcttaggacctttgatttgatttcatcattccagggtcagctgagatggggtcctatggtggtcacagctcgaccagagagggtggtacaacagtttggttacattcagagcatccctccgccgtctgttagtgctcgattgtcacatgatgatatatatgacaggtggatgcatttttcggagcacgtactacctgtgggtgagctttgtctagtgcatgggcatgatgattacgacggatatgaggcaattgcacagaggttggagcgtgtgctcaaccttaggatggtcactgcaggcacaaagttatatgagattatgcaggattgcctgacgatcgccagagggggagccagtgctgatggaagtgttagggctcgttag

SEQ ID NO: 43983 - DNA, 231 bp, Glycine max
  Peptide Sequence Number=SeqID_135668
atgcatctacgtgatcaaggaagcctcctttacaacaaagagaagaacaagatgaaagattgcaaaaatacaagtggtgaggatgtcttcttcacctctaggatctcacaaccactcacaaactcatctcaagctcctagaacaacttcctcttcaagctctggtctctgtagatcttcacacagcaaaatctctcaaaactctctggaacttggacctttctctctctag

SEQ ID NO: 43984 - DNA, 627 bp, Glycine max
  Peptide Sequence Number=SeqID_135669
atggttaagactagagaattaggccgtgccttaggtatggttgttgacagaggtttggggagaagggatcatgattattctgacggtgctccccagcgccgaaggccgaccgcattggcacgcaggcaacgggtacctgtcactgttgccgatgatgcgcctgcggtacctgcggatgagccgatggtagatgttgacgcacaggacaccgatgcagaggctaatgcacatgacactggtgtagaggctgctacagatgaggctaaggaatttcctggtggacccaaggacccatcagtgcttatggagtatgctcagcatgttgcagccagcgtatggtccggagaggaacggcctgagttaaagttatcctcccatgggaggaaggtgcataaattaggcatgcatgttcctgcaattgaggagatggttgttgggacaggattaagttctttgaccgcgtgttcaatagacattggcgatcgggaacttatatcctcgtttgtcgagaggtggcaccgggagacaagtactttccatcttctagtgggggaggtatccatcacgctagacgacgtcacatctcttcttcatatgctaatcgttggtgacttccacgccttctag

SEQ ID NO: 43985 - DNA, 474 bp, Glycine max
  misc_feature (446)..(446): n is a, c, g, or t
  misc_feature (460)..(460): n is a, c, g, or t
  Peptide Sequence Number=SeqID_135670
atggatcctggaggcgccaccaccttggatgctggagtagtagctgcaaatgtcgaaggaagctcagctggcctcgccctcgccctcgccctcctagcccttcaaatagaaactgtcagatccttaggattccaacagttcttcctgatgtatgccaagttaatgactgggctaaggcacttaaaagtaaggttgttagagacaacccctctggctttacatagggcggtgatcagagtaggaaagccaagtctagaagagttggactgggatatagaagtcatctggccagaaatgagagctcctacgttcatgtccatgcaagagactaggccaaagatcagcctagctctgtccactgtcagatcaaaggtatgtgatgtgggggccaagttggagtatgagagaacactccacacctgggctaaagtagtcaaatctttccntgagaatcctcccnaagatggcccttag

SEQ ID NO: 43986 - DNA, 282 bp, Glycine max
  Peptide Sequence Number=SeqID_135671
tattgcacgcctagtcaggcacagggtgatgcaccacaggccgcaggcgcgccgccaccacctcatcaggctgacccaactgggtcatttgacacggaacggtatttacagcacttggttcgccagcaggcagccaaccacagggggcaggtgcagatacatatgtgtctctaccagcccagcatcagtcaacagagccagggtttcgctccttttgcgtgccctactccagatcagttcagggctgaggttgcatggcccggatattggcctgaggcctag

SEQ ID NO: 43987 - DNA, 120 bp, Glycine max
  Peptide Sequence Number=SeqID_135672
atgtctttttcaagagatttcctctctggtaatcgattaccaaatctgggcgtcccaccgtctatgacaatacatgctgagccataccacctggttgatatccaagatggacccggttaa

SEQ ID NO: 43988 - DNA, 291 bp, Glycine max
  Peptide Sequence Number=SeqID_135673
atgccgctcagtcccgtgatattggttaccttggctgacaacgagctgatgtcggtggcctcttccttcctttcacttggaggtgcatacctccacgggactgcatggctatttcggtatggaaacggaacaggtttaactaccgaggggtatcagggcttttggggagctgcgtctttggtgaaatataccaccaaaggcttaggccttccaaaacttctctcatctgcggactgcatacatacatgctgctcttccctcccctcatcgccgacttccagttggccttga

SEQ ID NO: 43989 - DNA, 357 bp, Glycine max
  Peptide Sequence Number=SeqID_135674
atgggtatagctgaaacccaccatagggttcgtaaaggaggaaatatggttcttgctgcaaaatcttgtgatgatatctttaacaacctgttgcaagatggggtttctccagatgagctttataacacagtgttcaagcaggaggttgaaattgttctcactgctcatcccactcaaattaaccgtcgtaccttgcaatacaaacaccttaaaattgcttgtgttgtctctaactacttttccaccttcaagcagcatcttttggattataatgatcgacctgatcttagccctgaagatcgagatatgttgattgaagatctggtaccattcttgaactatttccattctgcttaa

SEQ ID NO: 43990 - DNA, 269 bp, Glycine max
  Peptide Sequence Number=SeqID_135675
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgttaaacgacggccagtgccaagcttgcatgcctgcaggtcgactctag

SEQ ID NO: 43991 - DNA, 255 bp, Glycine max
  Peptide Sequence Number=SeqID_135676
atgtcgaagaatggtcgaaaaccttcgcgaaatcactcacggaaacgttacgaaagcgcctcggcttggattttcttcacggaactaattttcctcagcaaattcgaaagagagagaaaaaactgggggagaagcttgccacccagctcgcccaggcgagcaaggttgcttcctccagaagcaacagccttctggaggaatcttctagagggcccaagtgggcctggttgctatttgcacccctatttttactaa

SEQ ID NO: 43992 - DNA, 419 bp, Glycine max
  Peptide Sequence Number=SeqID_135677
atggcttctatcacggaggccatgctaaaacttcaaaaaactatagaagataatgctacgacggccgcttccaatacagctagggaagcggaaccgctccctcctcataccgactatcctctgcaaaaagatgatgaaggagatgcccatttaggccctctacttcccttcaaggaaccagccccccatgagttgccccaaccaaacatagtccgccacgacctgtctccatccgcacccgttaaggaactcgttccctttgcaaaagacaagggagagattgatctacttgaagagaggctgagagcagtagaaggcctcggcaactatccattctcgaatttagcggatctgtgtctggacagcttagccggagcagctgtggcatggtacaccaatctggaagcttctcagatccg

SEQ ID NO: 43993 - DNA, 602 bp, Glycine max
  Peptide Sequence Number=SeqID_135678
atggatataaatcctgcctatagctgcctctatgggaagatcgtggattcatgccctgggagtggtcccttcaacgcttcaccagatattgaagacatgttagtgagctgcccttcctccgcaccatatgtagaagcggcggaagaatcgttggaaacggctttccaatcctttgaggttgtgagctgcgcctctgtggaaccaagtccgtcgctaccttctctctccaacgcggccataatggtggcacgtgttatgctcaggaatggatttgagctcggaatgggtttaggcaaggactgcctcgggaatgctgacgtggtcgatatcaaaggaaatccatacaagtatggattagggtatgagcccgggatgccgggaaggaggaacgtgccctcaagatttcgggcggacaggttatggcccggccgtattagccagtgtttcaccagcactggaatggtgtcggaagaggaggtggccgcaatagaagaggagttccctcaagacccaccaagttttgtgcaaccatgccaccccgattcccaagtagggaactggcgcgtgataagccagtcagaagtctataccgctgattcaat

SEQ ID NO: 43994 - DNA, 752 bp, Glycine max
  Peptide Sequence Number=SeqID_135679
atggatcaagttcaacgtcaagcttttagcaaggtatatgggaagatttgggatctggcgatgatggaattagcaccaaccatagaggagttcgaagggatcttagaatgcctgataggaggaaggaagccatacctcttttctgggaatggagtagcgggaatacctaggaagtgcttggaagagaaggcggaaactctggcaagccaaggagagtgggtatcattcatcaatgtattagcactgctaatgtttgggacaatactatttccgaatgtggatgggctggtggatctagtagcaatcaatgcttttcttgcttatcaccacaggaaggaaagcctggtcattgctattttagcagatgcgtatgatacatttgacttaacatgcgagaagagcagtgcaagaaaggacaaagcaaatcgggaagaactgttggcaggcatgatgggagcgtccattagttggttcccatggcggaaagaaggaggggcaggagtaggtgcgccatcggaggagaccatcacgcctttcatcgcggaagaggcagaagtgcctaaggagagcgaagaggtgcaagctttgaaagctgagctcgaaaagacaagagtagcgaaggagaagctgaaggtggcagccactagagttaggaaagaatgtgatgagctaaaagatatcaacatgaccacggatgaagcgctagagcgggaaatgaaaaaggccagaaaggaagaatggagcagaaacaa

SEQ ID NO: 43995 - DNA, 565 bp, Glycine max
  Peptide Sequence Number=SeqID_135680
gtctcttccgatacagaactcacccaaccaagggcgcccacacccccacaggggggagctctttgggcctcggcttcgacttggcctcacccgaccaacaatgctcactttggcgcaaacacagcaaggaacttttcgccaaggcaggcatagatcttcgccccgatcccaatgacatatggggaactcttgccatctctcatcgccaaccaattagccatggtggtcccgggaaagatcttccagtccccgttcccaaagtggcccaagcttttggaggacgtaaagaccccttgaaggtttatctacaaggccttgcaaaaggtgggcatgattccctgcggcgggcgcagagaagactcttgcttaatgcatccggtgagagggaggaggaacaacatgtatacatgcagtcggcagatgaagaaggacctaaaaagcctaaacccttggtaatacacttcaccaggaacacgactccccaaagacctcaacacccctcagcagtgtcgggcggtagatctattccatttccttacgagaacaaccgcgcagtttcgtggag

SEQ ID NO: 43996 - DNA, 658 bp, Glycine max
  misc_feature (528)..(528): n is a, c, g, or t
  misc_feature (609)..(609): n is a, c, g, or t
  Peptide Sequence Number=SeqID_135681
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctattcagccaacttgtcaggggtctaagcgcttagcacgagcaagctcaggcttagcgcgtgaagacatggcgcttagcacgcaaggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactatnaagataccaggcgtttccccctggaagctccctcgtgcgctctcctgttccgaccctgccgcttaccggatacctgtccgnctttctcccttcgggaaagcgtggcgctttctcatagctcacgctgtag

SEQ ID NO: 43997 - DNA, 231 bp, Glycine max
  Peptide Sequence Number=SeqID_135682
atggacactaatcctgacccaactacaattcgtgcgaaaggtcggccaaaatcaacaaggataaggaatgagatggattgggtcgaaccatctgaccaccgacaaaaatgtagtagatgtggagcagaagggcacaataggcgccgatgtccaatgcaatctgatcgtgggaaagttgaaataaatggagtggatcaatccaggttgagtgacattggtgttcatcattag

SEQ ID NO: 43998 - DNA, 417 bp, Glycine max
  Peptide Sequence Number=SeqID_135683
atgcattacttggaccatctagcagcagggggacaaatttgtcttgtgcctggccagtgtgcaccagattacatggactggttcttcaggatctctcatctgttcatcacacccatacaggcagttgatccacccaaacatccacttgtcccacagcatgacacatacgtggagtcagatatccctgaggtcccaatggcaccagaagctggaccttcacatgcaccttctgatgcagagcaacctagacatgcagtggatgcgtgccaagcgatcgcaaaaaggttggagcgtttgctcaacctaaggatagtcactacaggcacagagatacatgaggtcatggaagactacatcaggatcgctaggggtatcacagtagatggaaatgcttatgttagggcgcgacgaagatga

SEQ ID NO: 43999 - DNA, 1104 bp, Glycine max
  Peptide Sequence Number=SeqID_135684
atgaaacgacatgagtttgtctgggagccatacacagcaactgtgatgggagcgttgcctccaatttgtgtggttggaagtgtagcctggtttgcggtggtgccactgatttgtttccatgttgttgagtggcaccaacccgatagagttttacgacaatttggattgcaacaacccattcccgggtgtccttcgcaaccgcagaatctccatggcataacgctcaaaggcaaacaagatgagaattggttccacctgttggccctaatcattggtcagtggaacaaccaagcagagtttagggtcgacgtttatcctcgacaggagggcctactgggttataactcggactacatggtgtggtataggcgtaaaacaaagatgtttgtcgacccaaacaatgcaaacacagctgcattgggtgaagttgtggagactttacaatatatggtgtcaccacaagggaggaacacgtggacggttgatgatctcgtgccttacgtggataagttagcgattatatctgaagagcaagagagaatcactgagccagtgtcacatggtccagcatcagagcgtgaattcccagccccaaagtttcacattcttcagtcaagtgttgaaactcggggcataggcagacaaagggagcctattgaagccgaaaaatattcccaacaaatgatggagcgtggtcatggaatgtattacacgccagcaacattttccgaatatccttcacagatgtatcagtatccttttgcaggtcatgatactgatacttctgagacctcacattcgttcagtggtgttgcggaaacacaacctcatttttcatggcccactatgactccttcacagcagcacaatgcccccatggcaacacctaacgccccatttgctccgcaatggaatgtacccggagcaatacctgatatgggcgacttattaggtgttgatttgcgtcaggagttttctgcaaaggctgagcaagcagaagcggggagacaacgcggcggcagaagaaatcctgatcatcaagcgcgaagatgggatcaaccatgtggcacatcctcacgacatcacggacaccataatgactga

SEQ ID NO: 44000 - DNA, 231 bp, Glycine max
  Peptide Sequence Number=SeqID_135685
atggcttacactcacatttcagtggaagattcacaagcgattctcctcaaatttcagccagcccgcatcaattacactttgcaccttacacttcagggtcatacaatgctcaatggaatgccccaaggctcctccatgataagcacacattgcgttcgagtcgtatcctcggaaaaatggaggttgaggaaacctagcaggggttatggctaccattgcagtatcaagtag

SEQ ID NO: 44001 - DNA, 561 bp, Glycine max
  Peptide Sequence Number=SeqID_135686
atgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataagatgtacaatttgtggtagagctcatgaatctagatgttgtatccctaatgaagagcaaattgcacatgaagtcaattatatggggaatcagcccagaggcaatttcattacaagtggatttccaggatttcagaacaaccagcagtatcaacaacagagacagtggcaaaatcaccctggtaaccaattcaaaagagaccagggtggttcatctacaaggccataa

SEQ ID NO: 44002 - DNA, 264 bp, Glycine max
  Peptide Sequence Number=SeqID_135687
atggggtcgaaccaagcgccctcttttaaaaaaaggttctatcatgtcaaaatcaagagcctagaagtagccggcttgcgagagttaggacagcggatggaccaagttcaacgccaagccttccgtaaggcatatgggaagatttgggatttggccatgatagaagtgtctgttgaagccatcacatccctcactcagtattatgaccagtcgctaagatgcttcacgtttagggactttcagttggtgccaaccatagaatag

SEQ ID NO: 44003 - DNA, 478 bp, Glycine max
  Peptide Sequence Number=SeqID_135688
atcttcaaaccttgctctggtttctgaagaagatctcattgttatgtgggcctttcataaaggtttacaaattgattgggcacatcttgttagatatcgcatgcataaggcattgcgattgaatgctccattgccttatcctcatcttgttacccttttccttcaacactttaacatccctcttgattctgaaccctatcttccaatcaagagatccttccttataggcgcttcagtcatagcatcctttggttatcaaaaagagcatgatggatcttgggtgaagaagggtgctcgacatattttggacaggtttgatggtcttcaaacctttgttggtgaaaggtttgacactttggaactacaaatggatatgtgctttaatgaaatggagtcaagaatcaccaaggttgaagaagatgtgtcttacatacgttcaagctttgatctaccaccatcgccaccaccatcatcttag

SEQ ID NO: 44004 - DNA, 279 bp, Glycine max
  Peptide Sequence Number=SeqID_135689
atggcatacagaggacagctcgcaaggtgcttgactgcggtttctattggcccaccatcttcaaggatgcatggagaatttgtagcacttgtgagccttgtcagagagcaagcggctcacttttatggagacagcaaatgcctcaacaacccatattttatggggcctttccctatctcttttggttttgtttatattccccttgatgttgattatgtttcaaaatgggtggaagccaaacccaccagaactgacgatgctaaggtttggagtccctag

SEQ ID NO: 44005 - DNA, 471 bp, Glycine max
  Peptide Sequence Number=SeqID_135690
atgaatgaggagggtcctgtaggaggagctagaactgatggagctgttaagggagctgcagtagaagaagatggaacagtagtggaaggagttgtagaaggatctggtaaagtagatgaagaaggagcagaagtatctggtgctgctgaagtagggggagcctcagatctcttacccttggccttccttggccctctgaatgtcactgttggatcatctagattccaacagttcttctttatatatgtcaagttaatggcagggctgagactctccaaagatatggaatttgatgtgactcctctagctttacacaaagttgtgattaaggctggaatgttgggcaatgatagaaatctggtgggagatgagtgtgatgtcagaagggtggaaggtagggaccaagttggagtaagaaagaacactccaagtatgagcgagtgtggtcatgttcttcctgaggatctttag

SEQ ID NO: 44006 - DNA, 697 bp, Glycine max
  Peptide Sequence Number=SeqID_135691
atgagtcatcattcatctagtgttaatggtgagggtactagtcataaggactctttatctagaatcttagatgagttgagtttcctcaagttatggaacgaaaaactagaaagaaaagaaaaagaaaaagagagggtaaaaataaatcaagatgaaagggaacaaataagggcagaagaaagaaggaaaatactaaaagtattaagaaaagaaaaacatgccttctatagtagtcatgacccttgcaagagcctaagtgaagaacttcatgactattatgaaggaaggcatagagaaaagaaaagaaagcctcaagaggctaacattaacctcccatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaatcccaaagatgataaggggaagacaatagaaaagcaagcccctaaggctagtatgcaagagaaaactagctctataaagtgctttaaatgtcttggaagaggacacattacttctcaatgccccaccacaaaaaccatgattatgaggggccaagacatttatagtagccaagatgaggctactacttcaccttcctctagtgaaa

SEQ ID NO: 44007 - DNA, 303 bp, Glycine max
  misc_feature (289)..(289): n is a, c, g, or t
  Peptide Sequence Number=SeqID_135692
atgtcttgtggatcagttcaagtggagggtacatccacttggttgttcaaagagaacaagggagggtacatcccttgtggatctttgcttgtaaaggattttacaaggttattggaaatctcaagaaccagtggttgcttggggactggacgtatcttgagaaaagttttacaacttcaagattcatggcctcctcaaattctctgtttcccgaaggaaactccatccataggtcacttatctttactggtgagggttaccactattggaaaacccgaatgccaatctntattgaagccatag

SEQ ID NO: 44008 - DNA, 448 bp, Glycine max
  misc_feature (8)..(8): n is a, c, g, or t
  Peptide Sequence Number=SeqID_135693
ccataganataggaccttatgtacccaccatagtaaatggaagcacaacaagtggaagcacaacaatagaaaaacctagagataaatggtctgaagaagatagaaaagttcaatataatcttaaagctaaaaacatcattacttctgccctaggaatagatgaatattttagagtctcaaactgtactattgccaaggagatagattggcaaccaaaggtaacagccatcacggaatctacagatttgtctactgtgtctcttgccacactatttggaaaattacaggaacatgagatggagttgcaaagactaaatcaacatgaagaaaacgacaaaaggaagaagggaatagcactcaaagcttcatcttctattcaagaagaaagtgacaacgaagacttggaagaagatgaagatctcaatatttttgtcaaaagatttaacaa

SEQ ID NO: 44009 - DNA, 161 bp, Glycine max
  Peptide Sequence Number=SeqID_135694
tttgggctaagcgcatatccaccgctaaggagaattttggcagagcatcagcatcaaagccgtgcgctaagcacgagatcagtgtgataagtgcagcaggtgccttcagcctggctaagctcaagactggcgctaagctcaatttcacttactcacgctaa

SEQ ID NO: 44010 - DNA, 345 bp, Glycine max
  Peptide Sequence Number=SeqID_135695
atgaccggccctctcgatgagtcgatctcttgctttctcataagggtggacccttgggtacttgtacctatcacctttagaggactacacgtcctcgccttgagaggactacacgtcctcaccttcggctacacgccctcaccttgggtactagttaccctcaccgttgagaggactacacgtcctcgccttgagaggactacacgtcctcgccttgagaggactacacgtcctcgccttgagaggactacacgtcctcaccatcagagggctgcacgccctcacctccagaggactacatgtcctcgccttgagagggctacacgccctcaccttgggtactag

SEQ ID NO: 44011 - DNA, 342 bp, Glycine max
  Peptide Sequence Number=SeqID_135696
atgtgtggcatctcttgtcaatgtcaggatttacacgcaattctcctcaaaattacaaccagcccgcatcaattagaccttgcaccttacgcttcagagccctacaatgctcaatggaaccccccggggcttctccatgacaggcacacgttgcgttcgagtcgtattctcggagaaatggaggttgatgaaccttggctagggttatggctaccattgaattatcaagtagatatgggagcaaggatggcctttgtggataacggggcggtgggtaaggagaaggtttgttattggctgagtaaagacattgttgggttggtgggaaacttggccgtatag

SEQ ID NO: 44012 - DNA, 829 bp, Glycine max
  Peptide Sequence Number=SeqID_135697
atgtgagcatagcagagatatccatcgaagccgttgtatcactcaccatatactatgaccaacctttgagatgcttcacgtttggagacttccaattagtaccgactgttgaagaatttgagaagattctaggatgtcctcttgggggaaggaaaccgtatcttttctccgggtttcttccctccttgagcaagattgcagttgtgaagtacttagaaggcaagggaagggatatggcgaatcaagaggagtgggtcccatttatgggcgtattagcagtgctaatctttggggttgtcctctttccaaacatggacggtttggtggacctagcctcaattaatgctttccttgcatatcaccatagcaaagaaagcccggtggtagctatcttggcagacttatttgacacatttgaccgaaggggttgcattaactacaatcccgcacttgctataagacagttagggtaccccatgaggggagcatcgacggaagagagcttttctcctttccttgtgagatatttcggcgcgcaaggtttcaaggttatacatagagtccataaggcgtgggaaggcccgttaaggaaagataaagaacttaggggcatccgtaatggcatcatcggtggttatcatgaatgtctgaaagttcgtacacgagggttagattggctctccaagttgaaaattatcaatgaggagaacttcgaagctctggaagaggatgaagaagtccgagctctaaaaaccgaactaggaaaagcaagacttgccaaagaaaaattcaagttggtcgctacagacgtctggaaagagtgtgccga

SEQ ID NO: 44013 - DNA, 372 bp, Glycine max
  Peptide Sequence Number=SeqID_135698
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagttaatgcaagtgggcagttctgtggggtagcagagatggttggtacagttgattttaacaagaatatggacttttggcagcaagataaatggagtggaagctttcctttgaagtggcacatcataaaagatgtaccaaatccaaattttaggcacattacactggagaacaatgaaaataagccagtaactaatagcagagacacacaagag

SEQ ID NO: 44014 - DNA, 547 bp, Glycine max
  Peptide Sequence Number=SeqID_135699
atggctactccacctgcctcgcctcctcctcctacaatagcatcagagtctccgtctacgttgaagtggatgcgcaaagccacacggctacgatccttggccactagaccacctggggcagagagatcggtggtccacgtcaatcctatgaccgggaaggccgatagtccccacaagaagaaattaagaacatatttggggattgtcgctggtcgatgtgacatacaagacttggaaagaagtccctgctgctcagaaggatttgttatgggaggatattcaacttttgacggtaggacaaagaagaaagtacttcagactgttggggagcagtggagacagtttaaatctgatttgacgaggaaatgggcacttgcagccaacaaggatagtgtggacgacactgtttgtgaaaaatacgacattagcaaggagaaatgggcccagttttgtcagacccgcagagacccctcctgggaggatgtgcagaaaaagacagatgtcatccagaagcaaaacaccgccccccacgtgttgtctcgtgggg

SEQ ID NO: 44015 - DNA, 330 bp, Glycine max
  Peptide Sequence Number=SeqID_135700
atgcggatgctggaagacaaacagacaaaggtgtcggctttgcaggttgaaaaggaagcgagagaaggggtgatagagttattacacaaggaagccatgaaatggatggatagatttgctctcactctgaatgagagtcaagagcttccaaggttgttagccagagccaaggaagtggctgacacatactctgctcctgatgaagttcacacaatgacttccaagattattttgatgatgccaaagaatcaagagttaagcaagctccaaagaatcaagagtcaaaaagcttcaagaatcaactttcaaagaatcatgattcaagaataa

SEQ ID NO: 44016 - DNA, 473 bp, Glycine max
  Peptide Sequence Number=SeqID_135701
atggctccgaagaaactctccacgaagaggcctagaagggacgccactggagaaggctccagtgccacctcagagtttgatagtcaccgtttcaggagtgtcgagcaccagcagcgcttcgaggccatcaggggatggtcattccacagggagaggtgtttccaactcagggaagatgagtacacagacttccaggaggagatagctcgcaggcattggacacctctagcgactcccatggccaagttcgaccctgagatagtcctagagttcaatgctaatgcctggcccacaggggagggagtttgggacatgcgctcatgggtgaggggtcagtggattcccttcgatgcagattccctcagccagttcttgggcaacacgctggttttggaggaagaccagcagtgtgaattcagccagaagaggagccaggcagacggtttagatgaggaagccatcacccaactgtt

SEQ ID NO: 44017 - DNA, 849 bp, Glycine max
  Peptide Sequence Number=SeqID_135702
atgcagcaacctggagcaattgagcagcctgaaccttatgctgcaaatatttacaatagacctcctcaacctcaacagcaaaatcaactacagcagagcaattatgacctctccagcaatagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaatcagatgggacaattggctacccgattgaatcaacaacagtctcagaattctgacaagctgccttctcaagctgtccaaaatcccaaaaatgtcagtgccatttcattgaggttgggaaagcaatgtcaaggacctcaacccatagcaccttcctcatctgcaaatgaacctgccaaacttcactctatcccagaaaaaggtgatgacaaaaatttacctaacaatttctgtgcaggcgaatcttcttccacagcaattccaagatatgccaaattcttgaaggagctgtgcactaataagcggaagcttaaaggaagtgaacgaattagcatgggcagaaatgtctccgcattgattggtaaatctgttcctcaaattcctgaaaaatgcaaagatccaggtcccttgcagtcaactgatgtgatggattttctcaaggatcagttcccatcattctag

SEQ ID NO: 44018 - DNA, 114 bp, Glycine max
  Peptide Sequence Number=SeqID_135703
atgacatgtaaagttagggttgctaagaaggccctcaactcagtgttggaggttgtcatgatggctaacaccgaatgggcctatagaatggatgaatgggcaatacctagatag

SEQ ID NO: 44019 - DNA, 300 bp, Glycine max
  Peptide Sequence Number=SeqID_135704
atggagtgcctagagggtgtttgggagaccctcgaaggcaatgagaggtgccgattccgtggcacaattcgactcactgctacttcgctggtacatccggagcaacccgcacgcacacttcaacagcctgtggagtgggtactacctacacctactccatatcgactagttgagtcggttaaagtgatagaggtgtcatcctctgaagaggatcttgaagaggacccagaggagttacctcttgcacctactatggatgcccctgacttaccagaggatgatgaggacccactccttgat

SEQ ID NO: 44020 - DNA, 69 bp, Glycine max
  Peptide Sequence Number=SeqID_135705
atgaatcaaggtacttggggacggacacgaatggatgctaggcccatgatcaacagattgtcgttgtga

SEQ ID NO: 44021 - DNA, 132 bp, Glycine max
  Peptide Sequence Number=SeqID_135706
atgaagctctgcttccacaatagggatcgcgcccacaggacacccagtggacccaaagaagtccaacagggtcctggggtttccagctctgattacgggcctctgtcagtccttggatatgcatgtatatag

SEQ ID NO: 44022 - DNA, 330 bp, Glycine max
  Peptide Sequence Number=SeqID_135707
atgagacctgatgaggttgttcctcctgagccaattatgccagctatacatgagactgttgaagcaggtgagtcacagttgaggcaggaggctgctactcctgagaggacatcacagaccccaaaaggtccactctcaccagggatggacctatcttttgctcagcaagtagcagatgctcctacacctatcatcgagatgctagaagaccctaccactccagtcctgagactatcatccactcctccagctaccccagttttacatctgacaaatgaagaggatatgcaggacacacagggcacacaggaccagtcacaggaattctaa

SEQ ID NO: 44023 - DNA, 247 bp, Glycine max
  Peptide Sequence Number=SeqID_135708
aatgaccaaatttggtctctgcttgtcattggggccccgcccgcctctggatgacaaaaagggtgcggattacccaatgaccaaatttggtctctgcttgtcatcgggcccgccgcctctggatgacaaaaagggtgcgaataaccgtaagggtcagtatgacaaagattatggggcggccgacaaaagcaaggctcttgctcctacgtatcctccaatgaggaattcagacctacgtagttcttga

SEQ ID NO: 44024 - DNA, 627 bp, Glycine max
  Peptide Sequence Number=SeqID_135709
atggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggtaatatcgatgaagctactgcgaaagctacgaacttagaaatggagagcaatttgaagaaatga

SEQ ID NO: 44025 - DNA, 354 bp, Glycine max
  Peptide Sequence Number=SeqID_135710
atgagtattgtccaatgtttctactgcaaaggccatggacattttgcttcccattgtcctaaaaagttctgtaattactgcaaaaaaggtcatatcataaaagaatgtcaaatcagaccaccacggagaaatgcaacagccttcactgcaactaatggctcttctactactcctgtttatggggatcagaatccgcctgctttgggtctttcaggtaaagcttctttacccagctctccttggtattttgactctagcgcatccaatcatatgaccatcaatgttgctgcacttaccaatgtcacaaattactctggatcaacactcagggaagatgattgtgaagggacctaa

SEQ ID NO: 44026 - DNA, 159 bp, Glycine max
  Peptide Sequence Number=SeqID_135711
atggcggtagctttcctccaacagctggaagggttcacaatcaggccgggttgcagggaaaaagatggcaatggtggtggtttgctctcacttactcgatttggaagcataggaacaacatcattttctccaatgctgtttttcacggccagaaattaa

SEQ ID NO: 44027 - DNA, 747 bp, Glycine max
  Peptide Sequence Number=SeqID_135712
atggggacaaggggttgcattaattacaatctcgtcctcgctataagacaacttggctaccctatgagaggggcaccactagaggaagacctcacacctattattgcacgaggtttcaatagcaccaatgcggaggcacttcagaaggtccgcaaggcatgggagatggggcaaaataaggacaaggaactcagaggcagtagcaacgggcccttcgatggctaccataggtggttgaaagcctacacgcaaggtctggattggctaccgaatttgagaaccactaagggggtggaagttgaagctccgaaggaggacgaagaggtgcaggccctcaggacagaactcgagaaagcccaaacagtcaaagaaaagttcaaatcagcagctcttaggattcaaaaggagaatgccgaactgagagacgtaaatatagccaccaccgaggccttggaacaagagaccaaaagggcccgtagggaagaacatggccggaacaaattccgaggggctctgtggggcagtaacagcgagcttaagcttcggaaagaggaaagtaaccaatcacgagtagacagtttgatcttgaaggatgaattaaggatttgcctaaggtccaagagaagcttgtctcagcggttatgcgagaccgagaccaacatgttagccatcctcacgaacccttctttagtggacgtagtggtggaagagacttccttactccaccctactcttcctccaccatga

SEQ ID NO: 44028 - DNA, 159 bp, Glycine max
  Peptide Sequence Number=SeqID_135713
atgggtgccaagcacctcacaaggaccaaagaaaggtcgcatgtcatcaagcaaagagtcgcgggtgaccataaaatctccgcaaatgacttgtcgttcccggaatttcacaaatcgcctaatgatgggtgccaagcccctgacaaggaccaaagaaag

SEQ ID NO: 44029 - DNA, 462 bp, Glycine max
  Peptide Sequence Number=SeqID_135714
atgaccggtagattgctggccggatcattgacctttgataatcgtatcatgcactacattattgttagaattttgcttccccggtcttcaaatttggctcaagcctctgaggaggacttgattttgatgtgggctttccttaccggtcgtcagatcgactgggctcacttggttcagtaccgaatgcatatggcattacgggccaatgcacctctcccttaccctcaattggtcactctgtttctccatcattttcaaattccgcttgatgatgaaccttttgttcaagtcaagcgttcctttgctataggtgctggtgcagtcacttcatttggataccaacgttttgattcattggataatcgctttgccggaatggatatctgtctcacacatcttgaagaagatgtgggttatattcgccagagcttcgatcttccaccaccacctccaccttcttag

SEQ ID NO: 44030 - DNA, 426 bp, Glycine max
  Peptide Sequence Number=SeqID_135715
atgcgttcatgggtgaggggtcagtggattccctttgacgcagatgccctcagccagttcctgggtgacccactagttttggaggaaggccagcagtgtgagttcagccagaggaggaacagggtcgacgaggagaccattgcccagctgttatgcacaacggggcaggatttcgcccggacagctgcagagaggcgggtgcggatcatgcgcaccaacatgaccactttgacccagacatggatgacactgctgctcagcaatgtcatgcctagcgatcataactccgatctccctctgcctaagtgccagttggtgtatgccatcctaacatggatgaacgaccacgtggccctggtatgccacccaccaggcaccctttggacccggataagtctaatagggccctgtggtttccagcgttga

SEQ ID NO: 44031 - DNA, 99 bp, Glycine max
  Peptide Sequence Number=SeqID_135716
atggcgcctactaggaacctgttggacccagagaagtccaatagggccttggggtttccggctctggtcacaggcctctgccaatccttcggatttcag

SEQ ID NO: 44032 - DNA, 703 bp, Glycine max
  Peptide Sequence Number=SeqID_135717
cggcaagctttttgcaaagcttacgataaaatctgggacctagccatggtagaagtctccatagaggccattgcctccctcgcccagtattatgatcagtcgttgaggtgcttcacctttggggacttccagttatcacccatggtggaagaatttgaagagatcctaggatgtcctctagggggaaggagaccatacctcttctcagggttctatccctcattagctagaatttctaagatagtccaaatctcggcgcaggaattagaccacagaaagcaagtcagaaatggggtggttggaataccgagaaaatgtttagaggcaaaagcaagaatcttggcagcgatcgacgcttttctcgcctatcatgaccacaaggaaagcctggttgtcgctatgctagccgacctatatgacacttacgaccgaagatgtgagaagagcagtacgagggttgtttgctatactccagctctttatgtatggttggtttcgcacctctttcgccaagaggtgagacatgcttgcccgctagaaagccaccgttcatgcacagagaaaggaggggcaaattgggaccaactcttagcaaacaaagaaggagcgtctgtcaactggttcccccaaaggaaagaaggaagaaccggggttcttatttcgtgtagaggatttccaaacgttcccttgatggggacaaggg

SEQ ID NO: 44033 - DNA, 259 bp, Glycine max
  Peptide Sequence Number=SeqID_135718
gaagcggaagagcgcccaatacgcaaaccgcctctccccgcgcgttggccgattcattaatgcagctggcacgacaggtttcccgactggaaagcgggcagcatgcaagcttggcactggccgtcgtttacaacgtcgtgactgggaaaaccctggcgttaccaacttaatcgccttgcagcacatccccctttcgccagctggcgtaatagcgaagaggcccgcaccgatcgcccttcccaacagttgcgcagcctga

SEQ ID NO: 44034 - DNA, 219 bp, Glycine max
  Peptide Sequence Number=SeqID_135719
atggcggagtcaggcctagaagagtcagagtgggctcaagcacgctacgaccaacttaaccttattgaagcaaggagcagaatcgtctcaggccacggtcagaagtcaaggcaagtcaatggcagaaatcaaccaaggtacatagggacggatgcaagcggggctagagtcatgaccgaccgatcattgccccttcccggcgctaaacaagcagagaac

SEQ ID NO: 44035 - DNA, 471 bp, Glycine max
  Peptide Sequence Number=SeqID_135720
atggctgctagtggccatgcaattctgcgtgatagagcccacagtcctaccaagagaagcctgctagagctttcatcgcaagatgcattgttggcacaaaacaagctgttgtccaagcaattggaggcattgactaaaacattaagttgtgtcatatgtggtggagcacatgagtccggctgttgtattccccaagaagaaacaacacatgaacatggccagccatacaattcacaacagggacaatggaggaatcaccctggaaaccacttcaacaaagaccagggtggtccctctaataggccaccacaacaagggcctagtctctatgatcaaacaatgaagctggaagagacttgctcagttcatgcaagtatctatgtcaaaccaaaagagcacagagccagccataaagaatctggaagtccaggtgggacagttggtgaaacaattggcagatcgttcgtctag

SEQ ID NO: 44036 - DNA, 597 bp, Glycine max
  Peptide Sequence Number=SeqID_135721
atgggtgaagcagaggaggtgcaagagaagatgaaggccgaaatggaagccatgaaagagcaaatggccacaatgatggaggccatgatgagcatgaagaagataatggaagccaatgcggttatagttgccgctactagcgctgtcgctaaggtgaacccgatgctcccatctggcctcaaccaaatgaatcatccaacctcaaatatggagacacatgaaattccctaccacaatctagccgactttgagccttgcctcggatatgccgctgaagggcaagcagttggtggtgtacccctgcaaaacactttggagggccctcagtatcatccacaaccacaaccctcgcgtttcacaacggaaatgctcagggccattgaaggaggtgaagattatgcctttgctaacctagaagagttgttcctagtacccaatatcgtcacccctcctaagttcaaggtgccagactttgacaagtacaaagggactacttgctccaagaaccacttaaagatgacaactgtcacctggtatactaacttaggaaccttcctgagtccattcttggaaggacctaatggttgccctcgttag

SEQ ID NO: 44037 - DNA, 249 bp, Glycine max
  Peptide Sequence Number=SeqID_135722
atggcacatgagattcaattgtcctgtcttcaaaagaagaatgaaaaatctgacaagaggaatttcaaagagaagaaagaaaagaaaggatacatcacttgggaagatagtgtcataaactcatacttagcccatgggcccaaaatctaccgtaaggctcatgagaaccctagggccttctcttgcatctttgacccaatctacttggagtcttctatccaatgcccttgcggggtaataagtacttag

SEQ ID NO: 44038 - DNA, 159 bp, Glycine max
  Peptide Sequence Number=SeqID_135723
atgggagatcgcttagaggacatgattcgtgatcttggacaagagtcttttcagcaagcacatgcccttatgtataatacattgcaaaatgattcaaagaagcctttgtatccgaggtgcaacaattcattgacactgttgtcagcgatgttaagtttg

SEQ ID NO: 44039 - DNA, 240 bp, Glycine max
  Peptide Sequence Number=SeqID_135724
atgcaggcttggagttttaccctttgggtggagattccaaagttctcgctagttgataatcaagtggaggcacctgaagaaaaagcaaataagataaaatctttcttcatttatgcagtgggcaactgggacgctgaattttatgccaagagggactggggagagcataccattcatgaaaaacaaacaagagaaactattggtaccgataaaaatcatacacaaaaaactattctttaa

SEQ ID NO: 44040 - DNA, 174 bp, Glycine max
  Peptide Sequence Number=SeqID_135725
gtgaaaaagaggctaagccatgaagtgctaaaagtgacagttgagcttagctcatcagttgggctaagcgcgcatccaccgctaagtgcagcttcagcgcacttagcacgacagaagaatctggcagagaatcaatatcaaggtcatacactaagcgcgagatcagtgcgctaa

SEQ ID NO: 44041 - DNA, 219 bp, Glycine max
  Peptide Sequence Number=SeqID_135726
atgcctataggttggacctcccagaagagtggagctgatattgaggaggaggaactaacagatttgaggtcaaatcctcttcaaggggaaggggatgatgcaatcctccctaggaagggaccaatcactagaaccatgagcaagaggctccaagaagattgggctagagttgctgaagaaggccctagggttctcatgaaccttagggtagatttctga

SEQ ID NO: 44042 - DNA, 317 bp, Glycine max
  Peptide Sequence Number=SeqID_135727
atgtcagcgttgcctccaatttgtgtggttggaagtgtagcgtggttcgcggtggtgccactgatttgtttccatgttgttgagtggcaccaacccgatagagttttgcgacaatttggaatgcaacaacctattcccgggtgtccttcgcaaccacagaatctccatgacataacgctcaaaggcaaacaagatgaaaattggggacaattatgggccccactgataagtcaatggaacaatcgaactgagtttaaagtcgacgtttatcctcgacaagatgtcctgttgagttttaactccgactacatggtctg

SEQ ID NO: 44043 - DNA, 249 bp, Glycine max
  Peptide Sequence Number=SeqID_135728
atggcggtgctcaaggtggcattgtcgtcagtccggatttattgttttcgaattattatggccaatagtcacaagagtaggaaaaggtcactctcactaagtaagatcatagggagaccagtcagggtcacgatgttttgcgagaatactccaaccatatgggatcagcataggcttaaagaagcactcaaacccggtgacccccaaggcctacactccgaagagtccgtcagggcctctccctcctga

SEQ ID NO: 44044 - DNA, 633 bp, Glycine max
  Peptide Sequence Number=SeqID_135729
atggagagaagtatgatagatactgccagtggtggagcccttggagacatgacccctgctgaagccagaaatttaattgagaagatggctttcaactcccagcaatttagtgccagaaatgatgctattttcattagaggagtgcatgaagtagccacgaattcatcttcatcaggtgagactaagaagcttgaaggtaaacaagatgccttggttaacctggtaacccaactggtcatgaatcaaaagtctgcacctgtcaccagactctgtggtttatgctcctttgccgaccaccacacagacctttgcccttctatgcaacaatctgaagcaattgaacagcctgaagcttatgctacaaacatctacaacagacctcctcaacctcaacagcaaaatcagccacaacagaacagttatgacctctccagcaataggtacaatcccgggtggaggaatcatcccaaacttagatggtcaaatccttcacaacagcagcaacaacaaccttattttcaaaatgttgctagcccaagtagaccatacgttcctccaccaatccagcaacaacaacagcaacaaccccagaaacagcaaacagttgaggcctcctccgcaaccttcccttga

SEQ ID NO: 44045 - DNA, 243 bp, Glycine max
  Peptide Sequence Number=SeqID_135730
atggcctacaagactaagcccagcatggttcagtccagcactgatcagagtaaggaaactgattctgaaaaattaaattttgaggtggagattgaggatagacatgctgagacacaagctgttaattggcctcttgatgaagagaaatctgaagaagaggaacaagaagaagctgactatgtgctggctcgagatagaactagaagggaaatcaaactgttggatcaagtggcctcagaataa

SEQ ID NO: 44046 - DNA, 258 bp, Glycine max
  Peptide Sequence Number=SeqID_135731
atggattgtcataatcaaaaagggggagattgtggaagcaatgctttccaggattattttgatgatgccaaagaatcaagaattaagcaagtcccaaagaatcaggagtcaaaaagcttcaagaatcaagtttcaaagaatcaagattcaagaataatcaagtttcaagatttaatcaaatttcaagaatcaagattcaagaataatcaagatcaagattcaagaatcaagagaagactcaatcaagataagtactaa

SEQ ID NO: 44047 - DNA, 291 bp, Glycine max
  Peptide Sequence Number=SeqID_135732
atgtggaagaggataaggagggtggaattggtgctgtggatgcgctggtggctccggaacgatgagctcttgaagccgaagcggaggcggatgaacccttatatttcaatcggtgaaatcaaaagaaaattgaaaaagaagaagattgcaagttacgggagtcgatttgatgaagaaatgagtaagataggaaggtttcgaggtttgggaatggaggaatgtcgcaagagggaagaggctgcgcaggggtttctggaaaacgtgatatttatagagcaagacgcattgtaa

SEQ ID NO: 44048 - DNA, 162 bp, Glycine max
  Peptide Sequence Number=SeqID_135733
ttttatcatttgagccttgtcgcaacctacccttcggcgggagggcgacacgagggctcgcgggtgcgtcttccatgggaggaaaatgcacggagtcgccaccaacgtttgtttgaggaaaacgtcggaaaaatcgaaaaaggcgtggtctacgaactttaa

SEQ ID NO: 44049 - DNA, 252 bp, Glycine max
  Peptide Sequence Number=SeqID_135734
atggccaaccttaccagcagtagaatcaatggagaactcaccctggcagggcagctagccaaacagcttgcagaaaaatcttctagtacttttggagctaatgtggaagcaatgccttccaaggttattttgatgatgccaaagaatcaagagttaagaaaattccaaatattcaagaatctagtttcaagaatcaagattcaagattcaagattcaagtatcaagtttcaagaatcaagattcaagaataa

SEQ ID NO: 44050 - DNA, 435 bp, Glycine max
  Peptide Sequence Number=SeqID_135735
atgactctcattggttggaagtaccaaagactccctagcttcctgaaaacaaaagtaagagcatcttctccttcaattgcgctaacagctcaaatagcaacgatggtaatgacgatagctttacaggaattgctttctttagggattctatttgaaaaacagtataatgccacatctgactcaacagcttcttcttccttttctgattcatgtgcaaaagcccttcaactatatgcaagcactttttcttgctgtagaaagtctaaagtatcgcaagtaaggcagcaagaagaagaggaggctcggccattaacagttgcgttagaattgcctttccatccgccgctgaagaaagaatctcacccttcagctgtccctactattcgacatttccctgaggagtcaatcagtgagggagggaagattcaagactga

SEQ ID NO: 44051 - DNA, 210 bp, Glycine max
  Peptide Sequence Number=SeqID_135736
atggcctctggtaatcgattaccaagggtgtgtaatcgattacaaggcttaaaatggaggcaggatgtaaaaatggtctctgctaatcgattaccaattgtgtgtaatcgattacacagagtaacagggcactgtaatcgattaccaattgggtgtaatcgattacacagggagataggacactggtttccatgtgcaaaagctgtataa

SEQ ID NO: 44052 - DNA, 921 bp, Glycine max
  Peptide Sequence Number=SeqID_135737
cattccataactggtgaatctgtgcattctgttattggtgattttgaacatcctgatcttgagcattataattttgagcattctgattatgagcattctgattttgcacattctgagaacatggcacaacctccaccctgtgagaggactctaagggaaattgctgcacctgatttcacctacgaaagcttgtgcatccaataccctgatgaggatgtcccatatgttcttaaaactggactgattcatttgcttccaaagtttcatggccttgcagagggagtggcaaaggactggctgtattaccttgctccaaggtccatcacgagctgggatgaccttaagagagtattcttagaaaaaattttccctgcttccaggaccacatccatcagaaggatatctcagatgcttgccagtggtggagcccttggagacatgactcctgctgaagccagaaatttaattgagaagatggcctccaactcccagcagtttagcaccagaaatgatgccatagtcattagaggagtgcatgaggtagctacaaacccatctgcatcatctgaaactaagaagcttgaaggcaatctggatgcattggttaacttggtaacccagctggccttgaatcagaaatctgtacctgtcgcaagggtttgtggtttgtgctcctctactgaccaccaaacagacctttgcccttccatgcagcaacctggagcaattaagcagcctgaagcttatgctgcaaatatttacaatagacctcctcaacctcagccgcaaaatcaaccacaacaaagcaattatgacctctccagcaatagatacaaccctggatggaggaatcaccctaaccttagatggtccagccctcagcaacaacgacagcagcctgctccttccttccaaaatgct

SEQ ID NO: 44053 - DNA, 378 bp, Glycine max
  Peptide Sequence Number=SeqID_135738
atggagaatgatctgggcatggacaagcttgagtcgtttcatggaggaacattggtccaagagatggtgaagggtttgagagccaacggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 44054 - DNA, 419 bp, Glycine max
  Peptide Sequence Number=SeqID_135739
cgtgactcaaaagtcagtatgacagatcttgtgagcgcggaagatgacgcttttcgtattacagatagcaaaaaggtttatacggataaccactcgggtatctccgcccgtcagcgtgactcaaaagtcagtatgacagatcttgtgagcccggaagatgacgcttttcgtcttacagatagcaaaaaggtttatacggataaccactcgggtatctccgcccgtcagcgtgactctaaagtcagcatgacagatcttgtgagtgcagaagatgacgagacgacgtttgcctctgcgtgctatcatgcttttcgtcttacagatagcaaaaaggtttatacagataaccactcgggtatctcagctcgtcagcgtgactcaaaagtcagtatgacagagcttgtgagtgcggaagatac

SEQ ID NO: 44055 - DNA, 945 bp, Glycine max
  Peptide Sequence Number=SeqID_135740
atgagcaccaccgatatccgcgtcgtacctggcccggcgaactacttttcccactccggaagccttgcgcgtctgaatgacttctttaccccggaacagctttcccgcgcggtgtggatttacggcgagcgcgccatcgaaggcgcgcgccctttcctgccggagagttttaacgcgccgggggcgaaacacctgccgtttaaaggccactgcagcgagcgtgacgtcacccacctggtacatgaagccggcagcgaggcgagcgtggtgattggcgttggcggcggtgcgctgctcgataccgccaaagcggtggctcgccgtctgggtatcccggtagtggcaattccgaccatcgccgccacctgtgcggcatggacgccactttccgtctggtacaacgacgccggtcaggcgctgcagtttgagattttcgacgacgccaacttcctggtgctggtcgagccgcaaatcattctcaacgccccggcggagtacctgctggcgggaattggcgatacgctggcgaagtggtatgaatcggtggtgctggcgcctcagcctgaaaacctgccgctgaccgtgcgtctgggtatcaacggcgcgctggcgatccgcgacgtgctgctggcgcacagcgaggaagcgctggctgaccagcagcgcggcgaacaaacccaggcattcagggacgtggtagatgccgttatcgccggtggcgggatggtcggcggcctgggcgagcgctatacccgcgtggcggcggcgcatgcagtgcataatggcttaaccgtgctgccgcaaacggaaaaatacctgcacggtaccaaggtggcctacggcatcctggtgcaaagcgctctgctcggccaggaggatgtgctggcacagcttatctcggcgtatcagcgtttcaacctgccgaccacgcttcgcgctctggag

SEQ ID NO: 44056 - DNA, 135 bp, Glycine max
  Peptide Sequence Number=SeqID_135741
atgggacctctccaaaggcaagccttctgcaaagtgtacggaaagattctagatttgaccgcagcggaggtgtttacggaagctgtcgtatccctcgcccaatactatgaccagccgttgaggctaaaggcctaa

SEQ ID NO: 44057 - DNA, 117 bp, Glycine max
  Peptide Sequence Number=SeqID_135742
atgaggataccgggttgccttgcaacggtgctttctgttagcccagagctgggcaagggaggacgatccatcggtcgtgaccctagcctctacttgcgtccatccctaagtacctga

SEQ ID NO: 44058 - DNA, 1134 bp, Glycine max
  Peptide Sequence Number=SeqID_135743
atggcctccaagaagaggaaagccacaacatcccggctccaggagccctatgataccaccaaattcacttttgagggggcttgggaacgttattcacagaatattcactcccggaatattcttccggagaagaatgttaatctttttgtcacaaaatacgacgaattccggtgggagctgataaggcggaactggcacaaggccttgacccagttcatggacgagcacattgatgtggccctggtcaaggagttttactcgaacctgtatgatccagaagacaaatcaccaaaacatgttcgagttagagggaggctgattaagttcaatgcggcatcactaaatgcctttctggagacaccaccactcatccagccaggggagcagagcgccctagaagctcctgaggaaggatctgacgacactagcccagacttggaggacccgcaaggcccaggccagggtccatctgctactacttctacaccttcagctccttctgcatcagtcccaccactaccaccatcatcagctccaactctagttcataccggcacctccgctcagagctcagatcttatggtgctgatgttgcagagcctccaccatggctcatgcctggtgatgcagagtattcacgacttggctcaacatcgtcccatcattagcatggaggatttcatggcccaagtggcctggccaggagtccagccttctcctttgggaggaggtcaggcttccacagcccaggagcctcagccgcagccagagaccactccacgaacatcaccagttaccacaccagtcttggaggtctctaaggaggaggatggtgctgcagatattggctacgtagtagatttacaggcaacgcagagcacctgggatccatggcctactacagctcaggatattcctcagccagcccaggatgctccctcttcacctcaagatgagcctactgcagcttgtgcgcttagcgagaatcatgcgctaagcgaggcactcagcccgcttagcgagttggaagaatcaagaggagaatctgagaatcatctatgtgctcagcacgtcatcagctcgcttagcgagtcacttgtctcttcatgcgctaagcgcgctcaactcgcttag

SEQ ID NO: 44059 - DNA, 354 bp, Glycine max
  Peptide Sequence Number=SeqID_135744
atggtaggcaaagatttgggaagtacgggcggcccccattatgcgcaaagtcaaaacaagcatgccttcccaccatatggcttgcctcccaactatacaccatccaatgtagcgtacactcccaccgacctcgagccttgcctcgaacaggccactgaagggcaagcagttggtggtataccccttgaaaacactttggaaggtcctcagtatcacccacaactacacctcttgcattccacgataagtaaaaaccctcatgctatggcagaaatgggaaagctggatcatctagaggaaaggctcatggccattgaaggaggtgaagattatgcttttgctaacctagaatag

SEQ ID NO: 44060 - DNA, 360 bp, Glycine max
  Peptide Sequence Number=SeqID_135745
gaggcaattgctgatgatgtagttgtagatgtcgagggttttccaggtgggccccacgttacatcagttttcatggactatgttcatcatgttgtagtcacagtttggaatggaaaggaacgtcctgtgttgaagttgtcttcccatggaagttgtcctcccatagagaaaattggcaggcctgctccagagattgaaggcttggtggaaactagtagtttccatctttcagtaggagaggtcactatcaccctggatgatgtggcattgttgctacatctgcccattataggcgccttctatagctttgaggctcttcatgtagaccaagtcgtggacttgttagttgacttgcttgaa

SEQ ID NO: 44061 - DNA, 92 bp, Glycine max
  Peptide Sequence Number=SeqID_135746
atgggaaaaggaaagcactcactgagtcatgagcctgatgagttgaccaattactctaccccgctttcttccccaactcctcctgaatcctc

SEQ ID NO: 44062 - DNA, 222 bp, Glycine max
  Peptide Sequence Number=SeqID_135747
atgcattgggggttgtccttgctcagaaaattgataaatagcctagggtggttgatccgatggatgctttggctccaagagtttgacttggagatctgtgatgcaatcctccctaggaagggaccaatcacaagaaccatgagcaagaggctccaagaagattgggctagagctgctgaagaaggccctagggttctcatgaaccttagggtagatttctga

SEQ ID NO: 44063 - DNA, 703 bp, Glycine max
  Peptide Sequence Number=SeqID_135748
atggctgacgtttcaagaggaccgacccaacgtaaagacaaacccgcttgccaatcatggaggggggctgttaatgtcgtcgagtcgggtaggccacgtaggtccaaacctttgaaggatgtaacaacccccacaaggtttatctatgaggccctacaaaaagggggcataattccccgcggtgggcacgagaaggattcttatttgatgcatcctagcgcgccacatagcatggaagcatgtttagcagtaggagacctattgcaacaaatgatagaccaaggccggctggaagtcggtgatgaggggggtgaagaacagcatatatgcatacaatccacagatgaggaaggtcttagaaagcctaaacctttggtgatacatttcaccagggacgcagctcgccaaacgccccgacacccctcagtagttagacctattccatttccatacaaaaacagccacgcagtttcgtggaggtacgcgcctccaagtgaaaggaaggaaggagccaccgacatcagctcgctattggccaaagtaaccaatatcacggggctgagcggcatgacccgcaatagtcacgtattcgcaccccctgacctgccgacacaacccgcaaacactaaagggaaggcaaggatgacggaaggtcaaaatgtcaaagtgatccccgctccggacgaggatgtttcgatgaaag

SEQ ID NO: 44064 - DNA, 81 bp, Glycine max
  Peptide Sequence Number=SeqID_135749
atgaataagaaggataagtggtggctggacagaaatatagaaatggcaataactgaagctacagggctccaaatgaggtga

SEQ ID NO: 44065 - DNA, 192 bp, Glycine max
  Peptide Sequence Number=SeqID_135750
atgttggaagatcccgcttcggtagaaggtgtcctctcggtgtggagaacaacgatgttgcaaaccaaatttcgagaagatccaacggttaacgaaggctgggcagcgtttttaccgaggcagcttcatgtagctttctctagaagcttcattaagaggcttcctccagaagcttcctcgtggcttctttga

SEQ ID NO: 44066 - DNA, 195 bp, Glycine max
  Peptide Sequence Number=SeqID_135751
gcggaatttgaaatcccaaaggcttctgaaagtaggacgaagaagaagttacttaagactgttgccgatcagaacagtgtagacgacactgtctatgagaaatacaacataagcaaggaaaaatgggcccagttttgccacactcgtagagacccttcttgggaggatgtgcagaaaaaggcacgggccatctag

SEQ ID NO: 44067 - DNA, 648 bp, Glycine max
  Peptide Sequence Number=SeqID_135752
atggctaagtttgaccctgatatagtcctggagtttaatgctaatgcttggcccacagaagagggagtgcgagacatgcggtcatgggtgaggggtcagtggattccctttgacgcagatgccctcagccagttcctgggtgacccgctagtgttggaggaaggccaggagtgcgagttcagtcagaggaggaacagggccgatgggttcgacgaggaggccattgcccagctgttatgcaccccagggcaggatttcgcccggaccgctgcagggaggcgggtgcggatcatgcgcaccagcatgaccaccttgacccagatgtggatgacattgctactcagcaatgtcttgcctagtgatcataacttcgatctccctctgccgaagtgtcagctagtgtatgtcatcctgacacggatgagcgtccacatggctcagttgattgctgacgccatctatttatttgtaggtatgccacccaccaagcaccctctagacccggataagtctaacagggccctggtgatgcaatcctatcccgcaaaggcattgggtagaagactgcaagtagattgggctagagatccaagggaaggccctagggttctcatgagccttagggtagatttcgagcccatgggctaa

SEQ ID NO: 44068 - DNA, 213 bp, Glycine max
  Peptide Sequence Number=SeqID_135753
atgcagagccagggcttcgcttctttttcatgccctactctagaccagttcagggcagaggttgcatggcccggagattggcccgaggcccaagcgggagaggcacccccagaagctcccggcgacggagaagaggcccacgaggatgaggagatggccgatttgcttgacttcttgggagggagtggagataccgcatacatttttgtttag

SEQ ID NO: 44069 - DNA, 327 bp, Glycine max
  Peptide Sequence Number=SeqID_135754
atggagaattggcgaacaacgctaggcaatcaattcgcggggcaccagactcgttggtggaggatgcatgaacgatgtcgcaacgtgcccttttgcgggcgagcgaggcgaggctcacgggtgcgctttccaaaggaggaaagatgcgcggagtcgccaccaacgtttatttgtggaaaaggtcagaaaaaccgaaggaaaccggtcaaaatgaaaattctaagttcgggagttatatttacgcttggggaaggtattagcacctctcacgtttgtctcgaaggacaacagcctatttttagatttgtggaaattgtgttaccttaa

SEQ ID NO: 44070 - DNA, 480 bp, Glycine max
  Peptide Sequence Number=SeqID_135755
atggagattattatttccgttccactaataacttgtgatttttgccgaagggagcattaccaggataattgttatatgtactccacaaataactctgggtggagacagttaactccctataatcagtatgaagagcaaagagtccccgatcttgacattgtgtttgcagaattcatggcatatcatgctagttctaaagctaatcataatgcaatacaaaagcaggagattcaatgtgctaaagttttttttgaagattatcaaggggaaccagagtcacaattctactatcaaaatgaattagaaaggagtttcaatctggacattttgttaatgcaattcaaggatacaattggatcaattcaacgggcatttaaaagtgcagaaattcaggttggtaagctggtagaagaagtgactcaagctatgagcagaagagaagaagagattgtaaaggttgacactcaagaggagagccct

SEQ ID NO: 44071 - DNA, 207 bp, Glycine max
  Peptide Sequence Number=SeqID_135756
atgaatagcacaagttttcaaggtttggaaaaccagaaaacttcagaaagtccttttggtacaaagaagaagaagaagttcaaagagattcacaggcttgtaaaggattgtaatgaaatgattggaaaagtattcaagattattgaaatgcaaaacaaagccttgcttttacagactcttcatgtctggtcaagaagaccattttga

SEQ ID NO: 44072 - DNA, 242 bp, Glycine max
  Peptide Sequence Number=SeqID_135757
atgttgcggaaccttacggattacgtaatcatcccttttttgccttccggaacgttacgaaactttacagattgcgcactaacatttctttttaatttccggcatgccacgaaacttcacggattgtgctacaacgcttttcttttggcttccggcatgtctcggaacttcacaaattacctaagaatgggtgccaaatacctcgaagtggtcaaacgagggtcgcatcccaacaacggatg

SEQ ID NO: 44073 - DNA, 507 bp, Glycine max
  Peptide Sequence Number=SeqID_135758
atgttgttttatgtgaaacccgctaagcgactcacgctttgccaagcggggatgtcttcaaggaaaagaaagagtgtcggttcaaggcccactcctcaatatgatacacgaagattccagtcctttgaggcttggaccagatatactgacaatgtgttgggaagatacatattagttgagaggaaagtggaaatctatcacacagagctgggtgaattcaagggtgagatggagaggcgtaactttcacaagcgcctcaccaacttagctgatagtagcattgacctcgcattggtgaaggagttctatgccaacctctatagtcccgagggaccttcacctaaacaagtcagaatccagagccacttaataacgattgatgcagacaacctcaatgcctttttagaaacacctgtggtgcttgctgagggtgaatctttacccgcttactcaagatattgtaggatgcctactgacaccagagaaattgaggttgcactgtgctga

SEQ ID NO: 44074 - DNA, 279 bp, Glycine max
  Peptide Sequence Number=SeqID_135759
atgtgtcgttggcaacgcactaaactttttgtggatgagctgaggggctttggaggtggcggcagtgcgtctgttactcgctgctggccatccctaggctactgtggtgtctcgccctgcgcttgtctggtagcgcaggggcctgatgaccttgctgggggcgacaggcactctgtagaactgacagaggcccgtaatcagagctggaaaccccaagaccctgttggacttctccgggtccactgggtgtcttgcgggtgcgatccttgcaaacaatag

SEQ ID NO: 44075 - DNA, 279 bp, Glycine max
  Peptide Sequence Number=SeqID_135760
atgcctgcaggtcgactcctagaggatcccaccaatttttgtagcacaagatcggtttccaagttgaacctcactatcattccccatccaaaaccttataaacttcaatggctcaatgagcaaggggaaatgatagttaaccaacaagtgaaggtagctaataatcaagtacaaataaaaatcaaatgggatgaggaaaagaatagaaaaagaaaagaagaacaacctttaatggttaaggaggagtgtaaggaggtagtgtctcctccaagaggttag

SEQ ID NO: 44076 - DNA, 282 bp, Glycine max
  Peptide Sequence Number=SeqID_135761
atgctggactcgtttggcagtgatttccttggcaatctgatgctcagaaacagcaatatccaccactccatcagttggtctgcccagaccatacttaagggaagggtttttcctgtatttgactttgaagatctttctgcaatgccaggtgctaacttgttggcaatgggttcctcattcagattcgacttgcttctaagaatgaggtcacctggagcaggttctggtgcccttggtgcagggtctcctctgtggattgtcctcttcatctgtgactcctag

SEQ ID NO: 44077 - DNA, 222 bp, Glycine max
  Peptide Sequence Number=SeqID_135762
atgagaggtaaatcttcagtagggaatttaactccattggatttggagatagaagccacttgcaagagaaacaacgccgagagaaggagaaaaattttgcaagaaaggacagcacaaccaagtttggaggaagttcaatcatctaaatcatcttcagcatttccagacttaagggaatccgaagtaggtgcatctgaagcccatatcatggctgaagattaa

SEQ ID NO: 44078 - DNA, 246 bp, Glycine max
  Peptide Sequence Number=SeqID_135763
atggagaaggaagatgattggagacaccacttcaaggagaagatgagtcaagaagaagctcaccaccataggaagccatggataagagcttcccatgggcccaaaatctatcgtaaggctcatgagaaccatagggtcttctcttgcatctctgacccaatcatcttggagtcttctatccaatgctcttggaggataggattgcatcatatggccacgactaacaattgttacatcaagacgtga

SEQ ID NO: 44079 - DNA, 222 bp, Glycine max
  Peptide Sequence Number=SeqID_135764
atgacaaacaaagtgaagaggatgtaccatcatgtggagaacaactcagaaggtcacaaagagagagacaataaagggattttcatgtatcaaaagaagtatgtagaagacattccaaaaaggttcaatatgatggagtgcaattctgttatcacaccaactgaaactggaattaagctgcaaatagatggagatgagaaagaagttgatcctaccttgtag

SEQ ID NO: 44080 - DNA, 513 bp, Glycine max
  Peptide Sequence Number=SeqID_135765
atgcaaagccatgttatgtcctctcccctcagcagggatttcctcttcagcgaaggtgaggtagttgttggccgtgatgttactgacgagtcccccaaagtcttctacggagatgtcttgggctacatgagcttcattcaagacttttaccagcaaagctcggtgaggctcagagctcatgagcagttccaaaagagagactctagctgggccctctcttcccttgaaaagacctttcatcggaacatcctcacccagagcggggatcactttgacatttggtccttccatcatccttgccttccctttagcatttggggactgcgtcggcaggtcaaggggtgcgaatacgcgaccgctgcgggttatgccgctcagccccgtgatattggttactttggccgacagcgagctgatgtcggtagctcattccttcttatcgctcagaggcgcgtacctccacaaaactgtgtgactatttttgtatggaaacggaataggtctaactactga

SEQ ID NO: 44081 - DNA, 312 bp, Glycine max
  Peptide Sequence Number=SeqID_135766
atggttaacgactcaaggattgggacgttactgaagacactattaagtcttgtggatgtgtgtattgaattgattaacggtgaggatcagagcaattcgagagagaaaccggaagagactacaactataagagatgatgcattgcggtggttgacaatgttaaggcttggagggattgatgggaacccagtgctgagaggaacgaggagaagaactacgggtcaggagaccttggggacgtcaggttgggtgctattgcccaaaaccaagcttgaccaatcccgacctaacccgggcatagtcagccagtga

SEQ ID NO: 44082 - DNA, 354 bp, Glycine max
  Peptide Sequence Number=SeqID_135767
atgttaactgtgagctgcatagttgatatagggagaaagaagttggagctggactttgaagatcagaaaattgattttgatttgtttgttgaagacaagcttgctccaaagcacaatgtttgcttacaggtaatggaaggaggtcaagaggttctgaaaaaaaacagtcctttcgctaagcacaagccttgcgctaagcgcatctctgttcatgtgctaagccgggagtctcaagtgcttagcgctcaacctttgcatctaaggctcattcattctactaaggtagccaaggccaagctgagcctaatcgaatttgatctgaattcggctaagcgacaccttatccttggctaa

SEQ ID NO: 44083 - DNA, 572 bp, Glycine max
  Peptide Sequence Number=SeqID_135768
gagtgaacccttgggtactagaacctattgcctttagaggactacacgtcctcaccttcagagggcaacacaccctcaccttcagaggactgcacgtcctcgccttcagagggctgcacgccctcgccttcagagcactacaggtcctcaccatcagaggactacaaatcctcaccttcagaggactacacgtcctcgccatcagaggactacacgtcctcctcttcagagggctacacgccctcccctttagaggactacacgtcctggccttcagaggactacacgactacacgtcctcgtcatcagaggactacaaatcctcaccttcaaaggactacacatcttctccttcagaggactacacgtccttgccttcagaggactacacgtcctcgccttcagaggactacaggtcctcaccatcagaggactacacgtccttgccattagaggactacaaatcctcaccttcagaggactacacatcttcgccttcagaggactacactccctcgccttcagagggctacacgccctcaccttcagagggctacacgccctcaccttaa

SEQ ID NO: 44084 - DNA, 251 bp, Glycine max
  Peptide Sequence Number=SeqID_135769
agcgcacccgtgagcctcgccttcgctcgcccgcaaaagggcacgttgcgacagcactccctcctcaagatgagcgtactccttcacctcctcctcagcgtgaagattcagcactcctgaatgaagtccttaccgaattacgaggtcttcgttcttatgttggtgaccatttcgactcattagatatacgctttgccggcatggatattcgcctcacacagcttgaagaggatgtaggttacattcgttag

SEQ ID NO: 44085 - DNA, 507 bp, Glycine max
  Peptide Sequence Number=SeqID_135770
atgaggggggcgccgtcggtggagagcctcacacctttcatcacacggggtttcagtgaccccaacgcaagggtgcttcaaagagtccgcaaggcgtgggaagtggtggagagaaaagacagagaacttaggggaagtagcaacaggaccatcggcggctatcataggtggttaagagcctacacacaaggtctggattggctcccgaagctaagagccgctaaagaggaggaggttgaagcctcgaaagaaagagaggaggtgcaagccctcaaagcggagctcgagaaagcccaagcgatcaaggaaaaattcaagacaacagccgtcaaaatccgaagggagaatgacgaattgagggacatcaacacagccactgctaaagccttggagcaagaacccaagagggcctggaaggaagaacacagccgaaataagttccgaggagctttgtggggcagcaacaacgagcttaaactccagagagaagaaagaaaccagtcatga

SEQ ID NO: 44086 - DNA, 96 bp, Glycine max
  Peptide Sequence Number=SeqID_135771
tggcaaccaacggcggttcgtggtggccaccgatggtcgtgggtggtggagaagaaggtgttagggtttgggtgggcatttggtgtaacaccctga

SEQ ID NO: 44087 - DNA, 285 bp, Glycine max
  Peptide Sequence Number=SeqID_135772
atgaaacaaaaaccccccacacttattcccaaaacaattccaaagctccagaattccttaaggatcatgactgagcttcaaaatcaaggaaagggaaacaagactcaaaagggctatcaaaggaatctaactcatcaaggaagcatcaacaagaatcaagcccaaaggctattgtgcaagcaatcaatggggcaaaacacaccaaatgattatgaggcatgtcgatgtgctcaaattctcatcaaagctgtaaactcatcactttcaaactatcatgacatgtag

SEQ ID NO: 44088 - DNA, 159 bp, Glycine max
  Peptide Sequence Number=SeqID_135773
atggtggtggtggatggtgatggtggcacggcgtggtcaacggtggtgctgcggtggttgttgtttctgttggagaaggggagaatgggaagaaggggaaaaaggtgcgatggtgtgacacttcatcgaccatatcatcacttaacgaaagaggattaa

SEQ ID NO: 44089 - DNA, 141 bp, Glycine max
  Peptide Sequence Number=SeqID_135774
atggtgatcggaaacagtcagcgtcaaagtcagacgtataatttgaactcattagagatgccaaaagggtggctttcgcatgccaaccaatgccacttgcctactgtacacggacaagtccctcagcacttaacccattaa

SEQ ID NO: 44090 - DNA, 396 bp, Glycine max
  Peptide Sequence Number=SeqID_135775
atggaggacggggataacattctggatgccatatacgaggaggataccttagatgatgacgttgacatggttgatgttgaagaaggagagttggtggagcctgattcccaaaatgttttgggacaaagcagtgccggagatatcaacgaaccaaatcaagaacctctcagtaagaaccaaaagcgtagagctaacaagaagaagaataagaagaaaaggaagggttcaggatctaatgccatggacataaacagatttgtgttagatacatgtcgacggctcaaagagaaaaagtcatacatggtatacactgctgtgggttgccttggggtctctgcattaagtgatcttgtcaatgaggtagtgaaaccctgttatgtactcaattttgattga

SEQ ID NO: 44091 - DNA, 705 bp, Glycine max
  Peptide Sequence Number=SeqID_135776
atggaacagaagaaaggagaaagtagtatagccccagtcccaaaggtgaatgagagagatgtatcggtagatctccctctaagaggaaagaaaatcttgccaagttataagaccactcacttccagattcaggtttttcttccaaagttgctggttgatgttgattttgcatctgggatgcaagaatattgctgtccgaaacattgccgagatccctgccagaaaatgaaactggcactccttgagaagaatcctctttctttggcaccgacctttggttccctaactttcaagatgctccacaatatgccaccccctgtccggaatcgtctaccatcagcagttttctggcctccacaaagcagtattttgaagccattggaacacaaagagaagctatcaacagctagcggtgatgctttctctcaactggtagctaacatggaaatgacacaacttgaatgcagcctggtggacatttgtcaaggaatgggaagaaccgaagaggtgcaagagcacagggagtcaagcaacaaaagtgaagatgatgaaccttgggtccgaaaatacataacagaagatgcaggaacatcaaagctcaagcaggggtttggaaggagcaaactagcatctggaagaaaaatctgcaaggttagggacaaaattgcacacatcagagaatacgaatacccgtatggtgcttga

SEQ ID NO: 44092 - DNA, 237 bp, Glycine max
  Peptide Sequence Number=SeqID_135777
atgatacaacaagttgttgaacaacgcaaaaatcacgaacactgtgctcgcaacgagaagtctccctacaacgagcattcaagattgccgctggagaatcgtggtggaggaaggtggcaaacatggagaggatatcaaaaagtggccatgaaaagtgacaatgacgacagtggcattggcgggaatgaaagaaggttgatggagagtgacattggcgatggttctagaattggttaa

SEQ ID NO: 44093 - DNA, 1974 bp, Glycine max
  Peptide Sequence Number=SeqID_135778
atgaagcgcatgaatgagagtaacaacaccgatgatggaaacaatcataactggttggggttctctctctcgccccacatgaaaatggaggttacttcggcagccactgtttccgacaacaatgttccgacaaccttctacatgtccccttctcacatgtccaactccggaatgtgttacagtgtcggggaaaatggtaacttccattctcctcttaccgttatgcctctcaagtctgatgggtcacttggtatcttggaagctctcaatagatcacaaacgcaagtgatggtgccaacttcgtctccgaaattggaggacttcttaggtggtgcaactatgggaactcacgaatatgggaaccacgagagaggtttgagcctagacagcatctattataactcacaaaacgcagaggctcaacccaacagaaaccttctttcacatcccttcaggcaacaagggcatgtgaatgtcgaaacacacccttattactctgtatttgcttgtcgaggtttgtatcaggcaccgtcggaggaagaagcaacaaaggaaacgcacgtttcagtaatgcctcaaatgacaggaggaggtttgcaaaactgggtagctccaacaagggagtattcaactcatcagcagattctggagcagcaaatgaactgtggcatttggaatgagagaagtggggtatctgttggaactgtggggtgtggagagttgcaatctctaagcttatctatgagtcctggttctcagtctagttgtgtcactgctccttctggaacagattctgtggctgtggatgcaaagaagagagggcatgctaaacttggtcagaagcagcctgtgcatagaaaatctattgacacatttgggcaaagaacgtcgcagtatagaggcgtcacaaggcatagatggactggtaggtatgaagcgcatttgtgggataatagttgcaagaaggaagggcagactaggaaaggaagacaaggaggttatgatatggaagaaaaagctgcaagagcctatgatctcgcggctcttaagtactggggaccttcaacgcacataaacttttcgatagaaaattaccaagttcaacttgaggaaatgaagaacatgagcagacaggaatacgttgcacacttgagaagaaaaagcagcggattttctagaggtgcttcaatatacagaggggtcacaaggcaccaccaacatggaagatggcaagcgaggataggcagagttgctgggaacaaagacctttaccttgggacattcagcactcaagaggaagcagcagaagcatacgatatagccgcaataaaattccgcggcgcgaatgcagtcacaaactttgacatttcaagatacgatgtcgagagaatcatggccagtagtaatctcctcgctggggagcttgcaaggcgaaataaagataacgatccaagaaacgaggccattgactacaacaagagtgtagtaacaagtgtgaacaatggggaaacggttcaagttcaagcaagaaacaacaatgaaaatgattcggagtggaagatggttttatttaatcaccctttacagcaacaggcaaatggcagtgaccataaaataatgaactgcggaaattccaggaacagtgcattttctatggccctacaagatctcattggggttgattcggtgggttctgagcagcataatatgctggatgattctagcaaaattgggactcatttttcaaacccgtcctcgctggtgacaagtttaagcagctcaagagaggctagtcctgagaaaatgggtccctcgcttctgttcccaaagcctcctccaatggaaacaaagattgtgaaccccattggtacgagtgttacctcttggttaccctcaccaacggttcaaatgaggccatctcctgctatctctttgtctcacttgccagtttttgctgcttggactgatacttaa

SEQ ID NO: 44094 - DNA, 480 bp, Glycine max
  Peptide Sequence Number=SeqID_135779
atgggtcaaccaagaactcattcacagggaaatatacccttctcatgggaaagaaaacctggtgtgcccaaggtaactactgctgaaagtttccgaagagagcacaagtttgtgcacaagctacaaccccctccgtacacaagtaatttccaaagaaattctgttgatgttttccaaattccacttcctccttgtgcttttcagcctcctaattatgaaactttttcgaagatgcaagacggtgatccattctttgcagcttataaaaaatgcaccaagagtacgaaaagtgttgacaggaacagcaagttacaaattaacactagcatggagacgactcaaacgaggttaaggaatagcattagcatgtcattcatctcttgtaagcgatcctgcgccgttcgtgacaacaatttggtcagagtctctcgcttgccgcaaaacgtagatgaagaatccgattattgtattatcatttaa

SEQ ID NO: 44095 - DNA, 1041 bp, Glycine max
  Peptide Sequence Number=SeqID_135780
atggtatctgtcgaaaaaattcacatcgaaagggaacgaacacggaaacgccctcgtctcgcgtgggacgtagctcctccctccgcgtctgaggcacaacgggctctgccggtgcccggtgatgaaggtttcgaaagaaagcatgtttcgcctccgaaaagggacgacgatcgagagggccattatgtcttcaatcttggcgaaaatctcactcctagatataaaatcctcggcaagatgggtgaaggcacatttggtcgggttttggaatgttgggaccgtcaaaccagagaatatgtggctatcaaggtagttagaagcatacggaaatatcgggatgcagcaatgctcgagattgatgtgcttcaacaactagcgaagaatgatagaggaagctcgcggtatggaacttatggagtctttgagaagcttggaccaagcttatttgattttctaaagagaaataaatactgcccattccctgtggatcttgttcgggaatttggacgtcagcttttggaatctgtagcatatatgcatgaactacgcctaatccacactgacctaaagccagaaaatatacttcttgtttcctctgaatatgtaaagctccctagctataagagaatttcctcagatgaaatgcaattcaggtgcttgcccaagtctagtgctattaagctgattgattttggtagtactgcatatgataatcagaatcatagctccattgtttctacaaggcattacagagctcccgagattattctaggtctaggatggtcatatccatgtgatttgtggagtgttggatgtattctcatcgaactatgctcgggtgaagcattgtttcagactcatgaaaacttggagcacctggcaatgatggaaagagttttgggacctattccagagcatatgatttgcaggtctaacaagggtgcagaaaaatatttcaagcgaggatcgcgactaagatggcctgaaggagctgtttcaagggagagcattagtgcagtgaagaagcttggtcatcttaag

SEQ ID NO: 44096 - DNA, 1464 bp, Glycine max
  Peptide Sequence Number=SeqID_135781
atgtctgtagtggttgccaatgctacactgtatatgccattgacaactgatagggatctggatccaactaccctagtggactgggatttgtttaacccagtgactactatagttgggtcaattactgaaaagcccctacaactcaaaggcccaagaaggggattgtgtggcagagggtttctcagagcaggagcaatgtcttccccttatctacctgccacaactgactcacttgctctcgcaactgaggccaaagacccatctgaggccatctccattctttatcgggtgcttgatgatccttcttcttcaccagatgctctgcgtatgaaagagcaagcaatcacaaacctcactaagcttctcactgatgagaataggggagaggatctgcgcagccttcttactcagttgaggccattcttctccttgatacctaaggcaaaaactgcaaagattgttaggggaataattgactcggttgctaaaattccagggacatctgatctacaaattgcactctgcaaagaaatggtgctgtggactcgtgctgaaaagcgtacctttctgagacagcgagttgaggcaaggcttgcagcacttctgatggaaagtaaggagtattcagaagctttgactcttctctctggcttggtcaaagaagttaggagattagatgacaagcttcttcttgttgacatagatttgctggaaagcaagctgcacttctcattaagaaaccttccaaaggcaaaagctgcactcacggctgcaagaaccgctgcaaatgctatatatgtgcccccagctcaacaaggtgccatagatctgcagagtggaatacttcatgctgaagagaaggattataaaactgcttatagttatttctttgaagcttttgaatcattcaatgctcttgatgaccccaaggctgtttttagcctgaagtatatgttgctgtgtaagatcatggtgaatcaagctgatgacgtaggaggaattatttcttctaaagcaggcctgcaatatcttggccctgacttggatgctatgaaagctgttgctgatgcacattctaagcggtcccttaatttgtttgaaattgctttgagggactacaaggcacagttggaggaagacccaattgtacacaggcacctttcatccttgtacgatacccttatggagcagaatctctgcaggttgatcgagcctttctcaagggttgagattgcacatattgctgaacttattgaacttcccacggatcatgtggagcggaagttgtctcagatgattttggacaagaagtttgctggaacattggatcaaggtgctggatgccttgtcatatttgacgatcctaagactgatgctatatatcctgctactctagagaccatttccaatgttgggaaagtcgtggacagtctttacgttaggtctgccaagataatggcatga

SEQ ID NO: 44097 - DNA, 1060 bp, Glycine max
  Peptide Sequence Number=SeqID_135782
atgaacccttccacagaatcagacaacgccattatcatcgacattgattcctctgtcaaaacaccatcgtttgtcgaaaaccaccctaacgaagaaaaacaccaactcaatgttcccttcctcctccgtccatcttatgcgacacacgaactgcgaaaccttcgcaggagcctccaatggtgtgctctcgaccactcttccctcgttggacagctcatttcctatgtcgtcttcatattcctcaccatcgctgtccctctcttcacttctctcttcgttcatgtcccctcttcatcttctcaactcgaccctttcaacttcaacaagctccttcaattaccgcaatcagccctcgccgttatcgcattcttcactctctcccgtttctttccaaggcatggccttaggcagcttctattcctagatgtgttacaagatgactcaacgtatgttcgacgtgggtacacgcgcgagcttcagaaagcgttcagatacttagcaacggggttgttcttgttggcgtgtgtgctctttaggcttacctgtgagcttcagatactgaggtttgaagggcttcgcaagctttttgaagggtgtgggtctgatgcaaacatgatatttagagagcacttgggttctctcttgctggttttggaatccaaatctgccaccaccttcttcaattctggtgaccttgtgatttgttcggctgtgcagttatgtgggttcttcttgtgccttatgggtgcggcaagaatcacacatagagcacaagggatagtgtcaattgccacaaagtggcacatggtggtgaccaatgcatctgctgaatctgaacactggaaaacccagatgccagaggggctacccagtcctactgccagtgattcagattcttcggacatatacatatcagtaaccacacaaggaccttctttccaaactaggcaagcattagttcgtcggcggtgcagaaagaacacatgtgtcgtcggtgttgcgagagcatgtgtgccgatggttgcacggaccaccgtgagaggctgcgcggtgaggacag

SEQ ID NO: 44098 - DNA, 357 bp, Glycine max
  Peptide Sequence Number=SeqID_135783
caaaatcaccaatggggtttgacacatcatgttgaaagggccatagagaaaggcacttttgctgagatgttggatccatcagtggttgattggccaatggaggatgccatgaagcttgctaagatgggactgcagtgtgccgaattaaggcgcaaagacagacctgatcttggcaaggttatcctaccagaactcaacaggctaagagaccttgctgaagataataatctcatttcagttttggataactctatggatgcccctcttgcgaaacaagtttctgtgcatttggatggagggggtccatcatttactcagtcgagggaaattagagcaaacaattcagtcagtttctga

SEQ ID NO: 44099 - DNA, 192 bp, Glycine max
  Peptide Sequence Number=SeqID_135784
atgaaatttgagatgcctctcaattttccacctccacgagtctattcttctgcaagacttgtcaaccttgctaagtggtcatatgcttggtgtatatgtcttatactcagacataacataatacaattctcattaagggatagtggagaaatcgataaggagcaattatcaagttatgacattgtcttctaa

SEQ ID NO: 44100 - DNA, 948 bp, Glycine max
  Peptide Sequence Number=SeqID_135785
atgtcagttagacttgaagaatggaggattcggaaaagagatactgaagagtggatgaggcatcgccagttaccacaggatttgcaggaacgtgtccgtcgttttgctcaatacaaatggcttgcaacaagaggagtcaatgaagaagccatacttctttcactacctttggatcttcgtcgagaaattcaacatcacttgtgtctttctcttgtgcgccgtgtacccttcttctcacaaatggatgatcaacttcttgatgctatatgtgaacggcttgcgtcatcactgagcaccgaaggaacctacctatttcgagagggtgatccagtggatgaaatgttgtttatcattagaggtcaattggagagctccacaaccaacggaggaaggtctggattcttcaattccatctcactccggcctggtgacttttgtggggaggaattgttgacatgggccttaatgccaaactcaaacctcaacctaccttcttctacacgcacagtcaaagcacttactgaagttgaagcttttgcactacaggcagaggatctgaaatctgtggcaagtcagttcaagcgtcttcacagcaagaaacttcagcatgcatttaggtactattcccatcaatggaggacatgggcttcttgcttcatacaagctgcttggagacggcatcagaagagaaaagcaacaagggagttatccctcaaagagggtctctactacctggcattgtctgaggctgagagggatggaagtggaaattatgagatcgaggaatcctcagggagtgtgaaaaaggttcagaatctaggtccaactgtttttgcctcaaagtttgctgccaatacaaagaaaggaaaccataagctacaagatcctgtgccccaattgttcaagccagatgaacctgatttttctctagaccacgaacaagtttag

SEQ ID NO: 44101 - DNA, 2661 bp, Glycine max
  Peptide Sequence Number=SeqID_135786
atgaaggagctaagtttaacatcagacgaaggagccagccggcttcaagtttttggaccaaacaaattggaagagaaaaaggagagcaaacttttgaagtttctgggtttcatgtggaaccccttatcatgggtcatggaagctgctgctataatggccattgctttggctaatggtggaggaaggcctccggattggcaagattttgttggtatcattgctctattgttcattaactccacaatcagtttcatagaagaaaacaatgctggtaatgctgctgctgcactcatggctggtttggctcccaagaccaaggttcttagagatgggagatggactgagcaagatgctgcaattttggtcccgggagacataatcagcatcaaactgggagatatcatccctgctgatgcccgtcttctggagggtgatgctctgagtgttgatcagtctgctctgactggtgaatctcttccagtgacaaagaatccctctgaagaagtgttttctggatcaaccgttaagaagggtgagatagaagcagtggtgattgccactggagtgcacaccttttttggcaaagctgctcatctggttgatagcaccaaccaagttggtcacttccagaaagtgcttacagcaattggtaacttctgcatttgctccatcgcggttggaataatcattgagctcatagtcatgtacccaatacagcaccgcaagtacagagatgggattgacaatctgttggttctcttgattggaggaattccaattgccatgccaactgttctgtctgtcactatggctattggttcgcacaggctttcgcagcaaggcgctattacgaaacgtatgacagctattgaggaaatggcaggaatggatgtcctctgcagtgacaaaactggaactctgaccctgaataagctcagtgttgataaaaacctgattgaggtttttgccaagggtgttgagaaggactatgttatccttcttgcagcaagggcttctaggactgagaatcaggatgctatagatgctgcaatagttgggatgcttgctgatccaaaggaggcacgagctggtatcagggaggtccactttcttccattcaatcctgtggacaagaggactgctctaacttacattgattctgatggaaattggcatcgatctagcaaaggagctcccgagcagatattgaacctctgcaactgcaaagaggatgtaaggaaaagggttcatggaacgattgacaagtttgctgagcgtggactccgttctttaggtgttgctagacaggaagtacctgagaaaaacaaggatagtcctggtgcaccatggcaatttgttggtctgctaccactttttgatcctccaaggcatgacagtgcggaaaccatcacaagagctctaaaccttggtgtgaatgttaagatgatcaccggtgatcagcttgccattgccaaagaaactggccgaaggcttgggatgggaacaaacatgtacccatcttcttcattgcttggtcaaagcaaggatgctgctgtttcagcagttccagttgatgaattgattgagaaggctgatggatttgctggagtatttcctgaacacaaatatgaaattgtgaagaggctgcaagagaggaagcatatttgtggaatgacaggtgatggtgtcaacgatgctcctgcattaaagaaagcagacattggaattgctgttgctgacgctacagatgctgctagaagtgcttcggacattgtcctcactgaacctggtctgagtgtcattattagtgcagtgctcaccagcagggcaattttccaaaggatgaagaattatactatctatgctgtgtcaatcaccattcgtatagtgtttggtttcatgtttattgcattgatttggaaatttgattttgcacccttcatggtgttgattattgccatactaaacgatggtaccatcatgacaatatccaaggatcgagtgaaaccatctccaatgccagacagctggaagctgagggagatatttgccactggtgttgtgctaggagcttacatggcactaatgacagtagtatttttctggctcatgaaggataccgacttcttctcggacaagttcggtgtgaggtctataaggaacagccccggagaaatgatggcagccctgtacctacaagtggcaacttttctggcagtgtatgctaactggggcttcgcaagaattcagggaatgggatggggttgggctggtgtaatctggctctacagtttagtcacatatatccctcttgatatactcaaatttgcaatccgctacgtcctgagtgggaaggcttgggataatcttttggagaacaagactgccttcactacaaagaaagactatggcaaagaagagagagaagcacagtgggcaactgctcagaggactcttcatggtcttcagccacctgaaacaaccaaccttttcaatgacaagaacagttacagggagctttcagagattgctgagcaagctaagagacgtgccgaggttgcaaggctcagggagcttcatactctgaaaggacatgttgaatcagtagtgaagctgaagggacttgacattgatacaatccaacagcattatacagtttaa

SEQ ID NO: 44102 - DNA, 1950 bp, Glycine max
  Peptide Sequence Number=SeqID_135787
atggcttccgttcccggatctcgatccgccggcaaaattgtccgcacgcgccggagcgcagccgcaaggagtcgcaccccctacgaccgccccgcgccgccgccgccgccgccggagcctccgagccctaattggatctctcgtttcgttatctctccctcgcgtttcattgcttctggcgccggaaaaatcttctcctctgttttggatctcgataattctccttctgattcttcctctgctacgtcttctcattcctcttccgctaacgattccgatgctgaggaagttggtactttcgatgatgaaaatgataacccttctgaaggtgatgtggcattgagcaaggggctccagccatgtgttgggaatagcaaaagcaagcatatgattgagcaactacttatgaaggagtcattctcaagggaagaatgtgataggctgataaaaataataagatcaagagtggtagatcctgcaaatgatgatgatggggataagaggccaacggatatacccaacaagatttttggaagtggtactctctacagacttaactcagttttaacatattactgtttcctgaccatggagtctaattatttcttagatacagattcacctgagctccatagtgctgccattatggaggcaaagaaatggctgcgggaaaagaagtcaggtttagatacaaattcagatataggttatggaagtcctagtttgaatttggttgcattaccacaagaccccaaagatgaaggatcaccagtggatgtggctaagttgtatatgcgcacacgccctccatgggcatcaccttccatagaccatactaaacctcaaacaccatctggaattcagctatttaaagaagaaacaccatatctatttggcaacaattctacaccaccctccaagttgaaaagggattctgctgctactggttcatggagtattcaggatgaaatacgaagagtaagatccagggcaacagaggatttgcttagatcacttccatcctcaaaaattgattggtctgcatttgccatggagaataaaaataatgtaaactcttcagctattgaaaatattggagctagtttgggagagagagtacacaattcaacaaatttagtggatgcatctgcgaacttggccagaggattaggttctcaggtctctccagatttggatagtaaactagatgagttccaacctgaatctgtgctgtctaatccagttaacattaattttgaacagaatcagggctctgttgctgttcagcagaccagagttttgttccactgtctctcagtagaagttttacaattttacttagcttatgaaaatccatgccacataggtacacaagatggcggcgaaataactacttcaggactaagagatgggtcctcggatgatatgcacagggatggcggtctggttaaagtcaatggcatcagtgacacaaatgggcctggtcatcagctagattctgttgaagaaactagagaagcaataaattctagattacaagatagtaaccacttagtaatcaaagagaaggttagagcagaagatgcattagcaaatggttttccctcttcagagccaagtttcaatccagggcaggttattgaacagagcacaaaaacattggacaacaaacctaatacgactgattcaagtcaggaaaggacagctcagggtcttgagcaagaggagtgtcagacgttgcgtgaatcagcggaggtgcctgatgtgattggggacgactccgttgctggcggtgttgtctctggttcacagaacagttccagtgtgtatgaggttcagccgggtgtagaatcaggcttgtcaaccacaccaactagcattgctaagcaaaagggaagaagaattgcaaccagatacaacagaaggggcaggggcaagggtgtcaaatga

SEQ ID NO: 44103 - DNA, 1050 bp, Glycine max
  Peptide Sequence Number=SeqID_135788
atggcggttgtgggaggcgaaaaggagaaagaggagcttattcccgggttaccctacgaaattgcagagctatgccttcttcacgttccgtatccgtaccaggcactgtcacgctctgtttcgtccacgtggaacagagcaataacgcacccttcctttatttactccaagaagaccctctcccaccctcatctcttcgtactagcgtttcattcacaaaccgggaaaattcagtggcaggctttggacccttcctcggggcgctggttcgttttaccgcaaatgcccttgccggaaaacacttcctccacggcgttcgcgagcgcggcgctgccgcgccaggggaagctctttgtcatagccggcggcggcgaaggttccgacaccctcgtctaccgcgccgccacgaaccagtgggcactggcggcgcccacgccgggtgggaggaggaggggcttcttcgcggcggagggagtggagggaaagatcgtggccgttgggagcggcggcacggacatctacgatccggaaagcgacacgtggcgggaggggaagacgctgggaggggagctggagaggtacgaggttgtggcggcgggggggaaggtttacgtgagcgaggggtggtggtggccgttcatgttgagtccacggggatgggtgtacgaaacggagagggacacgtggcgggagatggggagcggaatgagggagggatggagcggggtgagtgtggcggtcgggggaagggttttcgtgatcgcggagtacggggacgcaccggtgaaggtctacgacgaggagttcgacacgtggcgctacgtgaaaggggggaggtttcccagggacgttataaagaggccgttttgcgccacggggttggaggaccgaatctacgtggcgtctttggatttgaacgtggccattgggaaaattaatgtgggtgtgaatagtaataatgagcaagtgagtgtgacgtgggaggttgtggaggcaccgcgtgctttccgtgaattctctccttctagttgccaaatgctctatgcttga

SEQ ID NO: 44104 - DNA, 741 bp, Glycine max
  Peptide Sequence Number=SeqID_135789
atggtgacgaaggcgaacgcgagaatggagacgcgcatggaagccatggagaaagtgaaagaagagaatcccaaagtagtggaatcgcagttaagttcgatcgaagggatgatacaaaggttggtagcggcatgggagaaaaaatctcctactacgaacattcacacagttgacgcgagcggaggagatgagggcgctacggcgcatgacggcaatcggtggaggaatttggaaatgcccatattcgacggtgaggatgctatgggctggttgacaaaaatcgaaagatattttcgattgcgtgccgtaagggaagaggacaagttggaggctgtaatggtcgcgatggatgaggaagctctgggttggttccaatggtgggaatcttggaacacaaatcattcttgggatggattcaagattgttgtcacccaaaggtttcaagcttctagcctgggaaatcctgttcaatcgttgctagcactggaacaagaagagacaatgcaaggattcatatgtcaatttgagaagtgcgttggaatggtaaggcttcatgaaccaaagaacttgatggaagctatgattaaagctcgaagaatggaggataagaacagagttctagagaagttacccttgagtaatagcaaggggtatgatctacataaacctagttattcgagtcagaaatttgtaagggattggcaactagcaaataataaggtagttgatatggcaaggtag

SEQ ID NO: 44105 - DNA, 1773 bp, Glycine max
  Peptide Sequence Number=SeqID_135790
atgcacgcgaaatcggcgcagtcgtcgttccgggatcggactcaggaattccacagcatcacagagaggttgaagaagtccggatcagggcccaatgggcccagcagcagcacttcttccaccagatcggaggaacagcgatccgcgatcgccaaccaatcggagttcaatagaagggcctccaaaatcggatacggaattcaccaaacgtctcagaaactcgccaaactcgccaagttggcgaagaggacgtcggtttttgatgaccctactatggaaatccaagagcttacgggggttattaagcaggatattactgctctgaactctgccgttgtggatcttcagtttctgtgtaactctaggaatgagagtgggaatgtttccgccgacaccactagccattcgagcactgtggtcgatgacttgaaaacacggttgatgagcaccaccaaagagtttaaggatgttctcaccatgagaactgagaacatgaaagtgcatgagaatagaagacagttgttttcatcttctgcatctaaggattctgcaaatccttttattcggcaacggccgttggctgcaagggcggctgctagtacttctaatgcccctgctcttccctgggctaatgggtcaccatcttcatctcaggcgtttcctaagaagcaagtggatggggagagtcaaccattgttgcaacaacagcagcagcagcaggaggtagttccattgcaagacagttacatgcaaagcagagctgaagctcttcagaatgttgagtccactattcacgagcttagcaacatttttaatcagcttgcaacacttgtttcccaacaaggagagattgccatcaggattgatgaaaacatggacgatacattggcaaacgtagagggagcacaaggggctttgctgaacattgcggagaggttgaagaaaacagggccagcgccgaatggacaaagcagcagttcatccagatcggaggaacagcgatccgcgattgcaaatcaatcggagttcaatagaagagcttccaagatcggcttcgggattcaccaaacctctcagaaactcgccaagctcgccaagttggctaagaggacttcggttttcgatgaccctaccatggaaattcaagagcttacgggggttattaagcaagacatcactgctctaaactctgcggttgtggatcttcagttactcagcaactctcggaacgagagtgggaacgcttctaccgacacgactagccattcgaccacggtggttgatgacctgaagacacggttgatgagcgccaccaaagagtttaaagatgttctcaccatgcgaactgagaacttgaaagtgcatgagaataggaggcagctgttttcggccactgcttctaaggactctgcgaatccttttgtccggcaacggccgttggctacgaggtcggctgctagtacttctaatgcccccgctgcaccttgggctactgggtcatcttcatctcagttgtttcctaagaagcaggtggatggggagagtcaaccattgctgcaacagcagcagcagcagcaagaggtagttccattgcaagacagttacatgcaaaacagagctgaagctcttcagaatgttgagtccactattcatgagctcagcaacatctttaatcaactagcaactcttgtttctcaacaaggagagattgccatcagtgctgactgggtttttgctcaacctgacccccaactgcaccctctagggatttaa

SEQ ID NO: 44106 - DNA, 1329 bp, Glycine max
  Peptide Sequence Number=SeqID_135791
atggcggacgatgacaaagcggttggggaaggtgagatgaaagagacgacgggtggtaccagtccttctgggagtggaaagaagaagaacaaaggtttcttgttgcgtatttggaacgggatatttaggttacacggcgatgattttgagaagagactccagtacatttctaaagaggaagctcaagtcatgactagaatgaacaggagatcccgatcctggaggagaatttcccgcaatcttattgtattttctgtcatatttgaggtcgttgctgtagtttatgctattatgacaactagatcaatcgatctgaattggaaaatgagggcaatccgggtttcgccaatgtttcttttgcctgcactagcagctgctgcctatacaacatttgtcagcttcacaaggatgtcctgcaaatgcggatatcaatgctggatcagtgatcgcagggataagaaaattcttgaaaggcttcgagctgaaaggcaagaaaaaattgatgagctcaaagaaaggacaaattattacactacacaacagctcattcagctatacccatgtatatactttataaagtgcattactgaaagagcagctcttgatggcaactgtttgcgactgagatatgatccagacccagctgcaaaagcagctgctgcaagtgttttagcatctaagttgggtgcagattctggtttgaaagtgtacctgggagatgaatccagtcccagtgctccactggggaggagcaatgacattgaaattgtgcagtcctctggacttcgaaatcggagacaacttcaatctagatccactagtccagggacaaccacaccaaattttgctgatcaacaactagttggtccaggaggaatcgatcaaactcagacttttgagctcaataagcctgttgttgttgaacatcacttacctcaaagttcaaccacacaagatggaggatggattgcacgaattgcagctttacttgtgggcgaagacccaacacagtcatatgcgctcatatgcggtaactgctatatgcataatggtctggctcggaaggaggatttcccagttatcacatactactgcccgcattgtcatgccctgaacaaaccgaagcaatcagatgagcatatctctggtcttacttctccaaacacgggggggactccaaacacagatgatggtgtgacggatgcagttaagaatgctagggcttctgcagccgagagtgtaatcacaagcagtagtcccggaagtgcttctagctctgagattgaggaagtatcagaaagggcaagcgtggatgagaaaattgattaa

SEQ ID NO: 44107 - DNA, 1701 bp, Glycine max
  Peptide Sequence Number=SeqID_135792
atggatccttcttataggccaagtttagtgcaaaatgatgctttggggtctggtcttctgccatttgctgggtcagacttggtcttgagtccatcccaatggagcagtcatgtagtaggaaaaattagctcatggatagatttggattcagaggatgaaaccctcagggtagattctgaaaccactcttagacaagaaattgcttgggcttctcatctctctttacaggtttgctttggttgcatggatatggttatggttcctgcgctgtaccagtatgagtatggatgccaaaacactgcctttgatgaattttcatgcctaagatgtactggcttggagagccaaattgtattggctggcatgcaaaccattaaggggataaaagcctgccttcttcctgcccccaagggaacttcttgtgctaattatgctagatgtgtgaatcagattttacagggttcaaataatatgcagttgtggcttaggcttccattggtgaagcctgatgatgactctatggatgcaaagtctgttgctttggttgactactgggaaacttggaattcatttcgtctgctgtgtgagcatcatagtcaactttcagttgcacttgatattctgagtactcttccttccccaaattcactaggacgttggtttggggagcctcttagagcagctatattacatactgattgctttctaactaattctcatggctctccatgcctctccaagcgtcaccagagtttaattactggtgtttttaatcattctattcagatcattatatctggaaattcagttcatacaaaagcaagtatggatgcaaatgataattctggtacaaattcacaaagacatcccttgcggccatatctggactacgttggatatctttaccaaagaatggatcctcttcctgagcaagaacgttttgagcctttgatggataatttagaggctcagacttacgagacttttgagagagatgcaatgaaatacattcagtaccaaagagcagttagtaaagcattgctggacagggttcctgatgaagaggcatctgttaaaaccattgtattgatggttgtgggggcagggcgtgggcctcttgtgcgggcttcattacaggctgctgaagaaactgggcggaagctcaaagtttatgctgttgaaaagaatccgaatgctgttgttaccctacatgcattagtcaagttagaaggatgggagtatactgtgaccatagtctcaagtgacatgcgtcattggaatgcccctgaaaaagctgacatattggttagtgaattgctaggttcttttggcgacaacgaactgtctcctgagtgccttgatggagcccagagatttctaaagcaagatggaatttcaataccatcttcgtatgttaaggctcataaagaccttgtacactttgaaactgcttatgttgtgaaaatgcacaatgtagccagacttgcaccaacccaacctgtttttacatttactcatccaaagcaccctgataaagaaagcaatcagcgccataaaaagttgaattttgtgatacctaatgacactgggtcagcaatggtacacggatttgctggttattttgatgcaactctttacaaggatgtgcatcttggaattgaaccttcaacggcaacgccaaacatgttcagttggtattga

SEQ ID NO: 44108 - DNA, 1161 bp, Glycine max
  Peptide Sequence Number=SeqID_135793
atggcgcgccctactcaccatgtcattgacattacggggagttccggaccgtccacttcgtcttcttccacaccccatgataggcttgccaatgatgtggattttggtgctttgaattctaggactagtagaaggcgaggggatactacgcgtagtagtaggcagcataggagtcctttgaattcgggtttgtggatatgtgttgagttagtgatcaccgtgagccagattgttgcgtcggttgttgttctatcgttgtcaaagcatgagcatccgcgtgcccctctgtttgcttggattgttgggtttgcgtctgggtgtgttgctaccctccctttgctgtattggcggtattatcataattgccttgttcgggagctagagtcatcatctcaggcctctctgaggagtaatgatccttcggggacacttctttccgattccacgacgaatggaggggaagatgttccggcatcttccagaagcaaccaagagtcgtggttgatgaatgcaagattgaagctactagtagaatacttcaaaattgctgtagattgcttttttgctatatggtttattgttggaaatgtatggatttttggaggacattcatctgctgatcaagcacctaacttgtacaggttatgtgtagtgtttcttacttttagctgtattggttatgctatgcccttcattctatgtgcaacaatttgctgctgcctgccttgcataatttccatccttggggttagagaggatatggcacaaaccccaggtgcatcctctgaatcaattaattctctgccgacttataagttcaaaatgaagaaaaataaaagcaaaggggaaagcaactcagctgttagtgaaggtggagttgtggcttcaggaactgaaaaggaacgtatgatctctggagaagatgcagcttgctgcatctgcctggcaaagtatgaaaataacgatgagctgagagaattgctttgttctcacctatttcacaaagactgtgtcgacaagtggttgaagataaatgctttatgccccctttgcaagagtgaggttagtgagaacgtaagaggatcagtctctggggaagatgccaaccaacatcagggtgaaagcaggattgagaatggcctcaccaacacctcatcgtaa

SEQ ID NO: 44109 - DNA, 648 bp, Glycine max
  Peptide Sequence Number=SeqID_135794
atggataaagtaaatagagtttgtgccaaagatgaagagcgtccactccgaatcaccagagcaagagctagagccttgagagggattactccatactcaagaccctccttaaaaaatgagcagaaaaatgtgcttcgagcacatccgaaaagagcagcatcttctgaaaacaaaacttctgtggttgttcctgctgttgtccaacagaagggaagggcagtgctttcagatgtatcaaacatgtgtgcaaaaccacatgataagtgtactaagtcatcaaagtttcaggccaaaggagtttatacaaagaaaaccaccaagctagcagccttaggtgtttccactgaggtttcatcaacacaagagaatgttagagcaaagttggctgaagaattatccacaataaggatggtagaatcaaaggacaccataagagaaggtgttacagcagacactgcactttcaatgcaaaactctctgaaatctgatgagctccagagctctccaaacaaagacatacatatgatttgggagaagctaggagcctcagactccctgactattgtggacattgattctgagttaaaggattctcaagtttggagttcttatgcccctgacatatacagcaatattcaagtcacagag

SEQ ID NO: 44110 - DNA, 1164 bp, Glycine max
  Peptide Sequence Number=SeqID_135795
atggctcagcctcacaatggcaacaccaacaacacttcaaaccagcaattggtactccatgactttctgggtatgaggcccgccgccgattcccccaaaaccgccgatgtcaggttaccggagccttcggcctccgcctcttccaccggaggacgcggccccttctccgccacctccgacatcgcttccggaaatcatctcgagggagttccattctatggcccgaggagtgatttttctggcactgagataagcaacagattagtgggaagcaagagaagtaattctgattccacttttatgggttcctccagagatgccttccaattggtccctgattcctttcaaaactcacatttgatgaaggttctccggaatgcagctggaggagaaaggcctagaaggcccaatgatgatgcagtgttacttggtatgcagtcaatgaagccatcttcttctcagatatttcagcctcccaccagcactaagattgatgccaataaatgggaacggtctattctcatgaatgttggcccttccatgcagcatccaccgcgtggggtgcaattggcaccttttgtgcaccaaatggcttcaagcaagattagggataccaatgctggcccttcattcatttctcagtcagctgctgatgaaggttctagaactggaatcaagggccctggaattttaagttctgcagctgctacagccactgagaaaagtattccatctgctgtgatgcttggtggcagcaggccaaagcctggaactaatgagaagttgcttgactttatgcatttcataattgatactgacagcagtcaacatgggctaacttctgccagccgccagatgactattttttatggaggccaagctcatgtttttgatgatgtccaccctcataaggcagatgttataatggctttggctgggtcaaatggaggatcttggtccactgcattctcgcctaaatctgctgtaaagatggttaatgatggtatcttgcatagcggagaaaatgaaacaggtgtagttagtaatgcagcattcccacaggagcttcatgggaaattgtctattactggcagttctagccatgccattgggcttggtgatcgagtaactactccagcgggtaagcctcgaactgaaacatag

SEQ ID NO: 44111 - DNA, 1152 bp, Glycine max
  Peptide Sequence Number=SeqID_135796
atggagcacacagtctcaaactcaagcagtgtcgagcagattctgaatcttctctacgcagccggctacgtcgacgccacaaatcccgatgcgccgccgtctcagaaaatcgccgccggcctctcctggtgcatcgccgccataacgcaagatcttgataccgatgctctttttcctgtaattcagtggcttgcgtcacacattcggcaaaatcaagaacactgtgtcaatgaggttcatcatgctgaaaataccattgaagtggatgagtgtagaacttcgattcaggcattaagtggcaacttggatgaactgaatcagcggaagatgaatgttgtgaagcaattatatattctacaagagagaatcaataaggagggtgctgattctgcagtacagaagttgctttctttactgacatctttgaagaatcttgaaaagcaggaaaaatactttcagtccaatcgtgatgctaaacactcagaacttcaagatgatattagtgaattagagaggaaaataacaaatgacagtgataatgagaaccttcctgatgaactacatcattcatttggtgaattagttgaaaaagtcaatttgatgaaaaagcaacttgctgctagactgagggatattgtggtattaagacgacagattgatgacctaccgtgccaatcagaagtcatccagtacgaacgccggctctcagaactgtatgcacaaatccagggaaaacatcgacaaactcgtaaatactatgctacctacaatgctctcttggaaataaaagaattgatgctaaaggaaacatctttattgaattcgatcatttcccagtttcaagaggcctttagtagcactgatggacgtataaaacttgttcattccatggaaggaattgtcaagggaagtcaacagaagctagaaagggttcatgtaggacttcaagaagaagagagaattcgtaatgatctgaaggataggtatgctgcagcaaccggtgagcacaagcactgctattctctgttgaaagcttttcaggtggtgccatggtgcagagttaagcttgtttatgatcctttgtgggtgataattctgtgtctatctgataaggcatcggttgatttaagaattgtattgttgaattggtag

SEQ ID NO: 44112 - DNA, 168 bp, Glycine max
  Peptide Sequence Number=SeqID_135797
atgaaagaagagaaacgaaaaacaaaggttacatcttgtcagcttcccagttggtctgagacatggttgtggaagcgaagaaagaaggaagtagcgaaagagttgaatttagttggtagagttgcgtcagaagcaaaggacaagaatggaaaagaaaagagaatatag

SEQ ID NO: 44113 - DNA, 84 bp, Glycine max
  Peptide Sequence Number=SeqID_135798
atggaggttgaggttgagcaatcaagtcttcgagtgtgcgagtggaaaggggttccgaatggaaaaattgatattatgggataa

SEQ ID NO: 44114 - DNA, 4299 bp, Glycine max
  Peptide Sequence Number=SeqID_135799
atggaaagtggtgaactgagagtggcgagtgcacgcatagggagctccggcgtgtggagaagcggcagcattgacgtgttttcagggtcttcaagaagggatgatgatgaacaagagcttaaatgggctgcaattgagaaactccccacgtatctacgcatgactaggggaattctcactgagacagaaggccaacctacagagattgatataaacaaactttgtccacttcagaggaagaacttggtggagaggctcgtcaagattgcggaacaagataatgagaagttcttgttcaaattaagggaccgcattgatcgtgttggacttgaaattccgacgattgaaatccgttttgaacacttgaatgttgaggcagaagctcatgtgggaagcagggcactacctacaatctttaacttctgcatcaatttgtttgaggggttcctcaattctcttcaccttattcccagtcgaaagaagccattcacagttcttgatgatgtcagtggaatcatcaagccaaaaagaatgacattgcttttaggccctccaagctctggaaagaccacattattgttggcactggctggaaggcttagtaaagatctaaaattttcggggcgagtttcgtataatggacatgggatggaggaatttgtgcctcagagaacatcagcttacataagtcaaactgatctacacataggagaaatgacagtcagagaaacattggccttttctgcaaggtgtcaagggatcggaacccgatatgagatgctggcagaattgtcaagaagagagaaggctgcaaacattaagccagatcctgatcttgatatttatatgaaggcggcagcactagaaggccaagaaaccaatgtagttacagattatataatgaagattttgggactggaagtttgtgctgataccatggtaggggatgacatgattcgaggtatttctggaggacaaaagaagagagtcacgactggtgagatgctagtcggaccagcaagagcacttttcatggatgaaatatcaaccggtttagacagttctaccacattccaaatggttaattctctaagacaatctatccacattctgaatggaacagctgtgatctctcttctccagccagcaccagaaacttatgagttatttgatgatataattctcctctcagatgggcaaattgtgtatcagggtccaagggaaaatgtgcttgagttctttgagtacatggggttcaaatgtccagagaggaaaggagtagcagattttttacaagaagtaacatcaagaaaagaccaagaacagtattgggcaaataaagatgagccatactcctttgttactgttaaagagtttgctgaagcatttcagtcatttcacgcaggtcgaaaactcggtgatgaacttgccactccatttgacatgtccaaaggccaccctgccgtgttgacaaaaaacaagtttggtgtttgcaagaaggaacttttgaaagcctgtgtgtccagagaattcttacttatgaaaaggaattcttttgtctatattttcaagatgtggcaactgattttaacggggttcataacaatgacattgttcctgagaactgagatgcaccgggatacagaaactgatggtgggatctacatgggtgcattgttcttcgtactaattgtgattatgttcaatggatactccgagctatccatgtccatcatgaaactccccgttttctataagcaaagggaccttctcttttttccttgttgggcatactctctgcccacatggatccttaagattcctatcaccttagtggaagttggtatttgggttgtgatgacttactatgttataggctttgatcctagtattgaaaggttcatcaagcaatactttctacttgtttgtatcaaccaaatggcatctggactttttcgatttatgggagcagttggaaggaacatcattgttgcaaacacagttgggtcatttgctttacttgcagttatggtcatgggtggatttatcctatctagagttgatgtgaagaaatggtggttgtggggttactggttctcgccgatgatgtatggacaaaatgctctagctgtgaatgaattcctcggaaagagttggtcacatgttactcctaattcaacagaaccattaggagtaaaggtcttgaagtcacgtgggattttccccaaagcatactggtattggattggagttggagcttccattggatacatgttactattcaacttccttttccccttggccttgcattatcttgacccatttggtaaaccacaagcattaatctcagaagaagccttggctgagagaaatgctggcagaaacgaacacatcatcgaattatcgtctagaatcaaaggctcttctgataaagggaatgaaagtcgtagaaatgtgtcctctagaacactgtcagcaagagtgggtggcattggtgcaagtgaacacaacaagaaacgagggatggttcttcctttcacacccctttctatcacttttgatgaaatcagatattcggtggagatgccacaggaaatgaagagccaaggcattcttgaagatcgacttgaactgttgaagggtgttaatggagcttttagaccaggagttcttacagctctaatgggtgtaagcggggctggtaaaacaactctaatggatgtattatctggaagaaaaacagcaggttatattcaagggcaaatcactatttccgggtaccctaaaaggcaagaaacgtttgctcgcatagcaggatactgtgagcagactgatatccactctccccatgttacagtctatgagtctttggtttattctgcatggcttcgcttaccccctgaggttgattcttccaccagacagatgttcattgaggaagttatggagctggtagagctgacttcattaagagaagccttggtgggattgcctggagtgaatggcctatccacggagcagcgcaagaggttaacaattgcagttgaacttgttgccaatccatctattatattcatggatgaacctacctctggccttgatgccagagctgctgctatagtaatgagaacagtgaggaatacagttgataccggccgaactgtggtctgcacaatccaccagcctagcattgatatatttgatgcttttgatgagctacttctgttgaagcgtggaggtgaggaaatatatgtgggacctttaggccagcattgttctcatctgatcaatcactttgagtttattcatcaagttacttcagaagcacaagaagcagctcttggagttaacttcgctgaaatatacaagaattctgacctatataggagaaacaaggccttgatcagggaacttaccacacctccaacaggttccaaagacttatacttccccacaaagtactcacagactttcttcactcaatgcatggcttgcctttggaaacagcacctatcatactggagaaatcccccatatagtgcagtgagacttttattcacaacaatcatagccttattgtttgggacaatattttgggatattggctccaaaaggcaaagaaaacaagatctatttaatgcaatgggatccatgtatgctgcagtcctcttcattgggatacaaaatgctacatctgtgcaaccagttgtagccattgagagaactgtcttctatagagaaagagctgctggaatgtactcagctttaccatatgcatttggacaggttgctattgagatcccatacatattcatacaaaccctcgtgtatggagtcatagtgtatgctatgattgggtttgattggacgttcagcaagttcttttggtatctcttcttcatgttcttcacctttttatacttcaccttttatggcatgatggctgtgggtctcacaccggatcacaacgtagctgctatagtttcctttgggttctacatgatatggaacctcttctcaggattcgtcattccaagaactagaatgccagtgtggtggagatggtacttttggatttgtccagtgtcttggaccttatatggattggtgacttcacaatttggtgacataaaagaacctatagatactggagagactgtggaagagtttgttaggagttattttgggtatagagatgactttgtaggcgtagctgcagctgtgcttgttgggtttacactgctttttggatttacctttgccttctcaatcaaggcattcaatttccaaaagagatga

SEQ ID NO: 44115 - DNA, 1119 bp, Glycine max
  Peptide Sequence Number=SeqID_135800
atggaaaggttctcatttctattggtgctcttttgttgcttccatgttgccttctcctttactcatggagcagtgatcaatggagagtttgagcttggaccaaagccacaggacatgaaaggcacggtggtgaccgggggtccccactctatacccgggtgggagatctctggcttcattgagtacataaaatcagggcagaaacaagatgacatgttgcttgtggtgccaaatggagcttatgcggtgaggcttggcaacgaggcctctattaagcaaaatctaaaagtggtaaaaggaatgtactattctatcacgtttgtagtggcacgcacgtgtgcacaagaggaaaagctaaacgtttctgccgctccagattgggtggtgctcccaatgcaaacggtgtatggtggaaatggttgggatgcttatgcatggtctttccgagcagattacccttcagtagacatggtttttcataacccgggaaaggaggaggatcctgcttgtggaccaatcattgattctattgctatccaacctctgtaccctcctagactaactaacaagaacgtgttgaagaacggtggatttgaagaaggaccatatgtgtttcctaacacatcatcgggtgtgcttatcccgcccaatattgtagaccacatcgaacactctcccctgccagggtggatggtggagtccctaaaagctgttagatacatagactcggaccatttctcagttcccaaagggaaaagagccgtggagctaataggaggaaaagaaagtgccattgcacaagtagccagaaccattcctggcaaaacatacacccttttctttgctgtgggagacgctggcaattcctgtgaagggtcactgagtgttgaagcatatgtaggcaaagaaagtgtaaaggtgccttatgagtccaaaggcaaaggtgggtttaaacgtgcaactctaaagtttgtagctgttagtacaagaacgcgcattttgttccttagcaccttctacaacatgagaagtgacgatctcgcttcgctgtgtgggcctgtgattgatgatgtcaccttgatcagtcttcgcaaaccacacagaagattccacatttga

SEQ ID NO: 44116 - DNA, 1314 bp, Glycine max
  Peptide Sequence Number=SeqID_135801
atggctatagttttaatggttcagtattctgaacttcctagtagtaaattcttatcttctgttaccaccaagattaccatggagggtaataatttgcacctagatggttctaattcaaactctactcatgcattggaagagaaagcaattagtcctcaggtaccccaatttcacaatgacagagattcaattacttcccctgcaccagagaaagctaaaggacttgatgaaacggattcaagaagtcctgtggcatctgtcacttcagcagcaacttcagtgaaatcggatataaccggttcagtttctaaggatggaaagtcgggttctttgcaaggtagtagtaacttgacatccaataatggtaagcctgtgactgcaaagaattccaaaaagagaccatctaaagtagtttcaatatctaagatgaacttgccgttgcagcataatcatgcttcttccaagctagtgaaaccagcaagggcttcagctgtcgatctggaaatattgcatgctaaatcagagattttaaatgcacccgtcattatgaatgatccaagactttacccacctttatacaggaatgcctccatgttcagaaggagttatgaactaatggaaaatatgctcaaagtttgcatctaccaggatgaagacagaccaatctttcatgagccgttactggatggaatatatgcatctgaaggatgcaccatttctcaggctcctgcagaaacaagagggcgcatgcttagtagcatcagagccctctgcaatgcagacattgaagtaggattcaagataggcaaggatgtttctcttccagaaacatatataaggaggtttgcacgtttatgttcgcctattctgttgaagcactgggaaaacaaagaacctgacatgaaaatttctggtcccttgccgcatgtcaggggtaatgtaaactacatccaattcatgaagagcagcaaattctgcatccatgcaaggggtcatgaagttaatagcccgcgagtggtagaggctatatttcacgagtgcattccagttatcatatctgacaattttattcctcctttctttgagattttgaactgggaatcttttgctgtgtttgtcacagaggaagaaatccctaatttgaggaacatactgctgtccatctctgaagaaagatacttagagatgcataagagggtgaaaaaggtgcaagagcattttccctggcatgctgaacctgtaaaggatgatttgtctcatatgcttcttcattcaatttggtacaatagacttttccatataagccagacatga

SEQ ID NO: 44117 - DNA, 1194 bp, Glycine max
  Peptide Sequence Number=SeqID_135802
atgagattgagaaagggaaataaggtggagatccgtggcaatgctgatggacttagtgtggaatggtgttgtgctcgtataatttctggtgatggacacacctacagtgtccagtatgactgttctagcacaacaagcgaggccagcatagagagagtttcaaggaaggccatcagaccatgcccccctcttattaaaggtattgagagttgggcagcaaatgatcatgtggaggtttacattgccggttcttggagagcagccactgttttgaaagtcattggtggagatttctacttggttaggttgtgggtatcttgcaaggagtttaatgtcctcaaagtaaacatgagggcacgccaatcttggcaaaatggacaatgggttgtcatgtcaaagggatcaggaatgtctggagatgtgatgtctagccggtatttgatttcaaacagttacaaggatcaacctgaaaatcagtgcagaaatattttttctccaggattagatgccagtggtcttcaggaatctcgtctggcttcatcttcaacattgaagagaatgtccccttatgactcctctgttattgaggcttatcccagaaaattaagggatgttgagaatatgggtgtgtgtgaaaggttcaaagctgtagccacagcccccttgctgcaaaaggtagatgctgttgcttacccacaaaatattatgggtgaaaaatgcatgcatacttcatatactaatggtgccaaccaatattatgaaacaggaaaggagaatccttgtaatgtttcaacacactttcttgagagaattgaagaacctgattattcttgtagtgatcagagttcggttggcagttgtagtgtgataagtagtaactcaaataaattttccagtgatactttagcaggttcttgccaggatgaagattccctttgcagtgatgcagaatctctagatgttgaacctgtgaatgaaggatgctccacttcttttgaagaggttgtagcagaaagaattcataggttagagttgcatgcctatcacagtaccatagaagttttgtatgcttcaggtcctttaagttgggaacaagaagaattattgactaatcttcgtatttcactccatatttcaaatgatgaacatttgatggagataaagaacttagtttcatctggtctgaatttttaa

SEQ ID NO: 44118 - DNA, 283 bp, Glycine max
  Peptide Sequence Number=SeqID_135803
ctactgctgtgatgggaataggccagggcagtttcctcctggaaatctatttgttgcggtgaatgaagggttatgggataacggggcagcgtgtggaaggagatacagaataaggtgtgtgagtggaaacaataggccatgcaaaggtggtagcatcgatgttaaagtggtagattcctgttcaaggtcaccatgtcccaacaccctcctcatgtcaaatgatgcatttgcagctattgcacgcttccctcatgttaaaatcaatattgaatatacccagtaa

SEQ ID NO: 44119 - DNA, 855 bp, Glycine max
  Peptide Sequence Number=SeqID_135804
atgggaacaaagggcacaacacacaaggggaagagatttctagcccaagtcaagggatgtctgctgtgccggcctgagattgttggaacaagactctatgcaacaattgatttagacaaggcaagggttggacgaaccagaatgataggaaaccaaccttctcaccccaggtggaacgagaccttcgaaatctactgtgcccatcaaatctcaaagatcatattcactgtcaaagatggtaacccaattggagcaactctaattggaagagcctctgtccccgtggagcaagttcgcaagggccccatagttaagcgttgggttgagatattagacgaagaagatcaacgtcctgtacctggtcacgccaaaatctgtgtcagcgtgcaattctacgatgtcaccgatgacacaacatgtctatggtctcagggtataagcatgccattttttggagtacctcgtacttttttcaatcaaagagaaggttgcaatgttactttgtaccaggatgctcatgtcccacgtggcattggtgttgtcccttacattccaatatccgaagaaaaagattacatgccagcaatgtgttgggaggacattaacaaagccattaatgaggctaagtattttatttacataactggttgggctgtttacactgaaatcaccttagttagagacaaagacgaatcagaaacacttggggagttacttaagaggaaagctgatcaaggtgttaaagttcttttgcttatttggaatgacagaacttctgttccagaattgaaagatggcttcatggcaacacatgatcaggaaactgctggttactttagaggtgggatcctctag

SEQ ID NO: 44120 - DNA, 2481 bp, Glycine max
  Peptide Sequence Number=SeqID_135805
atgccgcatttgctgcacgggaggctcgatgtgatcatatacgaggtcgacacactaccaactctcaacgactgcaatcttaacctctgcagcaagggtacaagtagaagcgtggggaagagatttctttcccaactcaagagttgttttctctgtcaatgccaatgccagccagagtttgtggagacgggtctctatgcaacaattgatttagataaggcaagggttggaaggactaaattgttaaatgatcaatcctccaaccccacgtgggacgagacctttcacgtatactgtgcccatttgatctcccatgttatattcactgtcaaacaaaaagatccaattgatgcaactctaattggaagagcttatgtcccagttgagcaagttgtgaatggcaacatagtggacgaatgggtccaaattttagacgaggatcataaccctataccaagtgagtctaaaatccatgttaaaatgcaattctctagtgttaggaatgacataaactggtctcaaggaataaggagtccaaggtttcaaggagttcctcacaccttctttagtcaaaaaaatggttgcaaagttactttgtaccaagatgctcatgtctcagatggttttgtgccatggatccccttgtcaggaggaaaaccttatgagcataggaaatgttgggaagatatttataatgccattatggatgctaggaactttatttatataactggttggtctgtgtacagtgaaataaccttgattagggacccaatgaagcctacaacaagaatcacccttggggaactgctcaagatgaaagctgaggaaggtgtcaaggttcttatgcttgtttgggatgacagaacctctgtgccagatttcaagaaagatggcttgatggcaactcatgatcaagaaactgctgattacttcaaaaacacaaaggtgaaatgtgttttgtgtccacggaacccagatgatgggaaaagcatagtgcaaggttttgaaacttcaacaatgttcactcatcaccaaaagactatagttgttgacacccaagttgctatgggacaacaaggacaaaagagaacaatagtaagctttgtaggtggcattgatctttgtgatgggagatatgatactcaggaacatcctctattttcaactttggacacagtgcataaagatgatttccatcagccaaatttccctggtgcttccatcaagaaaggtggtccaagagagccatggcatgacattcattgcaagttagaagggtctgttgcttgggatgttttgtacaattttcaacaaaggtgggagaagcaggttggaaatcagctcctattctcttcaagcaagcttgatgagtactttgtccctcgatccacggtggtgacaacaaatgaaaatgagacatggaatgttcagttgttcagatccattgatggtggtgctgcttctggctttccccctgacccagaagaagcggctgagttaggccttgttagtggaaaagataacatcattgatagaagcattcaagatgcttatataagcgctattcggcgagccaaaaactttatctacattgaaaaccagtatttcctagggagttcatatggttggcaagcatctgatattgtggttgaggatattggtgctttgcatcttataccaaaggagctgtcattgaagattgttagcaagattgaagcaggggagaggttttcagtgtatgttgttataccaatgtggccagaaggcatacctgagagtggttcagttcaggcaatattagactggcaaaggagaacaatggagatgatgtatgctgatatagccaaagccattcagagaaaaagaattcaagccaatccaagggactacttgacctttttctgccttggaaaccgtgagggtaagaaggatatggaatatactcctactgaggcaccagagcctgatactgattatgctagagcacaaaaggctaggcgattcatgatctatgttcatgccaagatgatgatagttgatgatgaatacattataattggatctgccaacataaaccagagatcaatggatggagaaagagacactgagattgcaatgggtgcattccaaccacgtcatatagcatataatggggcacccagaggacaaatatatggatttaggcgtgcactatggtgtgagcaccttggggatcatggggatacaaacatcttcgacaatccagaaagtgtggactgcatcaggcttgtgaatcatcttgctgaaaccaattgggacatatactctaaggaaacttttgatgagtatagagaatttcaccacctcatgcgctaccccatagaagtaaccaacaatggagcaataacgatccttcaagggctagaacattttcctgacaccaaggctaagattttgggctcccaatcagtttaccttcgtccaattctcaccacctag

SEQ ID NO: 44121 - DNA, 510 bp, Glycine max
  Peptide Sequence Number=SeqID_135806
atgactatggaagagactttcagaggaaccaaagagttcgaacagcaaccaaaggttcacgaggctgagcccaagatgaagggagatatggaagcgaagctgagagagtttgagaagatttatactctcacaaccacggagaagcgtaaaaccgacctcctcagcaaagcaagccttgagtatgaaaccaataatatgaggttgaagtatgttttgcaagtaaaatatttcttaaaacactggtgtcttttggcattgtgtgtccataggaattacttgaaggcacttcttgatgcaatgggaggaaactacgccaattatttaaatattttgtttggaaggggaagcggagttagagaaacactaatccgaaattcaaacatttcttttgagaaaaatatctatagttcagcccccaattgtgtcagggttgttgttgcagtggtggcatcaagatggtggtgggtggaagaagagaaagaagacaagggagcaaaggatgatacgtga

SEQ ID NO: 44122 - DNA, 1014 bp, Glycine max
  Peptide Sequence Number=SeqID_135807
atggagaagttattcaaggtatacgtataccctgatggggacctaccaattgttcacgatgccccctgcaaggacatatactcgattgaagggaggttcctccacgagatggaacatggggttgggaggtttaggactaacgaccccactgcagctcacgtttactttcttccattcagcgtgacatggatggtcaagtacttctatagtacaccacactcttacgacgtcactcctttaaagaattttgtttctgactacgtgagagtgatatctacgaagtatcccttctggaataaaactcatggtgctgatcacttcatggttgcttgtcatgattggggtccttatgcatcagagggaaaccctttcctctacaacacctccatccgggtcttgtgcaatgccaacacttctgaaggcttcaaccctcaaaaggatgtacctctgccggaaatccacctctatggaggtgaagtatcccctaaactcctttcacctccaccgggcaacgccacgcgccgctatctcgccttctttgccggtggcatgcacggcccaattcgccctatcctgctccaccactggaataaccgagacattaatgacgacatgcgtgtgtacgagtatctccccaaagacctagactattattccttcatgctgaactccaagttctgcctttgcccaagtgggtacgaagtggctagcccgagaatcgtggagtcaatttatgccgaatgcgtgcccgtgatcctatcaaagaattatacgcttcccttcagtgatgtactgcgatgggagtcattttcagtgcaggtggatgtttcagatattccaaggctgaaagaggtgcttagtgcaattccagagagcgagtaccagaaactcaagcatggagtaagggctgtgaggagacattttactctgaatcaaccggctaagagacttgatgtctttcacatgatcttgcattccatatggctcagaagattagatatagatcttagataa

SEQ ID NO: 44123 - DNA, 1728 bp, Glycine max
  Peptide Sequence Number=SeqID_135808
atgagcacggtgtctcttctcaagtgctacagaccctttttctctatgcttttccctcactctgccccacccagaccccacgcctccatcttcaggaggaaaaacttcccttctttttgcgccacctcatctccgccgccgttgacggcggagaagggttgcggcaaattcgactccgagggtctcgccttgccggaggtgtggctgcacaacaccatgagtaagacgaaggagctcttcaaacccaaagtggattccaaagtgggaatgtacgtgtgcggcgtcaccgcttacgatctcagccatattggacatgctcgcgtatacgtcaatttcgaccttctttacagatactttaagcatttgggatttcaagtctgttatgttcgcaattttactgacgtagatgacaagataattgctagagcaaaggagttaggagaagatccaatcagtttgagccggcgctattgtgaagagttctgtcaagacatggtaactcttaattgtctgtctccctctgtggaaccaaaggtctcagagcacatgccccaaatcattgatatgattgagaagattcttaataatgggtatgcctacattgttgatggggacgtatactttaatgtagaaaaatttccagaatatgggaaactatctagtcgagatctagaagataatcgagctggtgagagggttgcagtcgattcaaggaagaaaaatcctgctgattttgctctttggaagtttggaacttacttaaggtggatttccaatgctattctgcagtctgcaaagccgggggagccattttgggagagtcgctggggtcctggaagacctgggtggcatattgaatgcagtgccatgagtgcagcttatcttggttactcttttgatatccatggtggaggaatcgaccttgtgtttcctcaccatgaaaatgaaattgctcagagttgtgctgcatgtaagaaaagtgatataagtgtatggatgcacaatggttttgtcaccattgactctgtcaaaatgtcaaaatctttggggaattttttcacaatacgtcaggttatagacatttaccatccactggctttgagatattttttgatgagcgcacattatcgatctcctattaactactcaaatatacagcttgaaagtgcttcagaccgtgttttttatatatatgagacattacatgaatgtgaaagctttttgaatcagcatgatcagacaattaggaaggattccatcccaccggataccttggatattattgataagttccatgatgtttttttgacctcgatgtcggatgatcttcacactcctgttgtattggctggaatgtccgatccattaaaatcaatcaatgatttgctacatacccgtaaggggaaaaaacaacaatttcgaattgaatcactttcagctttggagaagagcgtcagggatgtccttactgttttaggacttatgcctgcaagttactttgaggttttgcagcagcttaaggaaaaagctttaaagcgtgcaaacttgacggaagacgacgtcttgcagaaaattgaagaacgggctgctgctagaattcaaaaggagtatgctaaatcggatgcaattaggaaggatttggctgttgttggtattactcttatggacagtccaaatggcacaacttggaggcctgccattcctcttccacttcaagagctgctctaa

SEQ ID NO: 44124 - DNA, 147 bp, Glycine max
  Peptide Sequence Number=SeqID_135809
atgtgggttggaagaggaggaggaggaggattgggaaatggaagaggagtgaaggttacggaagcgttgttgggtgaaaagtctacagcagccttaatgggggaattgcttggggtacccaacaatttcccaaaaggccgaaaatag

SEQ ID NO: 44125 - DNA, 486 bp, Glycine max
  Peptide Sequence Number=SeqID_135810
atgaatattagtgttgtggaaatcgagccattttgcaacgtcgctagtagcgtaaaagaggaaggagtggtcgagctccttacagcgactgggatactccttgcggacttgggaaatggtgatctagcggcggttgaaggacgcgtgggggttgctggtgtgggatgcggctgtatgagtgcgtggagtgaaggtggattcgacatggacgacggaggtggtatgggcggcggagtcggcaagggtgattggttgtgttgcattggtacgaggcatgaaggcgtagttggcctggaaggcggaggcgacggtggcggagttgagctacaacaaatttggccatggcagcctcgaggcggtccacgcccgcgggagaaggttcagcgtccgtcattcgaggtgggtgttgaaatgaaagggacagaggatgaggggtgtgcggaaacaaaggggataggtgctgcagaaatggttgctggtggatag

SEQ ID NO: 44126 - DNA, 747 bp, Glycine max
  Peptide Sequence Number=SeqID_135811
atgtcaggtttgaactggagtatcttgagagtgaacaatttgttaatggatcaacatagaggtgaggtattggatccggttcatgataggaatttgagtcattcggttgaaggtgttgcaattgcaagagctagtataagtggagaagtaggagaggtggatgaggatttgggatctgataaggaactaaaggacgatgttaagggtcaagacaagcatgatcaagaaaatattagtgataaattgcctggggttgatcaggggactagttataattcaaacaatttggttaatcaggaagtgatagaaactgtggttgtaattgagtctgttcagaccgagtatgccaatgaagataatacgaaactggaagcaaaagttgatgaatcagggttgagcttggtatccatgaaagcaccaaaaggggtgtctgaaactgataaaaattcatgtgtgattgatataaagtgcagcagccgcaaaaaaatttacaagagttctgaaggtgaaagaatttgtaggatttgccatctgacttctgggcagtcatcggatgcaacaactgttggcacttctgatagtgctacaagcgcagatttgattcagcttggttgtgcgtgtaaaggcaagccaggcattgcacacgttcattgtgctctggcgtggttcaagcttaaggggaacatgtatctgttcttgccaaatatcagtttgattatcaacaataacattagtgttattttttag

SEQ ID NO: 44127 - DNA, 213 bp, Glycine max
  Peptide Sequence Number=SeqID_135812
atggtttgtgtgggagagaatcttgagggtaaagaacggcaacgcccatctgtggaagagagaattgaagcacagaaagatagaaggagggtgaagagacaagttgaagaagaaggtaggagtgaattattggtgcttctccttcgattgggtcccaagtacacgttaccttcttccttcaccctagtcaagtcaaataataattcaaactaa

SEQ ID NO: 44128 - DNA, 360 bp, Glycine max
  Peptide Sequence Number=SeqID_135813
ggtttggttattagggttttcgctcacccgtgtgcagtcgagcctcccgaagaaaaagcgaaaatgccgtcgcacaagacattcagaatcaagaagaagttggcgaagaagatgaggcagaacaggcccatcccctactggatccgcatgaggaccgacaacaccatcagcgccgtcactggcgtcgcaccaagcttggattctgagccgtcgcacaagacattcagaatcaagaagaagttggcgaagaagatgaggcagaacaggcctatcccctactggatccgcatgaggaccgacaacaccatcaggtacaacgcgaagcgccgtcactggcgtcgcaccaagcttggattctga

SEQ ID NO: 44129 - DNA, 321 bp, Glycine max
  Peptide Sequence Number=SeqID_135814
atgaacacgaacggtgacaggaagaagaagcgccgtaggaagaggaggacgaacaacaagcggaagaaaaaggccgaagaagaaggatgtgcgcgcggtggccgtaggtacatgaataggaggaagaaaaaggccagacaacactgtagctttatttatgttattagggtgaatgacatttttgccatttcaccctacatgctgggtgccccagcaaaaatgttgggtgtaccaagtaactcccttcacttaatgtgggccatgggtttgatcttacaaatattcatctataaaataaaatttaaaaagtgttttatgtaa

SEQ ID NO: 44130 - DNA, 708 bp, Glycine max
  Peptide Sequence Number=SeqID_135815
atggcgtttccaagcgtaaacgagcaaagagaaaccaacgggaacgaccaactcattctcctccacactggaccattccaaaaccgaagagcttccaccgaaagacccaccggaagacgagagcgaagaagaggaccaagtcttgccccattcagaaacccccaaattccacagtccgacaacgttgttcctatccccgaccgcctcaacctcgtcctcctcgaacttaaacatgaaaatggcgtgcgcgtcggcggcgctgttgttgttcttatcaaacagccagttataaagatcccacgagatttgcacgtgcacgccgtcaacctggacccgctcgttccctctgaacttccacttcagccgcttaatctgcagcaccttctctccgtccacgctgaagcagagcctggagtggtcgtggtagccgcaatcgatctgaatctcacgcgctttgcctccgaacgtggcgcgcgtggtgtacagcctgtcggcgaagacgagggtcatgtggttgtggacgacgagggcgacgtagaagcccgagaggggttctggggcggcgccgaatttggctctggagaggttccagaagaggaaagtgtcgggggcgagttttttggaaccgtgttttttccagaagaggaagggtcttatgtggtggtggaaggagagggtggtggggttagggtagggtggggaatctaa

SEQ ID NO: 44131 - DNA, 522 bp, Glycine max
  Peptide Sequence Number=SeqID_135816
atgagtctggatccttcagctgtgtcagtctattatgcaataacatgcgggagtaatcttcatgcctcctcttgtcttgaaatgttgctctacggatttgcaccaacattgaacattgttgtggactgtggaaacctccgcaaaagtgttgctcacattcttctgcgacatggtgctgatgcggcggactccgtctacaacacaaactcatttgcggcttctaccactctacatacacttagccttgatttggtgaaccgtcgcgacttctcgaatccacgaggacagtggtgcgatgacgatgtcgatgtcgatgtcgatgtcgatgttgtgcgacgacgagctttatggccagcactaatggaagttcctccgtcaccaccgccccttcatggccatcattggatctctctaacccctttgccttttcctattctttgtttatctcaaagattgaatttttctgttgcggtgttctcaaaatctagtttttcccttgatgggctttggggattttggtag

SEQ ID NO: 44132 - DNA, 126 bp, Glycine max
  Peptide Sequence Number=SeqID_135817
atggatgaagggatcggagatttgagctccgatgaggggagaataggagcaacaactacacgggaggtgtcgtttacaactgggctcttgcaattcgggatgcgacaatgtgatatcagtcgttaa

SEQ ID NO: 44133 - DNA, 273 bp, Glycine max
  Peptide Sequence Number=SeqID_135818
atggaccttgcgcgcaaggtgttcaatgaaattcccgaaagggacgtggttgcttggactgcactcatcatcgagcacgtgcacaatggggagcctcagaagggtttgaggtgtctccgtcacatgcattgtgaagatgctccgatgcccaatgctagaacgtgggagggtgggtttcttgcatgtgggagcctcggtgctcgtatcgatccttttgtgaggtggttcacaaagatcttatctgttggacgtccatcatcgggatttatgtga

SEQ ID NO: 44134 - DNA, 1047 bp, Glycine max
  Peptide Sequence Number=SeqID_135819
atggaacaaaatgcgtgcaaggaattgtcaaaaattgcttcgaatttcaagtgcgagaaggttctcgaaacagttgatgaatcaattgtatgccccactccacaaaagaacgaggaacccctaactgtcaaatccaaagagggacaaaccaaccttcctgaaaaatactctacgcttgctgatttgtttggtcacatgagttgttcactcagattgttgtatctgtgtaaaaaggctccaattttcaaaatgtttgccgccaggaaattctcccatgcccatcttgcgcagatgaagtatatactccctaaaagtgtgtatatagacagggtgcttgttcatgataagaaaagcttgtgtgtggtgcctgatatgaagatcaccttgaaatttgaggttgtgaaagattgctttggcgaatctgctgatctggctcttcgacgatattttaaatctaagctgattgatttctttgatatgcatcctgaggacatgcctacccaaaagtcaacatcatcttataagccagcaaaaagagtgcttgacttttccctcatggaggacaatgatggcttgggcattgaaatggacaagttagaatctatcagagctctgcatgaatctagcagaggatgttctgaggattgcaactcttttggttctgtttctgcacctcaggaggtgctgagtccggtcgatgataacttggttgcagtcgagttttttgctctgattggtaaagagaaagacaagaggaacgatgacattgacgcgctgctcggggcggatgagaagcttgaggatttcgatgatgatcaggagaataaggagaacaaggaaggtgtggttgttgaggaggagatggatgaggcttttaattttaggctgaatgggattggtagcaatgttgctactggttggtggtttgtgaacgaaggcgaggctgtcctccttgctcaccatgatggttcttgtacttattatgatattaccaatagtgaggtatgtgttcttagtttaatgccagattcaaaatgtcaagcttaa

SEQ ID NO: 44135 - DNA, 1587 bp, Glycine max
  Peptide Sequence Number=SeqID_135820
atggtacattcacacactgaaacactgagagcagtgaatctgaaagagccaaagagaggatacaggggcatgccctggtgcccccctgccctcaaatgtagcaccacatttatgagtggtgacaaatattcatcatctcagtatagtgtattcacatgttcagtaacccctggtcaacctagcttaatttccgatgatccggaagctgttacccttactggaagcagccaggaagcagcaaaccagataaatcaaaaagaaattcattgggggttgcttgaagactctcttgaagaacggctggagaaagccggggccttgctttcagactctgaaaagggtgaaggggaagcaaaagagggggagaatgacgagactaagaaaagatccattgaaggaggaaagcaaggtgcttcagtcaaaaaagtaaaaaaggacaaaggtggaagtgcaactggaaaaagtgcaaaacctgaagctaacaccataccttcagctcctcgagttaagccagaactccctttgcccgtaatcccagctgaggcggaacagtccgtccttgaggatttaaggaaccgtgtacagcttagcagtgttgcattgccatcagttagcttttacacatttatcaatactcataatggtttaagctgttcttcaatatcccatgacggatcattgattgctggaggattttctgactcatcactgaaggtttgggatatggcaaagcttggacaacaacagaccagttctctttcgcagggtgagaatgaacaaatatttgggcaaggtggtgggaaaagacagtatacattgtttcaaggtcattcaggccctgtttatgcagcctcttttagtcctgtcggagattttatcctttcatcctcagcagactcgacaattcgattatggagcacaaaacttaatgccaatcttgtttgttataagggtcacaattaccctgtctgggatgttcagtttagtcctgtggggcattattttgccagctcgtcacatgacagaactgctaggatttggtccatggacaggatacagcccttaagaataatggcagggcacttgtctgatgttgattgtgtgcaatggcatgccaactgcaactacattgcaactggttccagtgataaaacagttcgactatgggatgtgcagagtggtgagtgtgtccgggttttcgttggccacaggggtatgattttgtctttggcaatgtctcctgatggtcgctatatggcatctggcgatgaagatggcacaatcatgatgtgggacctctctagtggccgctgtctcacacctttgattgggcacacatcatgtgtctggtccctcgctttcagttctgaaggttctgtgatagcatctggatctgctgattgcactgtaaaattgtgggatgtaaatacgagcaccaaggtttctagggctgaagaaaaaggtgggagtgctaacagacttagatcgctgaaaactctaccaaccaaatctactccagtttactcattgcggttttctcgaaggaatcttctttttgcggctggtgctctatcaaaaagtggctaa

SEQ ID NO: 44136 - DNA, 408 bp, Glycine max
  Peptide Sequence Number=SeqID_135821
gtgcaaagaagcttacaggataagtctttccttgttgcaacttatgaaggaaagcacaaccatggtgtttttcgtgatttacttaagccatcatcttctatacaagaaacctcaataatggacaattatttacctatgacagtcatgccaaatgacaaattagatactatgaacatagacctttgtctatgcaatcgagctcaaacagatataagacgttgtgatgatattaaagaacagaacgaccgtggcagcaacagcaaaattgaagaatatgcaagttctccagtcaaagatcctgacttcatcatgccattagctgaagcagttgtccactccctcaatagccagagttataagcaagtgggtcttaacctgagtttgggtcttccagaaccccaccactag

SEQ ID NO: 44137 - DNA, 1149 bp, Glycine max
  Peptide Sequence Number=SeqID_135822
atgtattattatagacaaaaacagtacaagggatactggataaaggaaatacaatgcaccagtggtgctgccctccaaaaaacccaaactaacccaactaaaaagataggaatgggaatatatctcagcactccaaaaactgaaaagttttctgaagatggtgaaaatgactgtcttagatatggtttatcatccatgcaagggtggcgtgcaacaatggaagatgctcatgctgcatatactgatctggatgagtccacttcattttttggtgtctatgatggccatggaggtaaggtggttgcaaagttttgtgccaagtttcttcatcaacagttgttcaaaagtgagacatacttaactggagatataggagcctcccttcagaaagcctttttgagaatggatgaaatgatgcgtggtcaaaggggatggagggaattatcaatattgggggataagataaacaagtttactgggatgatagaagggttgatttggtctccacgaagcagtgatgggaattgccatgttgatgattgggcttttgaggaggggcctcattctgattttgctggaccaacttcaggaagcactgcctgtgttgcagttattagaaacaaccaacttgttgttgcaaatgctggtgattcgcgttgtgtgatatccaggaagggccaggcatacaatttgtctagagaccacaaacctgatcttgagattgagaaggaaagaatcttaaaagctggtggtttcattcacgtaggacgagtcaatggaagtttaaatcttgcaagagctattggtgacatggaatttaaacagaataagtttctttctgctgaaaaacaaattgtaactgccaatccagacatcaacactgttgagctttgtgacgaagatgagtttgtggtgttagcttgtgatggcatatgggattgcatgtcaagtcaacaactggttgattttgttcatgaacaattgcactcggaaacaaaactttctgccgtgtgtgaaagagtacttgatcggtgtttggcaccatcaactgccagtggtgaaggatgtgacaacatgaccatgattgtggtgcagttcaaaagacctgctcagtccagtgtaccagcagaagagtcctcttcaaactga

SEQ ID NO: 44138 - DNA, 3618 bp, Glycine max
  Peptide Sequence Number=SeqID_135823
atgggtcacgtaggttccagcaaggacggcaccgaggctgggccttccgccgccgcgatgggcatcgacgacgacgaagacatcgacctcggcgacgtcgatctcgacccgaccaacgccgaaatcctcgaagagctcggtgaagacattgtgaaatactggtgcaagaaagcgtcgatgctcttcttcaacgagtacggtctgatcagccaccagatcaactcctttaaccacttcatccacacaggcctccaaaaaaccttcgaatccttcggagacctagtcgtaacgcccgggttcgacccttccaagaagggagaaaacgaacacttccgttacgcctccgttaagttcggcaatgtgaagctcgataaacctatgttctggggcggtgaagggaacgcgcaggagtttaagatgcttcccagacacgcgagaatccagaggatgacctacgcttccaaagtcaaaatccaagttaaagttcaggtgtatgttccgaagaaggtacggagtgataagttcaagactgggaaagcggaattccttgacagggaggttatgaaggaagacgagagggaaatcatcattgggagattgccagtcatggtcaagtctgatttatgctggatgaaagaggcggagaaggaggatgatgaatttgaccatggaggttattttatcgttaagggtgcagagaagacttttattgcacaggagcaactgtatttaaagaggctatgggttatgaatagtccaggttggatgattgcctacaagtcacagatgaagagaaacaggatggttattaaactggtaggaaattccaggggtgaagaagtggagaatggggacatgtctcttgctgtatattttttgtctgttgaggttcctgtgtgggtactgtttttcgctctcggtgtctcatctgacaaagagattgtagatctcattggttgtggcaatgatgatgtcagaattcagaatattctctttgcatctgttcgggatgctgatgagaaatgtggagcatttcgaagaggtaggcatgcagttcaatatttagaaaaatgtgtaaaaagtgttcaatttccaccttcggagtctatgcaggagtgccttgaaatgtatgtcttccctggaattagtggtttgaatagaaaggcgcgcttccttgcatatatggtgaaaggtctcttgctggcttatactggccgccgaaaatgcgacaacagggatgattttcgaaataagaggcttgaattggccagtgagcttcttgaccgtgagttgaaagtgcacattgcacatgcccggaagcgaatggcaaaagctttgcagagagacctttatggagatagggatgtacgcccaattgagcattatctcgacgcgtccataattacaaatggcttgcaaagggcattttcaacaggagcgtggtctcatccatacaagaggatggaaaggatctcaggtgtggttgcaaatgttgggcgcactaatcccttacaaaccatggctgagttaagaagagcgaggcagcaggtccagtacacaggaaaagttggggatgctagatatccgcatccttctcactggggcaaggtttgtttcctctctaccccagatggtgaaaattgtggactagtaaaaaatttggctgtcacaggattagtaagtactgatgtatcggcagtatctgaatatatactgcctaaattgctggattgtggaatggaagaacttgttgatgatacttccactcatcttgggaacaaggacaaagttctcctaaatggcgattgggttggagtgtgtcctgattccagttcatttgtggcagagctacgaagcagaagacgtagaaatgaactgcctcatcaggtggaaatcaagagagaccaatctcaacatgaagtgcgcatatactcggatgcaggaaggattctacgtcctcttttggtggttggtaatctactcaagattaaaggatttaaatcagactgtaactctttccagtctctattggataaaggtgtgattgagctgattggaccggaagaagaggaagactgttgtacagcctggggtgttgagtatttatttggaaaagaaggaaaacgatctgtaaagtacactcattgtgaacttgatatgtcattcttattgggtttaagctgttcacttgtaccatttgctaatcatgaccatgcgaggagggtactctaccagtctcagaagcactcctcacaggcaattggcttttctacaacaaacccgaacattagagttgatactttgtctcaccagttacactatccccaaaagcccctttttcgaacaatggcttcagattgtcttggaaaaccagacaattcacttggtcaaaataaaataagtaaaatacctccaaaggcagaattctataatgggcagaatgcaattgtggctgttaatgtacatctgggatacaatcaagaggattcccttgtgatgaaccgtgcttcactgcagcgtggtatgttcaggtctgagcacataaggagttacaaatctgaaatcgataataaggaatcttcagataagaagcgaaaacctgaagacattgtaaattttgcaaagctacaaagtaaaattggccgagttgatagccttgatgatgatggctttccatatgttggtgctaatttgcagagcggtgatattattattgggaagggtgctgaatctggtgcagacaatagtgtaaagttaaagcacactgaaaggggttatgtgcaaaaggttgtgctgtcttcaaatgacgaagggaaaaattttgctgtggtttcattaagacaggttcgaagtcccgttcttggagacaagttctccagtatgcatggacaaaagggagttttgggatttctggagtctcaggaaaattttcctttcacaagacaaggcattgttcctgatattgtcataaatccacatgcatttccctcacgacaaactcctgggcaactcctagaggctgctttaggaaaggggattgcttgtggtggcatactgagacaagctacgcctttctccacaccttctgttgatgccattactgaacagcttcacagagctgggttttcaagatggggaaatgagagggtatacaatggaaggactggtgagatggttcgatcactcatttttatgggaccaacattttaccaacgtctgcaccatatgtctgaagacaaagtgaaattccggaacactggtccagttcacccgttgacccgacagcctgtagctgacagaaaacgatttggaggtatcaagttcggtgagatggagcgtgattgcctaatagctcatggtgcatcagccaacctgtatgaacgcctgtttacactcagtgactcctctcagattcatatctgcagcaaatgcaaaaatgttgcaaatgtgatcttgcggcctgtctctggtggccggaaaatacgaggaccttattgccgccactgtgaatctgcggatgacattgtggtggctcatgtcccgtatggagcaaagttattatgccaggagctctttagcatgggcataaatcttaaatttgaaacccaactttgctag

SEQ ID NO: 44139 - DNA, 129 bp, Glycine max
  Peptide Sequence Number=SeqID_135824
atggctaaaaacgttttaactggcactgcttatgttagcgaggacattcccattgatgatgtggctgaggatgatgatgaagagctcccaaaagttgataacgttgaaactgagacttcaaatttgtga

SEQ ID NO: 44140 - DNA, 1563 bp, Glycine max
  Peptide Sequence Number=SeqID_135825
atgagacacactccgaagattggtgttcacggtgtctttgtgtgttataatatattggtattgttgttgagcagttttcatgaatcaacatcatcctcttcccactgtaaagcatggttagtgcaatccattcccaccgatatgccccacttatcccatgttccaggcaccctctctactggggatgtacttcggtggctggctgcaaactccaccacgaggcttcacataattgctcagtactggcagctgttaccttctcccaacgatcctcgctctggggactatggttacactcagcatcagatgcatgaatttggtgccgatcagggtgtttccctttatcaagcattagatgctgctgctgaccgcaatgttagcatcaggttactgtcccactctggagtgtatccaacttttgcctcagaaccatccaaacttgctttcggaaggcctaatgttgagaacgtgacattgctacttgaggattggtggggctccggcattgtccatgccaaagtttggatatctgatagtagggatgtgtatattggatctgcaaacaatgactggaaatctcttacacaggtcaaggaactgggaatttattttgctgattgtcctgaaatagctaaaagggttgaggtctactttgacaatttatggacactagcatctcttaattcttcagcttacacaaaaacagtgtttgatcaagactggcaagttgagagaaaggttccttgctggtcgcatttcattaatcatagagagaggtgcaagtcgcctctcccacaatatctggagacacctcatattgcaggatatcctattctgtctgagccttatatgtttaaggttccatttcaaactcctgggagtaactattcaacaaagcacccccaaggcagctatctatcatttgcacccccagagctattatttggcaaatatcaggctgatgagcatgcatggattgatacaatcaagtctgttggaaagaaagaaacagttagaatcagtaccatggactggctaggtcagtcagaatttatagaccaaacaatttactggtcatccttatcctctgcaacatcacaggtggtgttttccaagaatgcaacagtgcagatattggtagcatattggtcacactccatcagtaacacagattcgtacctgaattctctcctctacaccaacaatctctgctcttcctcaaaatacaacacatgctcagggaaagttgagataaaatattatgtggttccaggtttcaacatgacaggacctgccattaagggtggaaatagaacaggtaacatataccctgattttaccagagtgaatcatggaaaatatgcagttagtgatgtaagagcacacattggaactagcaatcttgtatgggactacttctacacaacagcaggtgtcagccttgggacacacaacactgccatcatctctcaacttagggaaatttttaatgctgattggaactcaccctatgctgttccatttgaagagatggagaacgttcatacaagaagttcaatctaa

SEQ ID NO: 44141 - DNA, 421 bp, Glycine max
  Peptide Sequence Number=SeqID_135826
atggaaggcgtggaatggatcaagcgcgaaagcactgtcctcattttctctgttgagctttggaattttctttacgagacgaagcttctttggaattttctttacgagacgaagcttgtagagttaggaacggcgaaaaaggaaagagagagagcgagaggcgaaagcgtacacgtggcacctcttcacgctgacacctcttcccctatgtggctctattccaacctcaacctccctcactgcccgggcctggtggaagcacttgatggagaagccaaacttgaaaagatgatggctgatggggataagaaagcactactgcagaaggcacacagtgcaattattttcagtctcggagacaaggtgctgaggcaaatctctaaggaaacaactgctgctggggtttggtcaaagcttgaag

SEQ ID NO: 44142 - DNA, 1038 bp, Glycine max
  Peptide Sequence Number=SeqID_135827
atgaaggcagtgacaaattgcaatcaatctggatgcttggcttattctagaactgaaatatctgatgttccacttttgtcttgttcagaggctatggaaaaactaaaatcattcagagaaaaggtaaagggcaagcagcaattccttgctatgtattctagcatttttggtgggataacaacagacccagctgctatggttattcccatggatgaccacatggtccacaggggccatggtgtctttgatactacagcaataatagacggatacctctacgagctggatcaacaccttgaccgctttataaggtcagcatccacagccaaaataaaccccccatatgatcgtggaaccataagaggaatacttatccaaaccgtgagtgcttcaaaatgcagaaacggaacactacgttattggctctcagcgggaccaggagatttcgacctatctccctctggctgccacaaatcgtgtctttacgcaatcacaatacaggatttgtcaccaatcaacttcagaggagttaaagttgtgacctcaaatgttcccattaagcctcctcagtttgcaaccaccaagagtgtgaattatcttccgaacgtgctctccaagatggaggctgaggaacttggtgcgtttgtgggcatttggcttgatagtgatgggtttgttgctgaagggcctagcatgaacgtggcttttgtcaccaaagagaaggaacttgtgatgcctctatgtgacaaaattctaagtggctgcacggctaagagggttttaacccttgctgagtctttggttagggaaggtaagctttgtgggataagaatgaaaaatgtgagcgtggaggaagggaagaatgcagatgaaatgatgcttcttggcagtggaattatggttcgctctgtagtgcagtgggatgagcagataattggatgtggtaaagaaggccctataacccagactctactgaatctagttgttgaggacatgaaatccaccctgccagctgttggcacacctgttccttattga

SEQ ID NO: 44143 - DNA, 894 bp, Glycine max
  Peptide Sequence Number=SeqID_135828
atggtccttctatacctcccaaggtttcctctctacctcgttaccttatctcactccctccctcgtcgaacctactccaaaaccaccctcttacgcccacccaaatccactctcacaacctcacaacccttaaccgttaacccttcccccacagagctatccctcgagaagctcttcgttccgccggagaccaccgtgtccctcgaaagttcaagagtcttgaacggttctaacattctgctgagtaactacgccaacgatgctcaggtattgcaggccgagtttgtgaaaagcagtgtgaagactgaagactgtccctccgatggaattcccgagttcgctctcgttggccgctccaacgtcggcaaatcctcgctccttaattccctcgtccgccgcaagaaactcgccttaacttcgaagaaacccggcaaaacacaatgtataaaccattttcggattaataatagctggtacctggttgatttgcctggttatgggtatgcatctgcaccacatgaacttaggatggattgggaaaaattcaccaaggactatttccttaaccgctcaaccttagtttcagtattccttctaatagatgctagcattcctgctaaacaaattgatcttgactatgccagttggttgggtcagaatcagtttttctttcagatcccaatgacattaatcttcaccaaatgtgacaagcggaaaaagaaaaagaatggaggcaaaagaccagaagacaatgttaatgattttcaggatttgattcgaggtttcttccaatccgtgcctccgtggatcatgaccagtagcgttactaatcagggtcgtgatgagatactcctccatatggcccagctacggaactactggctcaagcactag

SEQ ID NO: 44144 - DNA, 1074 bp, Glycine max
  Peptide Sequence Number=SeqID_135829
atgaattttaatcctaataaaataatagcattaaacagtgcatctttcgtcatttacctcttgttctcaagctgctatggcggtggttctcactctaactgtaaaatccaaaacaaattggcgggaaaagaagccattgtagaagctcagagtcagagcaagctccgatcagagttccttcaagtcctgcgtagtaggcgacccactcaagttccactaactgtcaaacctgcgaagccagtgaagaatcctttgtatcaaatgcctcctccaacgagggaagagatcgagatattggattcgactccaaaggcagatatagggaaccttgaagagttgctcgaggaggagaacttgtacttgaacatagagaaaggagagcaaggacggttgccggtgatgatactgaagttgaagagaagtaataagcagagaaaaaagcccgtggttgtttttcttcacagttcatacactaacaaagaatccatgcgtccattccttaaggcgtatgcttctcgaggatatatagcaatttcggttgattctcgttaccacggagaacgtgccaccaacacaaccacctatattgatgtgtgggacttgattaaattggcagattatctaacacagagaagagatatagacctttctaggataggaatcactggaatatcacttggaggaatgcatgcatggtttgctgcagttgctgatactcgctatgctgtggttgttcctcttattggcgttcagggttttcgatgggccatagacaacgataaatggcagggtcgagtcgatagtataaagcctctttttgaggtggcacgtgctgatttaggtaaaggtgctattgacaaagaagtggtggagaaggtgtggagccgaattgctcctggtttagcttcccaatttgattcaccctattcagttccaactatcgcaccacgtgctttgcttattgttaatggtgcggaagatcctcggtgtcctcttggaggcttggaaattccaagagcaaaggcaaccgaggcatacagaaagtttcattgtttagataatttcaaggtatga

SEQ ID NO: 44145 - DNA, 417 bp, Glycine max
  Peptide Sequence Number=SeqID_135830
atgaggacagtgctttcgcgcttgatccattccacgccttccatttccaggatcaatgccacggtagtgtcaatcagcgggagaaatctcttctttaaagttgaagaagcagagactgtaaatgtggctccacatctcttctttacatttgaagaaaatgggcctccacccccaacggaaaagttggttgtgtttggaggcaatcggtttgttgcaaaacacatttttagagaagccctagatcgtggcgagtctgctgggtgtcctaccaggtctggtaggtcatccctgcatgattcctgggctaggaatttttattggtataaagggaatctcttttcaactgattcattgacagaagctctgaatggggccactgctgttttacaagatgttgctttagattttgtcgcttag

SEQ ID NO: 44146 - DNA, 777 bp, Glycine max
  Peptide Sequence Number=SeqID_135831
atggttgaagcactctcgcaaaacattgtgaccctgactgatctccctatgatcttacttagtgagagtgacctgacaaactcattgtgtggtgtgtcttgttatgtactcctaagcgtcccagagtggtttttcactaacatgaaggtgtcacagttttcactagccaatgttccactcctaaaagaagagctaagagcaaaaatcacattcaatgagcgaatagcaatctatgttactcgtctcagaaagcgaatatcagacgatacacgcaatgctttgttgatgggtgctattctcttcgtaacgagcacgtacgaagcagcacttagcccccccggtggagtttaccaaggtgaggctagtagtgtcacaacctcaaagaaaactagggcatcattgcttcagagggattatgcaacgccagaaattgtagggaaagtggtgatgaaaatgcaaacgttcttctggttttggtccttcaatacatggtccttttatctatcaattttgatgatatgtttgctaatgccacgagggcgcatccgccttatagttattttcccactttctatcttttctgggtgctacgtgttctccatgatggttatatcacccagcctcaggttaaacactgccactgtggttatgccatgcatatttatcgtcttctattgttgggaaagttcgatatacattaggttagcccaaaaacttaaaatgtacggtcatagacagaaagacgcgttgaagttttccagaggaaatagatggtaa

SEQ ID NO: 44147 - DNA, 2205 bp, Glycine max
  Peptide Sequence Number=SeqID_135832
atgcttgtcttgggagtgtgggatctcaaatggctcctccaattcgtattctccgcgttcgtcttggcgattggactgcacgcgctgctcaagaacaccgcctccaagtacttcgagattgaagccactttccacgctatgcctggccctctcaccgaccattctctctgcgccgtttgtcgcaaccccgccaacaagaaatgttcgcgatgcaaatccgttcgatactgttcacaagcatgtcagcaggcgcactggaaatccgagcataagatgagatgcaaggagtttcagggcagcgccagtgtgatgaatttggatcaaactgaagtaactaatcgtgttttcaaagcttctgctgctgtgaatacaagtacatcttcaattgccctcattcctgaatgcggtcgcggaacatccaggactatcaagcagcctaaaactgttatttatccgtatgatgaatttgtcaaattgtttaactgggacaagccaggatttcctccttgtgggctcaaaaattgtggaaacagctgctttgcgaatgtggttctccaatgtctctcattcacaaggccacttattgcctttctattggagaagggtcatcacggagaatgctgccatagcgattggtgctttctgtgtgaatttgaaacccatgttgaaaaagtaaggctaagttctcaggcattttctccaatgaatattctctctcgtttgcccaacatcagtggcacactgggttatggaagacaagaggatgctcatgagttcataaggtttgccattgatgctatgcaatctgtttgccttgatgaatttggtggagaaaaagttgtccctcctaagcatcaggaaacaacccttatccaacacatttttggtggccaccttcaatctgaggtgatttgcaccgaatgtgaaaagaattcaaatcaatatgaaaatatgatggacttgaacgttgaaattcatggagatgctgcttccttggaggaatgtctagaccaatttactgccaaggagtggcttcatggggataatatgtataaatgtgatgggtgcaagggttatgtgaaggcatggaaacgtctcacagtgaaacgagctccaaatattctcacaattgcgttgaaaagatttcagagtgggaggtttggaaaacttaacaagagagtaactttccctgagactttagatcttagcccttacatgagtgaagctggagatggatctgatatttataagctatatgctgttgtagtacatattgatatgctgaatgcttcattttttggccattacatatgcttcatcaaagatttatgtggaaactggtatagaattgatgattggaaggtctcgagtgtggaattagaagaggtgctttcccagggtgcatacatgttgttgtatagcagggttaatgctcgaccatcaggacttcaaagtattgaattgtcagagacagcagaagttcaaacaatcaaatcaaaggtgcagcctggctggactgaacaagctgaatgcctctcagatatgaaaagcgagacttacagttacagtagaggatatgaggcttttccatctgacagtagtccagagttgaaggtttcttgctgtgaaagcgtgactgaaatgaactctgaaattaaaagagagcagtctaaggatgtggacattattgatgttgctagtgagtctttctgtaatggttttgaaacatctcatatgcatgattctgaagctgtcaaagatttgggggatatagattcggatggatcaaatacatgctcatctgttttagaagagatttcagtctgcatggaagagcaagatgataatgataatgatatggctaagtccagtccttgtccacatttgccaaatggcttttcttgctttgataaggattcttctgtttcagtggattatcaaaatacaagggaagattcaggccataaagatgtgactaaatgcaagttaacatcaaatggctttgcaaattatagcaatggatatggcagtgcaaataaatatgatgatgtcccagtggaagatggtgatggatctttttccactgaaacaccctcagctaaaatgcatcaattgaaggagagattggcttctgaaaattctgaagttgacaaaggaaatggagttaagaaagtggaaatatcagcgaataagttaataatttag

SEQ ID NO: 44148 - DNA, 2205 bp, Glycine max
  Peptide Sequence Number=SeqID_135833
atgggtttgttaacaattcaaattttgattcctcgcactacaagtctcaagactgcatttttacaagcaattattatacttcctgaaccaaaaggcgcagagagagaactgagagaagagatgatttccaccatgagttgggatgagaacaacgatgaatttgagatccctctcactcaaacgacaacggcttttcacgcggctcttgcttccattgatgatgataataatcaacggccgtcgaaaaaacctaaacgcaaaacgagcgagggtggttgcgaaattgataactgctgcagcttggatttcattccttccaccataggttgtgtttctgcttgcagtgttcaaccgttgggagaagaggacagtgtttctccttcttcttctactgcgtctttgtcggagctgaaaacgaaggggaattatcttcgcaactcgatagagtcgaagctggtggtttcgagagccaacgcgcttaaccgtgcagatgcagactctgattcggagcttgatctgttgatgaatttgtgcgatgagttggaggaagtagatagttccgttcggtgtcccctgtgtgaggttgatatttcgaacttgaccgaggaacagcggcatcttcataccaacaattgtcttgacgacgttgcggtggttcctgatgataacgagaaaggtgctcaacaagtgcctaaagttgcttctgtggttgattggctacgcgggctcggcttaaacaagtatgaagatgttttcgttagggaagaagttgattgggacaccttgcagtggctcacagaagaggatctcttaagcatgggtattgctgcacttgggccgagaagaaagattgtgcatgccctgagtgaacttagaaaaggagatgctgctgcaaatgagaaacatgaggattcttcggcggagcctagaaggattagaaaccagaaagtcaaattaaaacatgacaagtctgaaagaaaagttgatggcactggtaaaccagtggcaaacaaattaatcactgaatattttccgggatttgcttccaaagaaaagaaagtttctgcctctcccggagaaccacaggaaaagaaaaacagtggcttggattctggtcgtaagcacaaatcaaaaaatacgccaacaaatagaaagctccgtgatgttcccaaatggtgtgccgtccaaggaacgcctttccgagtggtccgggtgtttgacaaatacttttactatatgcaggatgctttcaaatatctcagaggagattgttctcactggtttctcacacacttccacttggaccattatcaaggtctcaccaagtcattcaatcatggaaagatctattgctcctcagttacagctagacttgtaaatatgaacattggaattccatatgataaattacatgttttgcctctgaaccaaaaggttgaaatagctggtgttgatgtgacttgcttggatgccaaccattgtccaggttccataatcatactctttcaacctccaaatggtaaggcggtgcttcacacgggtgatttccgctttagtgaagaaatggctgtcaatcctttaatgcgaatatgtcctatcaatactctgattcttgatacaacatactgcaacccacagtatgactttccaaaacaagagtctgtaatacaattcgttattgatgctgttcaagcagaaacttttaatcccaagaccctttttctgatcggcagctatacaattggcaaagaaagattattcttggaggttgctcgttcgcttcgtaaaaaggttcacgttactgctgcgaagttgcgtattttaaaatgtttggaattgaaggaggaggatatgcagtggttcacttcaaatgaacatgaaagcaacattcatgttgcccctatgtggacgctggcgagcttcaaaagattgaagcacatatcaagtcaatataagagtcagtacaatcttatagttgctttctctcccactggttggacgtttggcaaaggtaaaaagaagtcaacgggaaggagatggcagcagggtactattataaggtatgaagtgccatacagtgagcatagcagctttacagaactcaaagagtttgtaagagttgtatctcctgataacattataccaagtgtgaataatgatggaccagaatcttctgatgcaatgatttctctgttgttatcttga

SEQ ID NO: 44149 - DNA, 1617 bp, Glycine max
  Peptide Sequence Number=SeqID_135834
atgggtggtgatggtagagttgaagttgtgagtggcaaggggtgttcgaggctgttttcatcttcaattccttcattcagaggtttgcaaccattggagccaatgtctcctgcttcgtctcctttgcaagtgccatcatcaactgctccttttgctggtcttgtcatatgcgttactggtttatctaaagaagcaaggaatcaggtcatggaggctacagagagattaggtggacagtatagccccaatttgcatcctcaatgtacccatttggtgtacagttttggtggacgcaagtttgagcatgcgctgaagcatggagcaaaaaatggcctctttgttgttacactgggttggtttgtggatagtgtcaggaaaactgtgaggttgagtgaatcacattatagagtgaagagttacggggataacaacacacgtttggaggattttagactgcttcctgagtatagaaatgctgaaaattcttgttttcctgcaagaatccaccaaagcaaccaagctaatagtgttgaagaacttcaaagattcactggaagagagtctaacagaaattcggactcaactttgtctggctgctccatctatgttgatccaggcatttcatctgaattgcgaaacaaggttattgagactgcttcaagagaaggtgctagtttggttgaacaatggtttgttggctgcagtgttagtcatgtagtaactgaagggacatcaatccaaagatatcttggatactctagtaacctcattacacctctgtggattctcaaaacagctaaggagaaatatgtgcgaaagcttgttcacatgtccgttgatttggcaaagcaagttggcctaatgcttgaagacatccataatgacatttcaggaaaggaagtaataaagcaaaaagtccttaacaatcttccggatactgaaagtgaagtcagctatgaagaaagacaacaaattgtgaattctgccaaaaatggagtcagaaatcgccgtggtcgtcgaatgcagacttgtcagactccaattcgtcctataacacccaacaaccttctagactctatctgctggtctatatccgagccaacttcaactgcttccatttacacagactctttcagtgttgaagatcctagtgaaaatcatacttcaatattttttgacgcaaaaggggatggcaaggattcggaagcttcgttttcaaactccactcgtcctctgacagaaagcgagaaatccgagttgatatttaaaaaccatttccttaccatactattaccaatcgaccgatttgctgagatgggtccttcttcaagaacgtttttcagccataatggttttacatgtcttcaggtgttggatcatatccgtgcattttatcaggagaacatgtcaaggcaagaaatagaagctgcaattcatagtgattcaagacacgctgataggcttagatcagtgtactcaagtaaggaaacagctgaaagtggctatgtaatgttcaaaagggttgaattcttgggtagtcgtacaagttttgaaatgttgaagcgtgtaactggggacaacaattccaacgtttatgagctattacttagggcctaa

SEQ ID NO: 44150 - DNA, 3198 bp, Glycine max
  Peptide Sequence Number=SeqID_135835
atgacgacgtgtacgaaatacccgttttatcatcagaagaaagggtggaagcctgctctgcgcgttaccttgcgtgttgataccggcggcaacggattagcgttgcttcgagaatgtcgaaatccttcacaaatccgagttaatttttttagatctgcgctgtttttcggatctgaaattgtcgtcgggactggtggtggtgcgaaccaccgtgagaggctattcggtgaggacggacttgccattgcaggagaaaaatccccagtttccgtttcgaacgccaagaagatgcacttgcgacttcgagcagccacttccactgcgaacccattcatcccacccgctcacctcatccactccatccctcaatggttctccatcctccgccacgccatcgccgcctccgacttacccctcggaaagcgcgcccacgcccgcatcctaacttccggccaccaccccgaccgcttcctcaccaacaacctcatcaccatgtactctaaatgcggctccctctcctccgcccgcaaactgttcgacacaacgcccgacacaagccgtgatcttgttacctggaacgccatcctctccgcccacgccgacaaagcgcgcgacggcttccacctcttccgcctcctccgccgctccttcgtctccgccacgcgccacactctcgcccccgtcttcaaaatgtgcctcctctccgcctccccctccgccgccgagtccctccacggctacgccgtcaagatcggcttacaatgggacgtgtttgtcgccggtgctttggtcaacatttacgccaaattcggacgaatcagagaggcacgcgttctgttcgatggaatgggtttgagggacgttgttctctggaacgtcatgatgaaagcttacgtcgacactggtctcgaatacgaagcgctgcttctcttctctgagtttaaccgaactggactccgtcccgatgacgtcactctctgtactctcgcgcgggttgtgaaaagtaaacaaaatgttttggaatggcagttgaagcagcttaaagcttatggaacgaagttgtttatgtatgatgatgatgatgatggttcggatgttattgcatggaacaagacactgtcttggtttcttcagagaggtgaaacttgggaagctgttgattgttttgtggatatgattaactcgcgtgttgcctgtgatggcttgacttttgttgtgatgctgtctgtggttgccggtttgaactgtcttgagctggggaaacagattcacggcattgttgtgaggtctgggttggatcaagttgtctctgttgggaattgccttatcaatatgtatgttaagactggctccgtttctcgtgcaaggacagtgttttggcaaatgaatgaagtggatttggtatcgtggaacaccatgatatctggttgcgcgctgagtggtttggaggagtgttctgttgggatgtttgttgatttattacgtggtggtttattgccggatcaattcactgttgcgagcgttttgagggcttgttcctctcttggaggaggttgccatcttgccacacagattcatgcttgtgcaatgaaagctggtgttgtcttggattcatttgtttcaacaactctgattgatgtgtattccaagagtgggaagatggaggaggcggaatttctttttgttaaccaagatggatttgatttggcatcttggaatgctatgatgcatggatacattgtgagtggtgattttcctaaggcattgaggctttacattttaatgcaagaaagtggagagagagcgaatcagattactctggcgaatgcggctaaagctgctgggggattagtggggcttaaacaagggaagcaaattcaggctgttgttgtgaaaagggggtttaatttagatttgtttgtcattagtggtgttcttgacatgtatctaaaatgtggagagatggaaagcgcacggagaattttcaatgaaataccttcgcctgatgatgttgcttggactactatgatatcaggatgtgtggagaatggacaagaggagcatgctcttttcacgtaccatcatatgagactttccaaggtgcagcctgatgagtatacctttgctacccttgtcaaggcttgctctcttttaacggcattggaacaagggagacagattcatgcaaatactgtaaagctaaactgtgcatttgatccttttgtaatgacctcacttgttgacatgtatgctaagtgtgggaatatagaagacgcacgtggtttgtttaaaagaacaaacacgagtaggattgcctcatggaatgccatgatagtaggattagctcaacatggaaatgctgaggaagcccttcagtttttcgaagagatgaaatctaggggagtaacaccagatagagttacttttataggggttctttctgcgtgcagtcactctggtttggtatctgaagcctatgagaatttttattccatgcagaaaatctatggtattgaacctgagattgagcactattcttgtcttgttgatgcccttagccgtgcagggcggatacgagaagctgaaaaggtgatatcatcaatgccttttgaagcttctgcttcaatgtatagaacactgcttaatgcttgtagggttcaggtagacagagaaacaggaaagcgtgtagcagaaaagcttttggccttggagccatctgattcagctgcttatgttcttttatccaatgtttatgcggctgctaaccaatgggaaaatgtggcgagtgctagaaatatgatgagaaaagcaaatgtgaagaaggatccagggtttagttgggtagatttgaagaacaaggtgcatttgtttgtagctggtgataggtcacatgaagaaactgatgttatatataataaggtggagtatatcatgaagaggatcagagaagaaggatatctccctgacacagacttcgcacttgttgatgtagaagaagaagataaagagtgttctttgtattatcatagtgagaagctagcaatagcttatgggcttatgaaaactccaccatccactacattaaggatgcaaatcgatttcatcatttcaggagtggggtttgctcttgtgccatcagctaaccttccttttcttggctcctctttgtcattgacttccaaagtaagtactagctag

SEQ ID NO: 44151 - DNA, 192 bp, Glycine max
  Peptide Sequence Number=SeqID_135836
atgaaaccacctcaagaacgaaccacgtggcacccatgtggcacacatggttatggtgtcatcttccctggatcaaccattctttcagcatcagcatattcgaaggacatccaaaaccagtatcattcaccaacctctgaaaaggccatcaagctaagggggcagggggatgcaaaatcacatggaccttga

SEQ ID NO: 44152 - DNA, 864 bp, Glycine max
  Peptide Sequence Number=SeqID_135837
atgcagcagcctcactacgatatggtggccaacaccttttatgaggaactctcacttgacgcttttaactcatcatccagtttatgcccaaaccacagtgctcaccaatactatccacaatttctccacaacccacgacacaaacagcgacacgagtatcaacattcttatcaattgttccaacaacacccaaatcaatttcatccatcaccacaacaccaacaacaaccccaatatctgggagcacttaattgtcaccagccccaagaagaatccacaaccaccgtgtcgttttggaaagcattcaacacggtgctctctgacgcaaatggaaaaaaccaagagggaaacgaaaactttggggaacttgaagctgtatacataaacgctcgtaataaaaaaaagactgattcagcccttgccgttgaaaacacatgtaatgtggcaaatgagtgtcaattgttagcgacgaaaacaactggggttgatggagtacggacgaagaaaggtaggaaaaggaggagaaagaagcaagtggaagaagaaatgggtttgatgggttcatttttcaagaggttggcgaagcgtgtgattaagcaccaggaggttcttcagaacaaattgctggaagctattgagagaatggagaaagagagagcggaatgggaagaaggttggagggttcgagaaagggaaattcacgacagagaagcgattgtgaaagcgcgtgagcgagatcttgcttctaagagagactcttccattgtttccaacttagagaagataacaggtcaaaaaagcttcgttcttgtttcttctgggaagagtagtcacgagcaattatctacaatacatgaatattga

SEQ ID NO: 44153 - DNA, 216 bp, Glycine max
  Peptide Sequence Number=SeqID_135838
atggaagctaggttgtctagtatgtcgatgtgttatgacaggggcatgattgaagaagaaggggatgatttgcttgagaaagagaaagagaaaagaaaaagagtaatgagagcagagagtgacacgctttggaatgaaggagaagggaacagtgtgagggactttataaagccgttgatcaagttttggaaaatgcaagctgcggtcaaggattga

SEQ ID NO: 44154 - DNA, 150 bp, Glycine max
  Peptide Sequence Number=SeqID_135839
atggtggttccggaggtggctcatgctgctggatatgagttctccccttccctcaagaactttctgctaagcatctttgctggtgtccttgtattcttacatacttttttgagtgttgtaccgagtccctcataccatagcgtgacatga

SEQ ID NO: 44155 - DNA, 1131 bp, Glycine max
  Peptide Sequence Number=SeqID_135840
atgggtgatgacgacgacaataacaacaactcctcccggtttgttccatacacgtgtcgagatccatttgtcagtccacttctcgataacttttttatcgaaccggaccctgcacttgtctatttattacccgaaccgaacctacaaaatgatgaacagcagtccctgcagggtggtcatgtttcctccacgggttcaacgatccaagatcaatcccagcagcatttttgcaatgacaattttaccattggtggaggaggagttcctaactaccaagtagcggggtcttccaagaacaagcgtacatatcccttcactgatgtggatattgaacatcaatccttcaggtatgaccttaaagcgggtccatccaatctgaatcagtctgaaagtgggattatgggttctcgtaattggcctcctataccaaggccattcttttgcacttgctgccaagttctaagacagacaattcacaccaatggtaatgattttgagagacttgaaatacatgggaggatagggttgatcaaccatataataattcagaatcagagtattacgccggggattattctgagtttcaccaacggaacccctgcagaagttaagggtttccttgaagattacattgcgcagaaggataaattagggtacattattgtggaagaagctttttctgcgttttatgaagccctctgcaccaaattagattggattggaaaaccaaatttggaggaagaagaacctgaggctgagcctgagaaaagaaggcataaacgaagtcgcaaagatcagtccgataggataaataatatgacattgaatgatttgagtggcgtgttccacataactatgaaggctgcaaaggatgtattagaaatgtctgttactgtaattaaggcaatttgccgcaagtatcgtttatataaatggccccaaagacagttgcaaccacttgcgaggaggttgaaagtgctcaaaagagcattagaatcttcacaagatccagtgataatacagacaactaacatggaggttcgaagaattaaacaagaaatgactcagttgtgtggtggagttaccccaacgggtatagaaattcctgaagttgaagagaatagtgtttaa

SEQ ID NO: 44156 - DNA, 153 bp, Glycine max
  Peptide Sequence Number=SeqID_135841
atggaagaggatgaagatggagcacaaatttcccactccacagagaacagagaaaagttatatttttttttatatcacttcctactattgccgtgggagttcttcctcctcttgggtgttgctgtctacttctccggtcaaagttacatgtga

SEQ ID NO: 44157 - DNA, 2664 bp, Glycine max
  Peptide Sequence Number=SeqID_135842
atggatcagttcaaaggaaagcctcgtcttcccaaattcgccgtccccaaacgctacgaccttaggctcaagcccgacctcgtcgcgcaccgtttcgcaggttccgtcgccgtccacctcgacatcgtccccgccacctctttcattgttctcaatgccgccgaactctccgtcagcaacgacgctgtttcattcaccaaccaagactcctccaaggttattaaaccttcacgagttgagttgtttgaaaatgatgagattctggttttggagttcccagaggaattacctattgggttcggtgtcttgtccattcgctttgaaggaatcttgaatgatagaatgaaaggcttctaccgaagtacctatgagcacaatggtgagaagaagactatggcagttacacagtttgcaccggctgatgccaggcgatgctttccttgttgggatgaaccttcttgcaagatcttgcaggcttctttcaagatcacattggatgtgccttcagagcttgttgctctttccaacatgccaattgttgaagaaataacagatggaaatctcaaaacagtttcatatcaagaatcaccaatcatgtctacatatttggttgcggttgttgttggtttgtttgattatgtggaagatcatacctcagatggggtcaaagtccgggtgtattgtcaagttggtaaggcaaaccaggggaaatttgcacttgatgtagctgtgaaatctttggaactatacaagggttactttgccactccctactcactgccaaaattggatatgattgcaatccctgatttcgctgctggagccatggagaactatggtctggttacatatcgggagactgctttgctatatgatgaccagcattctgctgctgcaaataaacagagggttgcaactgtagtagctcatgaactagcacaccaatggtttggcaaccttgttacaatggagtggtggacacatgtatggctgaatgaggggtttgcgacatgggtgagctatttagcaactgataactgttttcctgagtggaaaatatggtctcaatttcttcatgaatctactgagggtcttaggttggatggacttgcggaatcccacccaattgaggtggaaatcaatcatgcttgtgagattgatgaaatatttgatgcaataagttataaaaaaggtgcatccgtaatcaggatgctgcaaagctatcttggtgccgaatgctttcagagatcgctggcttcatatataaaaagacatgcttgctcaaatgctaagactgaggatctatgggctgcacttgaggaaggatctggtgaacatgtgaacaagttaatgacctcatggacaaagcagaaaggatatcctgttgtatctgttaaagtcaatgatcagaaattggaatttaatcagtcacaattcttgtcaagtggtgctcaaggagaaggccattggatagttccaataacattatgctttggctcttatgatgtctgcaagagtttcctcttgcaatcaaaatctgaaacacatgaagtcaaagagttccttggttccacagacaaaggtgtaaattgttggattaaacttaatgtggatcaggctggtttctacagggtgaaatatgatgagctgcttgctgctagacttagatatgcagtagagaaacaactcttatctgcatctgaccggtttgaaaaggaaaacactaataacttgcaactgacaggcattttggatgattcatttgcactctgtatggcttgccaagaatcattgccctccttgattaacttgatgggatcttacagggaggaagttgattataccgtgctgtctaacctgataactataagtcttaaagttcaacgtattgcagctgatgcagtaccagacttactagaatatttcaagcagttctttattaaccttttccagtactctgctgagaggcttggttgggagcctaaaccaggagaaagtcatgtagatgcaatgttgagaggagaaattttgacagcccttgctatgtttggtcacaatttgacactggatgaagcaagcaagcgttttctggcattcttagaaaacagaaatacaccacttcttccacccgatataagaaaggcggcatatgtagctgtaatgcaacgggcaagcaaatctaacagatcggattatgaatcacttttgaaagtatatcgggaaactgacctaagccaggagaaaacacgtattctgggctctctggcatcttcacgtgatccagatctaattcttgaagctcttaacttcatgttgtcatctgaggttcgtagtcaggatgctgtttttggacttgctgttactcaggaaggacgaaatgtagcttgggcatggcttaaggaaaattgggaacacctcataaaaacatatggttcaggatttttgataactcggtttgtcagtgcagttgtctcaccgtttgcttcctttgagaaggccaaggaggtagaggaattctttgctagccacgctatgccattcattgctagaacgttaaggcagagccttgagcgggtcaatatcaatgcaaactgggttcagaatgttcagaacgaaaataggcttggtgatgctgtgaaggaattggcatacagaaaatactag

SEQ ID NO: 44158 - DNA, 261 bp, Glycine max
  Peptide Sequence Number=SeqID_135843
atgcagaaaagaccacttgaaggatcttctgccttgtactccgatgatgtcaccgtggcaaacagaaccagccccatgaaccaagcttttaagatccataaaaacaagcttttgataaacttggtgtcattcatttggactgaagtaggaggagctcggagaaacccagaaggtgaggaccagctggctacttcctgtagtgcgaatgttgtttttcatggaagcttgatttcagaatcttacatgcctaaatgtatttaa

SEQ ID NO: 44159 - DNA, 3141 bp, Glycine max
  Peptide Sequence Number=SeqID_135844
atggaacgtgcacggaggctagcaaacagggcgattctgaagaggctaatttctacggcgggggataattcccattcccttttaagacccaaaccagagaactcgatcttaggaagcaacagaaaactctcacactatgtcccatctcgatccatttccctggcagcactcaagccgagcgattcattccctcggcgccacaactccgccacctccgaggaacaaaccaagatggcccagacatgcggcttcgacaccctcgactccctcatcgacgccaccgtccccaaatcaatccgtctgagcgacatgtcgttcagcgtcttcaacgaggggctaacggagtccgaaatgatgtcgcacatgaacagcctagcgtcgaagaacaagtgcttcaagtcgtacatcgggatgggatactacaacacgcacgtgccgcccgtgatccttcgcaacatcatggagaaccccgcgtggtacactcagtatactccttaccaggccgagatatctcagggccgtctcgagtccctcatgaatttccaaaccgtgatctcagatctctccgctcttccaatgtccaacgcttcgttactcgacgaaggaactgcggccgctgaagcaatgtccatgtgtaacaacattcacaagggaaaaagaaagacttttatcattgccaataattgtcaccctcaaaccgttgatgtttgcgtcaccagagctgctggttttggtattaaggttgttaccgtggatgttaaggatgtggattataaatccggtgatgtttgtggggtgcttgttcagtatccggggactgagggtgaggttttggactacggggagtttgtgaaggaggctcatgcgtatggagtcaaggttgttatggcgacggatttgttggctctgactgtgctgaagcctccaggggaaatgggggtggatattgttgttgggtctgctcagaggtttggggttcccatggggtatgggggtccacacgccgcgttcctcgccacgtcgcaagagtataagaggatgatgcctgggaggatcattggggtaagtgttgattctggtggaaagccagctttgagaatggcaatgcaaactagggagcaacatatccggagggacaaggccaccagcaacatttgcactgctcagtctgttgggaatggacttgtccttgtgttaggtcattccgggaaccatgttttggtcttgtttgagttggcactgcttgcaaacatggctgctatgtatgctgtatatcatggacccgaaggacttaaaaccattgcccaacgggttcatggtcttgccggggtgtttgctcagggattaaaaaaacttggaaccgtggaagttcaggaccatccattctttgacactgtgaaaattaagactgccaatgcccatgcaattgctgatgctgctcgcaagaatgaaatcaatttgcgggttgttgatgggaacactatcactgttgccttcgatgaaacaaccaccttggaggatgttgataatcttttcaaagttttttctgatggcaagcctgtctccttcacagctgcatctcttgccccagaagttcagactgcagttccttctggacttactagaaacagtccttatctgacacaccctatctttaacacgtaccacactgagcatgaggttctcaggtacattcataggcttcaatcaaaagatctttcattgtgccacagtatgatcccgctgggatcttgtacaatgaagctgaatgctacaactgaaatgatgcctgtgacatggcctagctttgctaacattcacccttttgcaccaattgaacaggctcaaggttatcaggaaatgtttgaaaatttgggtaaactgttgtgtacaatcaccgggtttgactccttctctttgcaacctaatgctggtgctgctggagaatatgctggactgatggttattcgtgcatatcatttggcaagaggagaccaccatcgcaatgtctgcattatacccgtctcagcacatggtacaaatcctgccagtgctgctatgtgtgcaatgaaaattgtatctgttggaactgatgccaagggaaacatcaatattgaagagttgaggaaggctgctgaaacacataaggacaacctagctgctcttatggtaacatatccttcaacccatggtgtttatgaagaaggtattgatgagatatgcaaggttattcatgataacggaggtcaagtatatatggatggtgctaacatgaatgcacaggtgggacttacaagcccaggttggattggagcagatgtttgccatctgaatctccataagacattttgcatccctcatggaggaggtggccctggcatgggtcctattggagtaaagaaacacttggcaccatttttaccatcacatccagtggtttccactggtggcattcctgcccccggcaagtcacaaccacttggtaccatttctgctgcaccatggggctcagcactgatattgcctatctcatactcttacatagccatgatgggttctaaaggactcaccgaagcatcaaaaacagccattttgaatgcaaactatatggcaaaacgattggagaatcattaccctgttcttttccgtggggtcaatggaacagttgctcatgagttcattgttgacttaagaggctttaagaatactgctgggatagagcctgaagatgttgcaaagcgtcttatggactatggcttccatagtccgacaatgtcatttcctgtgcccggcacactcatgattgaaccaactgaaagtgaaagcaagtccgagttagacaggttttgtgatgctcttatttccattcgacaagaaattgctgagattgagaaaggaaaggctgacattaacaacaatgttctaaagtgtgctcctcatccaccaccagtgctcatgggagatgcatggacaaaaccatactctcgagaatatgcagccttcccagcttcctggctccgtgtttctaagttctggccttccacaggacgtattgataatgtgtacggtgatcgcaacctcgtttgcacacttctcccaacatcacaggctgttgaagaacaagctgctgcaacggcctaa

SEQ ID NO: 44160 - DNA, 398 bp, Glycine max
  Peptide Sequence Number=SeqID_135845
ggatcgcactcgcaagacactcaatggacccggagaagtccaacagggtcttggggtttccagctctgattacgggactctgtcaattctacggagtgcccatcgcccccagcaaggtcatcaggcctcctactaaccgagctttcatcaagaagtactgcgcccttatgcaggcacagggcgagacaccacagcagccaggggatggccggcagcaggcaacagacaaacagccgccacctccagagcccctcagctcatctacaacggctggagcgttgcctatgacccgtggccgaccagtaggcgaccaagtccaaagccaaaggaaagcaaaagtacccgtgaccaacaagtcatcacgcgttcggctcaagatattaaagaagcgctactag

SEQ ID NO: 44161 - DNA, 819 bp, Glycine max
  Peptide Sequence Number=SeqID_135846
atgggaatcgcaaatcattgccagtaccaagagtactgttcagtcacggttgttgtagttgcctctgacttagagagagaaaatggctttgatatggaagagaatgcttcctccaccgaagctctcaccagaaagctggacgagattctgaccgagacggagaatgatgccggacaattctgtttcaaagaagaaacggtagaaaagttcatgcaagagctttacaaagagatcatcgcatccccaccaacgccgtcaaatgcggtgcaggtgcaaaatgactctgtggggcttcaagttgttatcggtgaagacaagacagatgaagggcatttcgacgaggatgactggcttgcaagggtgcttcgttggggtcagacactttgcgacctgatttggattgttcctgtacaaacaagtgcagtttgtgatatgttgaaacttgtgaagaagtataaggatgcagagcatgttatatgtttccttaaaagtcttggagattcatataacattgctaagacacaaatcttgttaatggagccattgccttctattgaccatgttttttgtcttgttcttcaacaagagaggcaattgaatggtactattcttggagggcctgaggtgcttctgaattcaaccattacaggaagaaacattagatggaagcaatcacaagggcaaggaactatcaaatggcagaggcaaagacaagtagctggatctgtgtcagaacagcagaatagggaggatgaattcggccacagattgcagtgtcatttagccgaatacgtgcgtaacactaaccatggtccatga

SEQ ID NO: 44162 - DNA, 1317 bp, Glycine max
  Peptide Sequence Number=SeqID_135847
atggagtcagcgaccaaaaatcaagtcttcttctgcttctttctatgtcttctcttagtctcagcctcttcattatctgcttcaaaatcaacccatacattccccaaaaaagccctcccaacaaagcatggtcaccttccaatcagccccacttcaacttcttccattttctatgctttctatgaagcacagaactccactttaccactctcccgtaccccacttctcatatggctccaaggtggccctggttgctcctccatgattggaaacttttacgaacttggaccatggcgtgtcaccgaatcactcacccttcaacgcaaccatggtgcttggaatagaatttttagccttcttttccttgatagtcccattggaactggctttagtgtggcctcaacgagacaagaaattccaactgatcaaaaccatgttgcaaagcatctttttgctgctataaccaggtttgttcaacttgaccctctttttaagcatcgccctatttatattactggtgaaagctatggtgggaagtatgtgcctgcaatagggtatcacatactgaagaaaaatgcacagttgcatgtttctcaaagagtgaatttggctggtgtggctattggggatggtttaactgaccccgaaactcaagtggttactcatgctttgaatgcttattatgttggattgatcaatgagaagcaaaagaatgagctggagaaagctcaattggaagcagttagattggcccagatggggaattggagtgaagcaacagatgccagaaacaatgtcatgaatatgttgcgaaacatgacagggttggctactttgtatgactatacaaagaaagctcgttatcaggattatttggttgagaaattcttgaacattgcaaaggtgaagaaagctttgggggtgaatgaatcgtttgtgtatgagttatgcagtgatgttgtggaggctgcattacatgctgatgtgatgaaaagtgtgaaatatatggtggaatacttggtgaggaggagcaaagtgctgttatatcaaggtcagaatgatttgagggctggtgtggtccaatcagaggtttgggtgaagacaatgaaatgggaagggattgtggagtttgtgaatgctgaaaggaagatatggaaggttaatggagagcttgccgggtatgttcaaaactggaagtctctaaccaatgttgttgttttgggtgctgggcatattttgcctgctgatcaggttgttaggtctcaagcaatgatagaagattgggttttggagaggggtttgtttaaaagcgtgtag

SEQ ID NO: 44163 - DNA, 324 bp, Glycine max
  misc_feature (11)..(11): n is a, c, g, or t
  misc_feature (29)..(29): n is a, c, g, or t
  Peptide Sequence Number=SeqID_135848
acacttgttancactgccacacctcttgngcatgagtttattcctcaagtaaaggaggtgttggatgagggtttggtttgcaagagcttaaattcttgtgctttattggtgcctaaaataggggttcccatgaaccctaagagaataaaggtcattcctgagtggcccactccaccaagtataagaaaaatttggggcttccatgacttaacccggagtggaaatgggtcgttccgttctcaatgcaaaatccaaatccatatagccaagaacaatttctacggttttcttccggaccttaaaatttgtttcattcaacattag

SEQ ID NO: 44164 - DNA, 291 bp, Glycine max
  Peptide Sequence Number=SeqID_135849
atggagtgcgagtacctgaagaggtggtttggttccctcacagagcagaaccggaggctgcagagggaagtggaagagctacgagccatgaaggtgggcccacccaccgtgatctcccctcactcctgcgagccgctccctgcctccacactttccatgtgtccccgctgcgagcgtgtcacctccaccgccgacaaaccgccctccgccgccgccgccgccgccgccgccgccactttgtcccctaaagtgccgccaacgcaatcccgtcaaccctccgctgcctgttga

SEQ ID NO: 44165 - DNA, 204 bp, Glycine max
  Peptide Sequence Number=SeqID_135850
atgtccaagttagggccaataggtttcactaatccattaaagaagaagaaggttgaaggttgtgcaaagatagggttgagaaagggtgagataatgtgggagacaaaggctgaatgtcaaactggaaatgaccaagatgcgatgcgacacaagggtttgcttttctctgcatctctgcaaagcgctcaaaagcaacattattga

SEQ ID NO: 44166 - DNA, 168 bp, Glycine max
  Peptide Sequence Number=SeqID_135851
atggccatatatgggtatggggcagctgctcatgaaaagagtaaagtcacaaacatatatagaatcctagagtgtaagtttggagttttgagggtggaaacttggaatctaaataatgctctcaccggacagtcagaaggatacaacagaacagaagcttgtaaataa

SEQ ID NO: 44167 - DNA, 801 bp, Glycine max
  Peptide Sequence Number=SeqID_135852
atgtcgttcgaaaagaccctagccgttgtcggccaaacaaattctagccggcgttgtattaacaacaacaaaaatgttagtaaaggtagtagtgatgatgataacagtgatgatgttcatgacaacattggtagcggagtcaatgttgttggtggtagtagtagcaacgacaacaccaataatgatgacaacaacattgtggtagtggtggtggaagtgcaggtggagtgcaatgatattagtactagtgatgataatggtggtgatagtgacgatgacgacaatgataatgatggtggtggcgacaatgtgctagtagtggtggcaatgctagtagaggtagtaacaatgttgatggacaaagcaggctggagatcttggcccatcagcccactatgtcccgtgtcacctaacccaccaacttattgggctaaaggcaaggtggggcggagtttttgtttcttttatgggcgggtcagtccgctagcccgtcagctcaccttcaggtggtggcgacaatataatgatggtgatgacaataatgtgctagtattagtggtgatgctggtggaggtagtaacaatgttggtggtagatgtagcaacaatggtgatgatgatgcatgtggaagtagtagtggcgatagtagtagtggcgaaggcattggctataatgacgatgatagtggtgacggttaccatgttgtgtcaacgatgggggtggccatgttgtgttggtgacgatggtgcttgtggtggtggtgatgctggtgttggattttttttaataagcatatgttag

SEQ ID NO: 44168 - DNA, 330 bp, Glycine max
  Peptide Sequence Number=SeqID_135853
atgttttggtccaagcctgaactcgtttgtcaggttcgaggactctggtttcaagatctgggggatgtgagatttgggtttgggaatgtgagcttgattaaggggaaatctagaagcttttgtgaaaggaagtgtttgagggattgtgggtgtggtggcttgagttttgacgaagggagtggggtgtgcaggaatttttatgggttgctttcggattttgataggaaggtggtgaaaaagaagaggggtggtggaaaaaatgggttggaggaggaggaagatgagtttgtgcttgtgttgaatttgaaggatgtggtaagaagtttttaa

SEQ ID NO: 44169 - DNA, 351 bp, Glycine max
  Peptide Sequence Number=SeqID_135854
atggtcggtaaagctggtggtgacaaatggaaatcgctgtctgatgctgaaaaggcccccttcgttgctacggccgaaaagaagaaacaagagtatgagaaaactattttggcttacaataagaaattggaggggaagaattcagaggaagacgagtctgacaagtcaaagtctgaagtcaatgacgatgaggaagatgagagagagagagagatagagagaattcaaccgcattggaaggctatgctaggcgaacttggagaaactcagatatcagtctatagaagcacaccaaagtcaacactctccaagaatcctgtgctaaattaccaatccatttcaaatacttag

SEQ ID NO: 44170 - DNA, 663 bp, Glycine max
  Peptide Sequence Number=SeqID_135855
atggctcgtggcttccaagttcgagctacttcagttaccatatttgctcatttgttgttcatagcaatagcaacccttgtgttagtttggttgctacactttcgagaaggtgtggccttcttcagctcttccaacccagtcaagattttcaacctgcatcctcttctaatggtaattggatttattttagttggtggagaagcaatcatgatatacaagtcggtgcctgaaaaaaggaggtcagtgaaggtggttcacctcctattgcatctgatagctttagtggctggaattatagggattattgcagttttcaaatctaagaaagaggcaggtcttgctgatatgtatacattacactcttggctaggcatgtcagcaatctcactatttggcttacagtatatatttgggttctttgcttatttcttccccggtgcagaaatgtctgctagagcttcccttttgccatggcacaggtttatgggcatggccatattcctccttgcagttgccacagctgagacgggtttggttgaatatttccagtttttacagcttttccgcactcaagaggcactaattatcaactccactggtctcttactcttcctctttgccgtctttgttaccctctctgtcattctccaaagaaattactga

SEQ ID NO: 44171 - DNA, 1014 bp, Glycine max
  Peptide Sequence Number=SeqID_135856
atggggtggttcctcttctgttgttgttcttcttctctccttttttttgttgcttcttcttcttctgtgtcacccagaagaaacttgcccatcatagcctttgaggatggctacacacccttgtttggtgaccataatttggccatccatagagatggcaaatcagttcacctttcacttgatgaaagaacaggttctggatttgtgtctcatgacctttaccttcacgggtatttcagtgcctcgatcaagttgcctgccgattacactgctggagttgtggtcgcattttatatgtcaaatggtgacatgttccagaacaaccatgatgagatagactttgagtttttggggaacattagaggcaaagactggaggattcagaccaatgtttatggcaatggaagcaccagcattggtagagaggaaagatatggcttatggtttgatcctgctgaggatttccatcagtacagtattctttggacagattctaagatcatattttatgtggatgatgttcctattagggaagttaagagaacagaatctatgggaggagatttcccttcaaagccaatgacattgtatgccaccatatgggatgcttcagattgggcaaccaatggaggcaaatatagagtaaattacaagtatgcaccctatgttgctgagttctctgacctggtcctgcatggttgtgcagttgatcccattgagcatgtggccaagtgtgacagtgccctaggttctgaagaagttccctctggtgtcacccaagtacaaataaccaaaatgagaaacttcaggttgaggcacatgacatattcttactgctatgacactgttagatacaaagtccctccaccggagtgtgtcatcagccaccaagaagctgaaaggcttagaaaatttgatcccataacgttcggcaatggccggcgccaccgtggtaaacgacaccaccatagtagtagaggaagccaagaagagattactgcttcttcattttaa

SEQ ID NO: 44172 - DNA, 942 bp, Glycine max
  Peptide Sequence Number=SeqID_135857
atgacaatgaagaagaagaagaagaaggaattgacggacaattgcgaaagaaatgaaatgaaagaaccaacctgggcagagattacaggtgaagctgtcatggttgtcaataacagcaatggggttgttgttggacttgttgttagccaaaatgccctcaacggaattcaaggtggcctttgccacaaacccaatcacccttttggccacagaacccccacctgcaatcaaaatccaaaatttgcaacaaaaggggataattacagtggtgagattgttggagaagtaacagaggtgggaagcaaagtagaccagttcaaggttggagacaaggtggctgtgggatgcttggttgggtcttgcaaatcatgccaaaattgtgtcaacaatgttgagaattattgccaactaaatattcccacttatgatgccaagtatgtggatggcgccatcacatatggggggttctctgacttcatggttgcagatgaacactttgttgtcagcattccaagtgacctacctcttgatattgctgctcctctcctttgtgcagggatcacagtgtatggtcctttgagatatttagggcttcacaaacctgacatgcatttgggtgtggttggccttggtggactaggccatctagctgtcaagtttgcaaaagcccttggcttgaaggtcactgtcatcagtacctctcctaataagaagaaagaagccatacaaaatcttggagctgattcctttgtggtcagtagagaccaagatcaaatgcaggctgcaatgtgcaccttggatggtataattggtactgtttcagcagtccatcctctcatgcccttgattgatatgttgaagtgtcatgggaaacttgtaatggttgggacacctgagaagcctctagagttgctactcccgtctttaattatggccgggtaa

SEQ ID NO: 44173 - DNA, 561 bp, Glycine max
  Peptide Sequence Number=SeqID_135858
atgagttacaatctgaggatcaatgattgtatctgtgtggactttacagttttatggttatttcttctgggcttggataagtatggaaaaggcgactggcgaagcatatcaaggaactttgtggtgacacgaactcctacacaagtagcaagccatgcccaaaaatacttcattcgtttgaactcaatgaacaaagatagaaggcgatccagcatacatgatatcaccagtgttaacaatggagatatttcagcacctcaagggccaataaccggtcaaacaaacggttctgctggaaattttactgccaaagcagccaaagcggccaccccggcctcaactggggtgccaggtgttggaatttatgcagctccaaccattggacaacctataggaggacccttagtatctgctgttggcaccacagtgaaccttcctgcacctgcacacatggcatatggggtccgagccccagtacccggtgcagttgtacctggtgcaccggtaaatatgggccctgtgacgtaccctatgcagcatacgtctgttcctcacaggtga

SEQ ID NO: 44174 - DNA, 555 bp, Glycine max
  Peptide Sequence Number=SeqID_135859
atgtcacgtcgcccccacgcagcgccgccgccgccgccgcggtcactccacaagcaacagtcgtggtcgccggacatgctccgcgacgaggcgtggcagcggcggaaggacaacaaccaccccgtgaaccgccgccagcaccggctgagcaagagcctctcggaggacgacttggacgaactgaaggcgtgcttcgagctcgggttcgggttcgattcgcccgaaatcgacccgaaactgtcgaacacaatccccgctttggagttgtaccatgccgttaacaaacagtacaaccaccacagcttgtctaggtcatcttcttcgtcttcccttgtctccgacagcgacactactagccccaccactattttcaatccaggggatgatttggctgcgaagaagactcgtttgaagcaatgggcacaggtggttgcttgttcggtgtgggaatcttcttcatcttcgtgttcaaacccttccgaccaaatattcacgcaagtcactaacctattaatcggttgcgttaaaaacaagagaaaggaaaatacaaaatag

SEQ ID NO: 44175 - DNA, 648 bp, Glycine max
  Peptide Sequence Number=SeqID_135860
atggacaccacattacttcattcactcagcatagctacctataatcaactgcataagtcaatactcaacaaattcttacctgatcctgccaatgaacgccaattgtcaacaacaacgtcaaagcaaagtagaatatattcgattataaacaagcttggaaggaaggctgataacttttcgcaagaagtacgagaacatgtgagactggggccaacgataactgagacagttatggggaagttgagactaggggctagaattcttcaagttggtggtgtgaagagagtcttcaaccaattcttcacagtgagacaaggggagaaactgttgaaatcttcacagtgctatctatcaaccacatcaggccctttagcagggctcctcttcatttccacagacaaggttaccttttgcagtgagagatcaatgaaagtcttctctagtaaaggcgaaatgtgcagaatccgttataaggtttcaattcccctgaagaggattaagtacgtgaaccaaagtagaaatgttgagaagccaacacagaagtatatagagatagtcacagaagacaattttgagttttggtttatgggattcttaaaatatcagaaaactttcaattatcttgagcttgcaatttctcaagcttag

SEQ ID NO: 44176 - DNA, 150 bp, Glycine max
  Peptide Sequence Number=SeqID_135861
atggcaaaatgttgcaaagagctgtattctacggcgcacaaagaagctaagttgtcctcttcatcccatcccatccctcgacggcaccaaccaaggaaaccgaagacagttgcagcaaggaatcgtctcagctctaatggaactcagtga

SEQ ID NO: 44177 - DNA, 1980 bp, Glycine max
  Peptide Sequence Number=SeqID_135862
atgccagaggtttatactgtgaaggttgaagagggaaggcttgcaactgatggaaagccatcagtgggtcctgtctataggagcatttatgctaaagatggtctcttggaggttccttctgattttaagtccccttgggatttcttcagaaagtacacgtcacttatcagaagttttaatgcttcgtttggcagggactctgttaagaggaaccccaacaacaatatgttgggtaggcgtcaaaaaaccgaatctaagttgggttcctatacatggctcacgtatcaagatgtttatgatgctgccatgaaaatgggttcggccataaggagccgtggtgtcaatcctggagatcgttgtggcatatatgggtccaactgccctgaatggatcattgcaatggaggcttgcaatagctgtgcagtgtcatatgttccattatatgacacccttgaatctgtggacacaaattggagcatatatcatcagctaggaaatgactttgacttgggtttataccttccaggtcctaatgcagtggagtttatcataaaccatgctgaagtttcaattgcatttgtacaggagaaaaagattccatcagttttgtcatgtcttgcacagtgttcttcaaatcttaaaactattgtgagctttggaagtgtttctaccacacaaaagaaagaagctgaggggcatggcgcgtcctgcttctcatggggagagtttctccagctgggatgtctggattgggatctaccatcaaaaaagaagactgacatttgcacaataatgtacacaagtggaacaactggagatcccaaaggtgtcgttattaagaatgaggctttcatggctgaagtgttgtctgttgaccacataattatgttaacagacagagtggcaggagaagacgatgtgtacttttcctttcttcctcttgctcatgtatatgaccaaataatggagacgtattgcatctccaagggctcatcaataggattttggcaaggcgatgtcaggttcttgctggaagatattcaggaactgaaaccaactatattttgtggagttcctagagtttttgaccgtatttatgcaggtatcaaaagcaaagtatcttctgcaggaccactgcagagtacattgtttcagtgcgcttacaactacaagttaaaatatctggagaagggtcttccgcaacacaaagcagcacctctgtttgataggcttgtgtttgataagacaaaactagctctaggtggacgtgttcgcatcctgttatccggagctgctcctttgcctaggcatgtggaagagtttatgagggtcactagtggatctacattatcacaaggatatggtcttactgaaagttgtgccgggtgtttcacggcgataggtgatgtgtattctatgacaggaactgttggagttcccatgacaaccattgaagccaggcttgaatctgtgccagagatgggatatgatgccctctccaatgtaccccgtggagaaatttgtctgagaggaaataccttgttctccggttatcacaagcgtgaagatcttaccaaagaagttatggttgatggctggtttcatacaggtgacattggagaatggcaatcaaatggggccatgaaaattattgatcggaagaagaatatctttaaattgtctcaaggagaatatattgctgtggagaatattgaaaacaagtatttgcaatgccctcttatagcatcgatttgggtgtatggaaacagctttgagtcattcttggtggctgttgtggtccctgaaagaaaagccattgaggattgggcaaaagagcacaatttgactgatgattttaaatctttatgtgataatcttaaagcaagaaaacacattttggatgagctcaacagcactggtcagaaacaccaagatcatattgatcaactatacaaggaagcaaagggagcaatggtgtaa

SEQ ID NO: 44178 - DNA, 1413 bp, Glycine max
  Peptide Sequence Number=SeqID_135863
atgcacgctcacacgcaaagacctcccttcccttccaaggggttaacaacctctttcaggttcacccttaagacccttctattcctctgcttctgtttcttccatttgccactctcaacttcatcagaaccaacccattcattccccaaagaagccttccccgccaaacatggttaccttccaatcagccccacttccacttcttcaattttctacgctttctatgaagcccaaaactcaactttacctctttcccaagccacacttctcatatggctccaaggtggccctggctgctcctccatgattggaaacttgtacgaacttggaccctggcgtgtcactgaatcactcaccattcaacccaaccctggcacttggaatagaatctttggtcttctttttcatgatagtcccattggaactggcttcagtgtggcctcaaccccacaagagatcccaaaggatcaaaacaccgttgcaaaacatctttttgctgctacaacaagctttcttcagcttgatcctgttttcaagaatagccctatttatattactggtgaaagctatgctgggaagtatgtgcctgctattgggtattacatattggagaaaaatgcaaacttgaaggtttctgaaagagtgaatttggctggtgtggctattggggatggtttaactgaccctgaaactcaagtggctactcatgctctgaatgcttattatgttggattgatcaatgagaggcaaaagcatgagttgactcaaatgaggaattggagtgaagcaactgatgcaagaaacaaagtcttgagaatgttgcaaaacatgacagggttggctactttgtatgactatacaacgaaggtgaagaaggccttgggggtgaatgaattgtttgtgtatgagatatgcagcgatattgttggggctacattgcatgctgatgtgatgaagagtgtgaaatatatggtggattacttgacaatgaaatgggaagggattgtggagtttctgaatgctgaaaggaagatatggaaggttaatggagagcttgcaggctgggcatctttgcctgctgatcagcatgttaattctctagcaatgatagaagattgggttttggagagggctattcttcttggcattaagcttgcttggtcgagagggtataggaggattagagtagattcggactctcctgtggctattaatctggtgacaaaaggttgttgcatgcttcacccttatttcaaccatgtaaaggagattcatgcagtccattcctatgagggtgatgttacttggagccatattcttcgagaagctaatcaagttgcgaagcaagttgttatagctttggttccgtttcaagtttttaatttccccctaggtgtactgtcaatgtgttga

SEQ ID NO: 44179 - DNA, 978 bp, Glycine max
  Peptide Sequence Number=SeqID_135864
atggggacacaaaagtctaatatgtttgatgcacctttcaaatacatggtgcctgaagataaggaaattcccgacagacctttgccatcacattggactccttctatgcaggcatataacacttctgggtctactccaactccctttttaaatcaacaggcagctggttctcacatgcctctctacatgtgggtaaatcaggtaaacaacacactacttcaatccgatgctttgcatgatccaaggatgctctccagtaaacccacagtagctggggatgctgtactggctttttcagaaatagtacacaggacttttggcgaacaaaacctgaattcaataaaaaaatgtgccagaaacttgcaaccaaaaagtttaataactaaggaatcaacagaaaatggaagcaaatcttcaataatgaaaaccaatagggatggagtgttgtgcagtgaagcaaatggaaacaagggatcaccagatgaagatcacattactaatgattttccttcaactaagaagcagcactgtaatttgatgcttgaaaatggtgatgtgggacaaaacacatcccctcatacccagcacaataaaggtgctggaggctgcaatgaagacagcccaaagagactgcaactaaggcaattttccaatactaacaatcttccatctcaccactctgcagcaagttcaaccaaactgaatcaggatttggagacaggcctagatgcatctgacgctaatgctcaacttgtaaatttggaaaaggatgaaataagaagagaaagaaaaagacagtcaaacagggaatcggcgaggagatcaaggatgcggaaagagaaagaatgtgaagagctacataaacaaatggaaatgcttaaggatgaaaactccgtgctcacacagaggctcaagagtctttctgaggagtgcctggagatctgcaatgaaaacgatgccatcgaggtccgtcattaa

SEQ ID NO: 44180 - DNA, 639 bp, Glycine max
  Peptide Sequence Number=SeqID_135865
atggatccaatctcaatcaaactggatgatgacaattactcagcatggaaggctgaagccttaggaaaaatcaaagaaagcagccttgagaagttcatcacaatgaaggactttggaggtcagccacccatgttgagtgaagaatacaaaagctggatagagcaggatcaggttctttatacgtggcttcttgattccttgcatccaaagcttcttcaccgaatcgaaagatgtgaatgtgctttggaattctggaaggttatagaggtcgaaacattggtgctagaaggacggcctagaccactcttgccccttagcctcgactggggtgcttgttccggcaaccgcaaagtcccacatcacttaagagtcgaggagggtctagagtcactcttggctgactctagccctagccttgactgggtggcttgttccggtagccgcaaactagaaattgaagagatacgtcaacaatataaacgtaatttggaagaaactgccatggtccaactgatgcgcatgaatcttgatgcggagtgtccagagactagcaatgaagacatggccatagaggaagagcttggaccagaatccgcagcagcagatatattattgtccctgaagcctggcacctcttag

SEQ ID NO: 44181 - DNA, 4506 bp, Glycine max
  Peptide Sequence Number=SeqID_135866
atgacggaggagcaggtggtgaatgtgcgcggcgaagtaagcgattccgtcaccgatcaccgcagcgtcaaggccaatggagttgctcacggtgtcggtggcgatttggatcttgccgccgacaacaacggtgctgcgttgtcggagaaaatttgtaaagatgcagtgtctaacggtacggcagaggaagtttccgaaacggcgatggttaatgtcgtttcgcgggatgatgaattaaaatgtgcggatggtcaaaacgacacgggatccgttcaaaacggcgtcgtggagaatgatgataagagtgctaatgctgttgcggaggagttggttacggatcacgatgaatacgttgtcgtcggtgattcggatgttcagaacggtgatgatgtgaatgcgaacgctaacggagttgaggaatgcgaaatgctggatggtgcggagggttcgggagatgaaaacggtgtcgttgtgagtgctgtggagggagatgctgatgtgaatcacagtgatcgcgaattcgaatgtgttgatgttcacaatgatgtcgcggtggaaacagttgaggaagaagtaactgctactactgatcagaacgttggaaatggaaatgacgttcagggaagaagtgagtctgtatctgatgaagatgtggataaaagtggggaaagtgtaaatgtcgttagtgcagatgttttggatgagaaggacattgtaactgatggtgatcatgatgcggaagaagttcttgagaagaatgagattcttgttgatgctgatggtgtctctgccactacagatttgaagcaatgtgaacctgaagatgctcgaaacagttcagagaaggggcaggttgagtctgtctcaggtttggcaaagccggagccaagtgaatgcactgaggagaatgagatagctgttgaaggtgaaccaggcagtaagttggaaaggtccgaggaggaagcaggaagtgaaatagttcctcaaggagaaaatttaacagccttaaacagcacagatgtgactggggatggtgatgttgtgtctgacattgcagtggagagcaaagatgaaccttctgttgatgtttgtgagttgaaaagcattgcagttgaaaatgatgttgatgtgcaagagttgaaaaatggtgcagtgcagagtgaaattgtgtctgagatgaaaaacaatacagaggagagtgtagctgaaccttcaaatggtgcagttgagagtgaagctgaaccttcaaatggtgctgtagaaagtgaagctgacccttctaatggtgcagttgagtgggaaactgaacattcaaatggtgcagttgagagggaaactgaacattcaaatggtgcagttgagagtgtagctgaaccttcaaatggtgctgttgagagtgtagccgaaccttcaaacagtgcagttgatcgtgaagatgaaccttcaaatggtgcagttgataaggaagctgagccttcaaatggtgcagttgataaggaagctgagccttcaaatggtgcagttgataaggaagctgaaccttcaaatggtacagttgagagggaagctgaaccttcaaatggtgcagtgcagagtgaagctgaaccttcaaatggtgcagtggggagtgtagctgagccttcaaatggtgcagtggggagtgtagctgaaccttcaaatgttgcagtcgagagtgaaactgacccttctaatggtgcactagagagtgaaactgacccttctaatggtgcagtagagagtgaagctgaaccttcaaatggtgcagttgagagtgtagctgaactttcaaatggtgcaattgagagtgtagccaaactttcaaacagtgcagttgatagtgaagctgaaccttcaaacggtgcagttgatagtgaagctgagccttcaaatggtgctgttgataaggaagctgagccttcaaagggtacagtggagagtgaagctggaccttcaaatggtgcagtggagagtgaagctgaaccttcaaatggtgcagtggagagtgaagccgaaccttcaaatggtgcagtgcggtgtgtagctgaaccttcaaatggtgcagtggagagtgaagctgaaccttcaaatggtgcagtggcgagagaagctaaaccttcaaatggtgcagtggagagtgaagctgaaccttcacaaggtgcagtagatagtgaagctgaaccttcaaatggtgcagtggagagtgaagttaaaccttcacaaggtgcagtggagagcgaagctgagccttcacaagatgcagtggagagtgaagctgaactttcaaatggtgcagtgaaccgtgaagctgaaacagcaagtggtgcagtggagagtgaagctaaaacttcaagtggtgcagtggagactgaagttaaaccttcacatggtgtagttgagagtgaagctaaaccttcaaatggtgtagctgagagtgaaagtgaaccttctgttgatgtgtgtgagacgaaaaacgatgtagtgaatagtgaagctgaaacttcaagtggtgccctgcagagtgaaagagaggcttgtgttgtgtctgagatgaaaaacaatgcagtggagagtgaagctcaaccttccgttgatgtgtctgagaagaaaactaatgcagttgacagtgaagctgaactttcagttaaaggtgggctttctgttgaaagtgaaggtagtaatcaaggagatgaagattcaagacctgcctcagatgctttggatggacagaatgtgggtacagaggtagtgaaaaagccattctactatttgatcagggttcccagatatgatgatgatgaaaacataaaagagaagataaaaaacgctcttcaccaagtagaggagaagactaaaattcgagatgctattcgaatcgaaagccagactataaaggccagttgtaaggatttcgaccaagagtttagggctgcaatagcagcccatagagctgctcgtgacttgctcaaatccaaacgccaggaaatagattcagtccaatccacaatgaacagattaaacaatgcaatttctgttggggatatagatgacaagataagaagcatggaacacatgatccagcatgaaactttgcctctaaataaagaaaagcaattgatacgcgagatcaaacaattgaagcagaaccgtgaggagttgtcttctaatatgaaaaagcaggatcaatcacaacaatctgtagacaacaaggatgacaatattgaagagcactttaagcatttacagcttttgaagaaggaaatggaagtgcttagaaataatgttctgaagtcagatacagaaactaaagccgcaaagaagaaatataatgatgaatgtgataaactgaatgagttgctagctcgatttagggccgctgatgattctcgtcaagaggcatatgctaagttactggctttgaaaaaacaattgcatgagaagagcaaaaatttctgggaatacagagatgctgcaaataaagcacaggaactagcagcgggaggaaaaaaagaggagctgcaatgcttctgtgttgatcaggttgagagaattatggagctatggaacaaaaatgatgggttcagaagggactacgtccgatgcaacactaggagtacgctgaggagactgcaaaccctggatggccgatcacttggtcctgatgaagagccccctgtaattcctaatgtaataactgaaagagcttccaaaaatattcccatggtcttgcagtcaactctggaacaagaaaagaaatcgacaccaacagaatctgttaatgtaaaggatgaacctgtttcgaaggttgtggtacaaagaactgaaacgagtcagacaactaaagctaagaagcctaccaaacctgctcccttagagaagcatgtggctcgttggggtgatgagtctgatgaagatgaagttaaaaaagaagaacctgtgagaacaaaggaggaagaggagttgatactgaaggctgagaaggcaaggatggaggaagaggaggcaaagttgaaggaaaagcggaggctagaggagattgagaaagctaaggaggccctgctgaggaaaaagcgtaatgcagagaaggcccaacaaagggctgccttaaaggcacaaaaagaagccgaactgaaagagaaggaaagggagaagagagcaaagaagaaggaaagaagaaaggcaggttctgctgtcactgcagagaatacagaacaagaatctgctcctatcccagaaactctaacaagaagcgtggaagagtttgaacagactgagaaaacagctgaggtaacaaaaaagccacagaaaacatctcaattcacgaggcagaccaaggtaaaatctgtacccgcagctcttcgcaaccggggtaagaggcgaattcaaccatgggtatgtgttctaattgcgcttgtcgttgctgttgccttgttttatgttggccataactgctctttgagatcttcgctcgaaggctttggttactga

SEQ ID NO: 44182 - DNA, 364 bp, Glycine max
  Peptide Sequence Number=SeqID_135867
aatcaaatgctatggtgttaaagaacccatatctgcacaaggagaaaactacgaccagaaccgccaattttgctctccatgccccccacccaaaacatcctcactattgtgctcaacaacatcggtgttgtccttagcgactactcgtcattggctcctccgctcatcaacatcaaacttccttagagttctcctggtgtcgctcacgcacttcatcgccatggttgttagcatcatgaattaccaccgttgcgcacttcatctctctgctcccttcaccatcgctgaagaggaagaggaagaaaccccactccaaacccttttcgggtttggatttgaagcatgcgggaaaaaaacgggttga

SEQ ID NO: 44183 - DNA, 399 bp, Glycine max
  Peptide Sequence Number=SeqID_135868
atgaaagaggggtgttttgggaaagagaagagaggacgaggaaggtggaagttaggtggcattgggaggtgggagcggcggcggcgacggaatgtaacaagtaagcgaggtcgtcggagctcggctcaggttatagttgaaactacatcgtttcaatttgaaaccattttaattttagaaattaccatatccttcctctcgcggtctcgctctacgcctccacttcgctcaccaacctctccttctttcctcttgctcacaatctcactctcagtctctcatagcctcaccttctacaccgtcgctcgccaacgaccgacctatctatccttccttcctctagtcatggcattgtgctactgccaccttctatgttgtcacttgcagtctcggtcttaa

SEQ ID NO: 44184 - DNA, 1078 bp, Glycine max
  Peptide Sequence Number=SeqID_135869
atgatcggcgccaacctgcagcaggcgctggaggccgccggctggtcggtggactgggtgcgtgacggcgtatttgccagcaacgcctggcaggaaggcggttacacctgcgtcctgctcgatctcggtttaccgcgtgaagatggcatcaatgtgctgcgccgtgcacgcacgcgcggtgacatgacgccggtgctggtgctgaccgcacgtgataccgtgcagcagcgcatccaggggctggacagtggcgccgatgactacttactcaaaccctttgatctgcaagaggttctggcgcgtatgcgagccatcacccgacgccgccacggtgcggcggactccctgctgggcaacggcgacgtgcagctcgatatgatgacgcgtgaagtgctgtacaaaggccagcgcgagcagctaaccgcacgtgaatacgccctgctctatgcgctgctggaacgcccaggggcgatcctgtcgcgtgagcagttagaaaaccgcatctacggctggggcgaagaggtcaccagcaacgccgtggacgtgctgattcacggcatgcggcgcaaactcgataacgaagtgattcgcaacatcctttacgtttatgcggtcgctgcgcaacaaactgctggccacgctggtgctgctgcatctggcgatgatcggcggtgtcacctggacgaccagctcgccaaaattgccgatgcctggtcaagcagccagcgcatgccggcactgatgccgatggtgatgcagcaggagaagctgaaaagtgctgcacaacgtcggctacatgaagagcctgatggtgaaacgcgtactctccgccatcattccgctcatcctgatgatgccgctgtcgctgctggtgatctggctggtggtgcgggccattacgcgcgatctgcgcgtggcctcgcgccagattgcggcgcaggaaaccctgcatccgcacagcgtgtcgccggacggtctgccggacgaagtgctgccgctgctggaagcgggcgtcacgcgcacgcgccatctggtgacgcagttgctgaatatctcacgacaggaggatcagtccgtg

SEQ ID NO: 44185 - DNA, 3018 bp, Glycine max
  Peptide Sequence Number=SeqID_135870
atggaaaacaattcataccatccttatgtcactgagcgtgtctgtcgcttcgacggcacacctatcggcgcatgttattcagcgtccttaatgcattgcgtgccggagcgtgatgcattacttcatgaaggcgagataattacccaacattatcagtcagcggatgctgcgggattaataattattccactggcgggaaatagtgtgatgtcctttttgcatgacgtggataattattccagcctgcaacatgagaatgtaaggctggcgatcaactatgccactttacgtcaggcaggatccgccttacgcgctgtggcgtctcgtttttccttctggctttacgatctcgcgccgccgggaaccgagtggaaaaatatcaccgattttcccttcagcggtattgttctgagcgatgacttcttccgcgaaaattatctcaagttcagctttccttttctgctcgcttcgctgcgggaaacacaagcagaggtcaatattatggggaaagcttcctcatcttttggcgtaattcgcttcctgacggtgctgtttgcactgctgacgggcgcatttatgctgattggcggcgtttggttagccgccattggaggttcctggtactacgttattggcggtgtgattatgctgatcaccgctgttctgctgtggcgccgtagcggttccgcactgctgctgtatgccctgttgctgctggcaacgcttgtatggggcgtatgggaagtcggcttcgacttctgggcgctggccccacgtaccgacgtgctggtgatcttcggtatctggctgattctgccgtttgtgtatcgcggcctgaatcatgcgggtaaaggtgcgctgggtgcgatggccgttgcgctggtagccagcgtactggtgctggcgtgggcagtattccacgatccgcaggagctgaatggcaacctgccggaagccgctaacgtcccgcaggcccagccgctgagtaacatcaacgatgctgactggccagcctacgcgcgtgaccagcagggcacccgcttctcgccgctgaagcagatcaacaccagcaacgtgaaagagttgcaggttgcctggcagttccagaccggcgatctcaaaaccgccaacgatccgggtgaaatcactgacgaagtgacgccgattaaaatccgcgacacgctgtacctttgctcgccacaccagattctgtttgcgctggatgcgacgaccggtaagcagaagtggaaattcgatccgggcctgaagccgaatcctaccttccagcacgtgacctgccgcggtgtttcataccatgaagtgcctgccgctgccgatgccgccaacagccagcctgcgctgtgctcacgccgcatctacctgccagtgaacgacggtcgtctgttcgcgctggatgccgataccggtgcccgttgcccatcttttggcaacaacggtgagctggatctgcagcacaagcagccggtacagacgccaggccagtatgagcctacgtcaccgccagttatcactgacaccaccatcgtcattgctggtgcggtcaccgataactactctacccgtgagccgtctggtgccatccgtggcttcgacgtcaacaccggtaaactgctgtgggtgttcgacccgggcgcgaaagatcctaacgcgattccggccgatgaacacaccttcaccatgaactcgccgaactcgtgggcgccggcggtatacgatccaaaactggataccgtttacctgccaatgggcgtttccaccccggatatctggggcggtaaccgcacaccagagcaggagcgctacgcgagcagcgttctggcgctgaacgccaccaccggtaagctggtgtggtcgtatcagaccgtgcaccacgatctgtgggatatggacctgccgtcacagccgacgctggccgatatcacggacaaagatggcaacaccgtaccggtgatttatgccccggcgaaaaccggtaacatctttgtgctggatcgccgtaccggtaagccggtcgtgcctgcaccggagacgccggtaccgcagggcgcggcgaaaggtgaccacgtggcaccgacccagccgtactccgaactgaccttccgtccgaagcagaacctgacggacaaggacatgtggggcgcgacgatgtatgaccagctggtgtgccgcgtgatcttcaagcgtctgcgctacgaaggtccgttcacgccgccgtctgagcagggtacgctggtgttcccgggcaaccttggtatgttcgagtggggcggcatcgcggttgatccccatcgtcagatcgcgattgctaacccaatggcgctgccgtttgtgtctaagctgattccgcgcggtccgggcaacccgattgaaccaccgcagggcgcagaaggcggttccggtactgaaaccggcattcagccgcagtacggtgtgccgtttggcgtcgagctgaacccgttcctgtcgccgtttggtctgccgtgtaaacagccggcctggggttacgtttcagcgatcgacctgaagaccaacgaaaccgtgtggaagaaacgtatcggtaccgttcgcgatagcgcaccggttccgctgccgttcaaaatgggtatgccaatgctgggtggcccaatcaccaccgccggtaacgtgttcttcatcggcgcgaccgcagataactacctgcgtgcgttcgataccaacaccggtgagatgctgtggcaggcgcgtctgccagcgggtggccaggctacgccgatgacctatgaagtgaatggcaagcagtacgttgtcatcgcggccggtggtcacggttcgtttggtaccaagctgggcgattacgtgattgcctatgcgctgccagatgcgaacacccgcgcattcaatagcgcgcacagcgccataatcacgcaggtggcgagaaacaccgggcgcataccaaacgcgccgccgataaagccaccgaacagcgggccgctcacctggccgacatactgggctgag

SEQ ID NO: 44186 - DNA, 1071 bp, Glycine max
  Peptide Sequence Number=SeqID_135871
atgggagaggctgattatgtctcgtctgcgaaaactcctggcttatcgtgctacgctttctttgggtttaccaaaatgcgctccgcagcagagaagcgcgcaatgaatcatgatgttcttcaggaaataaacgccgaaccactttttccggtacagagcgatcaacatattgtttttggcgttgacggaaagtttaaagcgcatgcgctaatcacgattctgtccatcatgaaacacgccggtgaccgcgtgtatcatttccatctgatctcttcagaactgacaccggccgataacccccggctcgccaggctgtttcagggatcgcgccacggcgtgacgctgcatcatctgccggaccagctatttgccacgctgccggtcaccgaactttttacccgtgcgacctactatcgctttctggcaccgctgattttgccgcaggcggaaaaactgctctatcttgatgccgatatggtgtgcattaatccgctcaatgaactgtggcagatcccgaccggccctgaggcggttgcgctggtggtcggtgaaattgcctcgctgcagccggtgctggcgaagaatgccggcttgcgcggcgagcgctattttaacgccggcatgatgctgattgatgtggcgcaatggcgcgctgacaatatcagcgaacgcgcgtttactttactgtccgaacacgggcgaaacttccagtatctcgaccaggatgcgttgaatattttactggaagataaagtgacctttatttctcctcgcttcaataccctgaccatgctggcccatgacgatcatggttatacgctcgacgtgccggcggaaacctgcctgattcattatgccggtgcggataagccctggcaggtatggaatcaacagtttgtggttcaccattatcgcgatatttatcaggattcaccgctgtccaccatggcgtttgaccagccagccaatgcgcagcaggcaaaaagaatgtataagtcgctttttcgtcaaaaaagatggtggcaggccatgctgtggcgcctgaaacatatcaagatgaggtattgttaa

SEQ ID NO: 44187 - DNA, 843 bp, Glycine max
  Peptide Sequence Number=SeqID_135872
atgacggcttcaccggacggcagcgtgctgtacattaccaacacgctggacggtggcgtgacaaaagtggacgccagaagcggtaaagtgctgcagcgtctgctgtttggcctgaaaaacgacaaaggcaatccgattggcgcgcgtgaaatcctgctgcatgacggcctgctgtacatcggtgcgattgagaatccggcgatgatttgggtggtcgatgcgaatacgctgcggctgaaaaccaccatcaaaaacgccggcaagtgggtgaccgggttgctctattcagcgtcaaccgaccgtatttacgcggcgaacggcagtggcgaagtgctggtgatcaatccgcgcactcacaaaattgagcagcgctggacgccgggcgatggcaaagagtatctgctgttaaatctggcggaagatgccgccaatggccgcctgtacgtcactgacaattctaagggcaaaaccacgctggtgttcgatgagcgcagcggtaaggtgatcaaacgcctggatgtcggcgattcgcttggcatcaaattcaatgcgaaacgcaacgagatttacatcagccagcgactcggcggcaaagtgctgcagctggacgcgacgacctacgcagtgaaaaatagctggacgctgccgacccaccctaacagcctgctggtgggctcaataaagatcgctcgccgcaagggccggatagcgtggtgcggattacgctggattaaccgcgatgggtttaatcgcggcgcgagagatcgcgccgcggataacccttgcttagcaacgggttacgtcatccattatgccacgccgttcaccagcagtacgcggtag

SEQ ID NO: 44188 - DNA, 435 bp, Glycine max
  Peptide Sequence Number=SeqID_135873
atggcttctccacctgcctcgcctcctcctcctcctccttctcctctttccgatgcatcaacttcgtcatctgtcgtgaagcggacacgcaaagcctcacgtctacgatccttgtgtactagaccacctagtgctgagagactagtggtggacgtcacgtacgagaacatgaaagaggacggtgtggacgacattgtctgtgagaaatacggcataagcaaggaaaaatgggcccaattttgccagactcgcagagacccttcttgggaggccatccagaaacagaacactgccccccacgttttgtctcgtgggggttatgaatatttgaagcagaaactcctagctgagaagactaagaagaagctgaaggaagctgcacagtcaggaagcgttgatggtgtcattgactctccatcccccgtcagacgccac

SEQ ID NO: 44189 - DNA, 779 bp, Glycine max
  Peptide Sequence Number=SeqID_135874
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataggcgatgaaagagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44190 - DNA, 455 bp, Glycine max
  Peptide Sequence Number=SeqID_135875
gtgctccagtggctatcatggtttctatcagctgtccttcctgttcagctactgacggggtggtgccgctcacaattcggcacacaagcataccgagccggaacatcagcggcaagtgtagccggggtgcagacgctgagctaactcacaccccggttaatgctgccgctcagggcgcgctttcccattcgaaacctgcgctaagggcggatgtgtgcaactggcgattactatgttgggcactgatgcagggtgactcatatgtccgcgaattcctcgctctgagctcgctacgctcggtcgtcgactgcggcgagcgtgaacagtggatccctacaacggggcggaattcgatcggaaacgcagaaattcctttagggaatgatctcgagttggccctggcaaagccgtttttccataggctccgcccccctgacaagcatcacgaaatctga

SEQ ID NO: 44191 - DNA, 477 bp, Glycine max
  Peptide Sequence Number=SeqID_135876
atgcacgccctcacctccagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtcctcgccttgagagggctacacgccctcaccttggagggactacacgtcctcgccgtcaaagggtcatgtgccttcacctttgtagggctacatgccctcaccttcgagaggactacacgtcctcgcctttgagaggactacacgtcctcgccatcagaggactacactgttccaccattttcaaaggggggcatgccctcaccttcagaggactgcacgccttcaccatcagaggactacacgtcctcgccttgagagggccacacgccctcaccttgggtactagttaccctcactgttga

SEQ ID NO: 44192 - DNA, 429 bp, Glycine max
  Peptide Sequence Number=SeqID_135877
atgactctgccagttgtttggagtccccgttgcacctaccaagtactgcaccagagacaggctcagggtgatgctccacaggccgcaggcacgccaccaccacctcatcaggctagcccggctgggtcatttgacatggagcagtatttacgtcatttggttcgccagcaggtggccaaccaccgggcacatgtacagacccatgattgtctgtaccagctgagcctcagcatgcagagccagggcttcgcttctttttcatgccctactccagaccagttcagggcagaggtcgcatggcccggggattggcccgaggcccaagcaggagaggcacccccagaggctcccggcgatggagaggaggcccacgaggacgaggagatgaccgatttgcttgacttcttgggaggaagtggagctacatga

SEQ ID NO: 44193 - DNA, 333 bp, Glycine max
  Peptide Sequence Number=SeqID_135878
atgtcgggatttacacgcaattctcctcaaatttcagccagcccgcatcaattagaccttgcaccttacgcttcagagccctaccatgctcaatggaacgccccggggcttctccatgacaagcacacgttgcatttgagtcatattctcggagaaatggaggttgatgaaccttggctagggttatggctaccattgaattatcaagtagatatgggagcaagtcagcatatgacaacggaatttggggtggtcttcgtcattggaagtgcggtagacaggccttgtggtgatttagggatggcctttgtggataattgggtggtggggtaa

SEQ ID NO: 44194 - DNA, 336 bp, Glycine max
  Peptide Sequence Number=SeqID_135879
atggcagatatactaagaatgaacaagcacctggtccttttgcaaagtttcttcaagaacatgagattgttacccagtacactatgtctggttctccaaattagaatggtgtggcaaaaagaaggaattgaacattattggacatggatcgtggaatcaagaaatgccaagtttcttgaaaatgacttgataaatgagagtgatcaattgagggacttaggttttgaaattgattgtataaagtctcaacctttcacatcaagtgaaagattgtttgtaatccatacccctcaagtgcaaagggatgatgaacagcacatgattgacattccataa

SEQ ID NO: 44195 - DNA, 528 bp, Glycine max
  Peptide Sequence Number=SeqID_135880
atggactcgatcgtctctggatggcaaaaaggtgtgcggattaccataagttgtctgcgcatgtcatcaggatcgccgcctctggatgacaaaaggtgcagaatgaccataatttgtctctgcgtgccattggactcgatcgtctctggatggcaaaaagatgtgcggattaccataatttgtctccgcatgtcatcgggctcgccgcctctggttgaaaaagggtgcaactgtgacaataatttgtctctgcgtgccatcggactcaatcgtctctggatggcgaaaagttgtgcggattaccataatttgtctccgcatgtcatcggggctcgccgcctctggatgacaaaaggtgcggagaccataatgcttgcggccatcgatcatctctggatggcgaaaaggtgtgcggattaccataatttgtctccgcatgtcatcgggctcgccgctctggatgacaaaaggtgcagaagtgaccataatttgtctccgcatgccatcgggctcgccgcctgtggatga

SEQ ID NO: 44196 - DNA, 668 bp, Glycine max
  Peptide Sequence Number=SeqID_135881
atgggtgatcaagaggagacgcaggaacagatgaaagccgacatgtcggctctgaaagaacaaatggcctccatgatggaggccatgttaagtatgaagcagctcatagagaagaacgcggccaccgccgccgctgtcagttcggctgccgaagcagacccgactctcttggcaactacgcaccatcctccctcaaacatagtaggacggggaagggacacgctggggcacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattatgctcgaagggatgtcgagttctatcccccgatccccgaagggccggcaccaggcacgttgcctcaacccaacatcgcagcaccaccaatagttctgtccacggaagggccgcccccagcaactgaagaaaggaggaagctcgatctccttgaggaaagattgagggccgtagaaggatttggggactatccgttcgcagacatgacggatctttgcttagtacccgatgttgttattccctcgaagttcaaagtgccggacttcgacaa

SEQ ID NO: 44197 - DNA, 276 bp, Glycine max
  Peptide Sequence Number=SeqID_135882
atgttgctggttgaggtccttgacactactttcccgacctcaatgcaatggcactcacgtttttgggattctggacagattgagaagtcatttgcctcacaagctcttcaagggaaggttgtggaggagcctcaactgcttgctgtttctggggctgttgctgttgttgctgatggattggtggaggaacgtatagtttgcttgggccaacaacattctaaaaataaggttgttgttgttgttgttgctgctgttgtgaaggattcgaccatctag

SEQ ID NO: 44198 - DNA, 192 bp, Glycine max
  Peptide Sequence Number=SeqID_135883
atggacaacataagattcaccgcacctttcagagttcaaaagttgcttctccaagttcctttcacctatcacaggcaatggctgcgcaactaccccaaatacgttttattccactacgatggcgagatacatttcattaggaagggcacacaacctccacgaaagcatgattctacgtttggtcgccggtga

SEQ ID NO: 44199 - DNA, 231 bp, Glycine max
  Peptide Sequence Number=SeqID_135884
atgcacaactcatccttcttccagattcttccttgtgctcagccgaggagtgttgcactcagcggatggctcgctaagccagaagattggcttagcgagagggtttttatacacaaaagtttaggtcgtattcatcgactaacaaactcccccaaatttacagttttgcttgtcctcaagcaaagaatagaacaactcactgggtccccaagtaacaataacatacagtga

SEQ ID NO: 44200 - DNA, 201 bp, Glycine max
  Peptide Sequence Number=SeqID_135885
atgaagaaaaagtgtcccaagtacgccacatggcgtgtcaagaaagatacttggtgggtagattttggtgctactactcacttaagtgtaaccatgtcgggttgcctgtggagccaactgccaagtggtgacgaaagattcatatttgttggcgatggcaaaaaggttgcagtggaggctataggagcttttagattgtaa

SEQ ID NO: 44201 - DNA, 378 bp, Glycine max
  Peptide Sequence Number=SeqID_135886
atgcagatgaccacgttggtctctgcgtgtccatcaggcttggggtccccgaatgatggggtacgaataaccggaaggtgtctctgcatgctaccagactcttgggtcatgatagcaaaaggtggggcggtcgacaaaagcgaggctgttgctcctacgtatcctcaatttgtgatgaggaactcagacctatgcttggggtccccgaatgacggggtacggataactggaaggtgtctccacatgctaccagactcttgggtcatgatagcgaaagatggggcggtcgacaaaagcgaggcttttgctcctacgtatcctcaatttgtgatgaggaactcagacctacgcagttctttctttgtgagactaaaatag

SEQ ID NO: 44202 - DNA, 432 bp, Glycine max
  Peptide Sequence Number=SeqID_135887
atggcaacgcagttaatccatgattgcgtggtgatggagtgcctagagggagtttgggagaccctcgaaggcaataagaggtgccgattctgtggcatgattcgactccttgctacttcattggtacatccagaggaacccgcacgcacgcttcaacagcctgtggagtggatactacctacacctactccatatcgactagtggagccagtccaagtgatagaggtgtcatcctctgaagaagatcctgaggaggaccaggaggagctacctcctgaacctgctgtggatgatcttgacttacccgaggatgatgaggacccactctctgatgttgattctccagaggatatcatgtcagcatctaaggcagactctacagaggagatcggccctggagggacaacgaatagtgaagactcttcatcatag

SEQ ID NO: 44203 - DNA, 417 bp, Glycine max
  Peptide Sequence Number=SeqID_135888
atgactgcccattcacggttagtcagttcattgataatgaagaaaaaacggccggtactccaggatgtggcggacaaggtgggcgtgaccaagatgacggtgagccgttatctgcgcaatcccgaccaggtttctgccgccctgcagcaaaaaatcgccgtcgcgctggatgagctgggttacatccccaaccgcgcgccggacatcctctccaacgccaccagccgggcgattggcgtgctgttgccgtcgctgaccaaccaggtgttcgccgaagtgctgcgcggcatcgaaagcgtcaccgacgcgcacaactaccagaccatgctggcgcactatggctacctgccggagcgtgaagaagagcgtcttgacctcgctgctttcttacaatatcgacggcctgatcctgtctga

SEQ ID NO: 44204 - DNA, 674 bp, Glycine max
  Peptide Sequence Number=SeqID_135889
atggtaaccattcgtgcagatgaaattagtaaaattatccgtgaacgcattgagcaatataatacggaagtaaaaattgtaaatacgggtaccgtacttcaagtaggcgacggtattgctcgtatttatggtcttgatgaagtaatggcgggtgaattagtggaatttgaagaggagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacgggtaaaacagcagtagccacagatactattctcaatcaacagggacaaaatgtaatatgtgtttatgtagctattggtcaaaaagcatcttctgtggctcaagtggtgaataccttacaagaaagaggagcaatggaatacactattgtagtagctgaaacagcggattctccagctacattacaatacctcgccccttatacaggagcagctctggctgaatattttat

SEQ ID NO: 44205 - DNA, 306 bp, Glycine max
  Peptide Sequence Number=SeqID_135890
atgactatttttgcgcatccaagcaaagtccttgatcctgtgaagtttgatgagttggaaattgaggctgctattatattgtgtcagttggagatgtacattgtagaagaagccattgaattttgttcaaagtacattgaaaaagctaaacctattgggcttcccgagtctcggcatgatgaaagagtgggcagtaagggttcaagaggactgcatgttatcactccaactatagaagatttgcaacaagctcacttgtatgtgcttcccaagttttgccatacatacttcggcatgaaggtttag

SEQ ID NO: 44206 - DNA, 237 bp, Glycine max
  Peptide Sequence Number=SeqID_135891
atggtgaaagttggagaccttacgtgccgatcaacgtctcattttcgccaaaagttggcccagggcgaaggaggtcctcacgtcaacagagtctggcaccgagatcaagcttatttcgaatatccgtcgacctcaggctgcgtccgctttccagtcgggaaacctgtcgtgccactgcttagaatcggccaacgcgcgggcgatcgaggcgggctttgctattacgccaggcgctaa

SEQ ID NO: 44207 - DNA, 567 bp, Glycine max
  Peptide Sequence Number=SeqID_135892
gagaacttcgaagctccggaagaggatgaagaagtccgacctctaaaaatagaactaggaaaagcaagacttgccaaagaaaaattcaagttagtcgctacagacgtccgtaaagagtgtgtcgagttacgaaaagaaaacgcagctaccgcaagagcccttgaacgagaaaccaagagggctcgcaaggaagagcatggccgagacaaatttcgtggagctttgtggggcagcaacagtgagctcaagcttcgaagggaagagaaagaccaatcacgagcacatagcatggtcttaaaagaggagttagctgcttgctcaaggtccaagagaagcttgtctcagtgtttatgcaagacagagaccaacatgttagccatcatcaataagtaccaagaagaattaaatctagccacggtccacgagcacaaagtggcggacgagtatgctcgggtgtatgcggaaaaggaggctagaggaagggtgatcgactcgttacatcaagaggcaacaatgtggatggaccgatttgctcttactttgaacgggagtcaaaaacttccctga

SEQ ID NO: 44208 - DNA, 212 bp, Glycine max
  Peptide Sequence Number=SeqID_135893
aacaaggaattaaagagaattcaccgaacaaaaagatagaggaagcaaaagagcatcacctagatgaagatgctttgataccacatgatgtagctccatgtggagcttgtaggccttggatcttcttcatcaatggattcctttgcttcatgaggtctgattgcagtggaatggagaaggagaaagatgaatggagatgccacttcaactag

SEQ ID NO: 44209 - DNA, 138 bp, Glycine max
  Peptide Sequence Number=SeqID_135894
atggaagagaagagatgcagcggaaggcaaaggagaagaggagaggggaggcaccatccactagggaataagccaaggaagaaggagcttcaccaccaagaattgccttggataagaagtttgaagaggatgctttaa

SEQ ID NO: 44210 - DNA, 282 bp, Glycine max
  Peptide Sequence Number=SeqID_135895
atggaggccatgaaggaccaaatgaccacaatggtggaagccatgatgagtatgaggaaaatgatggaggtcaatgcggctacagttgttgccacaagtatcgccactgaggtggacccgactcatccatctagcctcgatcaagtccctcaacccataggggagacacatgaagtaccccgaggccactctctagccgactttgagccttacctcagatatgccactgaggggcaaacatttggtggcatacccctgccaaacactttgggggccccttag

SEQ ID NO: 44211 - DNA, 181 bp, Glycine max
  Peptide Sequence Number=SeqID_135896
atggttgacttttgccttttttacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 44212 - DNA, 189 bp, Glycine max
  Peptide Sequence Number=SeqID_135897
atgtcacaacttgttgatgggataactaaggtgactacgaataagtggatggatataacggacatgggacatgtcattgcatcaagatataatgcgaagccatggccaaatccatatattagcagaatgcagcatttcaagagctttgtgatgttcaagagagactatgttgacataaatgatgattga

SEQ ID NO: 44213 - DNA, 462 bp, Glycine max
  Peptide Sequence Number=SeqID_135898
atggcgcctaccaggcaccctctggacccggataagtccaacagggccctgggatttcccgccttgattacaggactctgccagtcgtttggcgtccccgtcacacctagcaaggtgattcggccgcccatcacccgagcttttattgagaagtactgcacgcagagacaggtccagggtgatgcaccacaggccgcggacgcgccgccacctcatcaggctggcccagccggtttgtttgatacagagcagtatttgcggcatttggttcgccagcaggcggccaaccaccgggcacagttcagggcagaggtcgcatggcctggagattggcctgaggcccaggcaggagaggcaccagcaggggcaccagcagaggctcccgacgaggcagatgaggcccgcgaagacgaagagatgactgatttacttgatttcttaggagggaacggggccacatga

SEQ ID NO: 44214 - DNA, 150 bp, Glycine max
  Peptide Sequence Number=SeqID_135899
atgaagttaggtggcaggcggagatacccaagtggttatccgtataaacactttttcgctatatgtcagactcagagttcggggcaagcaaacccgttgacacgcggagacttacgtcgtcttttgcacctttgtcatcctgacccgtga

SEQ ID NO: 44215 - DNA, 273 bp, Glycine max
  Peptide Sequence Number=SeqID_135900
atggcaaaagggaagattttggtgaaaatacaatcatcagtaacattgatacagcttgcatgcggggcagattctgctactgtggcaatcaccacgacagatcttgttagcaagagtgtggcaattgagtctctgggtcaaggatactcattacatgcagatatacagtatcttgatgctagatgggaagttcttgttgtgcttcctctgcgtgattgttttgcccaagatatcaacatgctatgccaccttgatgggtttgtagtcctctag

SEQ ID NO: 44216 - DNA, 525 bp, Glycine max
  Peptide Sequence Number=SeqID_135901
atgacccaagagctggtagcccgcggagacaccttacggttatccgcacctcgtcattcagtgaccccaagtgtgattgacgagcagaggccaatgtggtcatctacgccctttccggagatgtcagcattttccgatggagacttttcaagtctcacaagttatctagaactacgtagaggcggcgggcccgatgatacgcggagataccttacggttatccgcacccttgtgtcatccagaggcggcgggccgatgacaagcagagacaaaatttggtcattctcttgtattcaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatgatacgcggaaatacccgagtggttatccgtataaacattcttttgctatctgtaagacagaacgcttgatagcatgcagaggctga

SEQ ID NO: 44217 - DNA, 290 bp, Glycine max
  Peptide Sequence Number=SeqID_135902
cacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgggaccgctacacttgccagcgctgatgtccggcggggcttttgccgttacgcaccacccccgtcagtagctgaacaggagggacagctgatagaaacagaagccactggagcacctcaaaaacaccatcatacactaaatcagtaa

SEQ ID NO: 44218 - DNA, 449 bp, Glycine max
  Peptide Sequence Number=SeqID_135903
ccacggctcacgagcataggatcgcggacgattatgcccaagtatatgcagaaaaagaggctagaggaagggtgatcgactcattacaccaagaggcaaccatgtggatggatcagtttgctcttaccttgaacgggagtcaagaacttccccgattgttagccaagccaagatccaaatctagaacgatgggtgatcaagaggagacacaggaacagatgaaagccgacatgtcggctctgaaagaacagatggcctccatgatggaggccatgttaggaatgaggcagcgtatggagaaaaatgcggccaccgctgctgctgtcagtttggctgccgaagcaaacccaactctctttgcaactgtgcaccatcctcccttaaacatagtaggacggggaagggacacactggggcatgatggcaaccctcacctgggatacaactga

SEQ ID NO: 44219 - DNA, 447 bp, Glycine max
  Peptide Sequence Number=SeqID_135904
atggttaaggaggagtgtcaggatacacttgttagcattgccacacctcttgggcttgagtttattcctcaagtaaaggagttgttgaatgagggtttggttcgcaagagcttaaatccttgtgctttattggtgcctaaaataggtattattagccaccaaatccctaaaataggttgtatgattaatgttttgagtggtgcaaccctcttttgtaaaatcactcatgcacccaacatcttcatgatttgtgtacatagggactcattagggagtgatcaaggggttcccatgaaccctaagagaataaaggtcattcctgagtggcccactccaccaagtgttgagaaaaaaagcccagagtttcaagaacctcgggatttgaggtcaaatccttttcaagggggagggaatgatgcaatcctaccccacaagtctattggatag

SEQ ID NO: 44220 - DNA, 203 bp, Glycine max
  Peptide Sequence Number=SeqID_135905
gtgtagttgattcaaatgataaggggtctataaatttgaggacaaatcctcttcaagagggaggggatgatgcaatcctcccaaagaggggacccatcaccagatccatcgctaggagactccaagaagattgggttagagatgcaggagaaggttctagagttctcatgagccttaaggtagattttgggcctatgagctaa

SEQ ID NO: 44221 - DNA, 851 bp, Glycine max
  Peptide Sequence Number=SeqID_135906
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatttacagatcgtgtatggtctaaaatcagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44222 - DNA, 563 bp, Glycine max
  Peptide Sequence Number=SeqID_135907
aagtttatgggataaagatggtcattgaccaatccctcttctatgatttgacccgattgtctagcgaaggtgtaccatttgaaggtacactagatgatgattggaaatttgatttttctatgcatgatgcccgccggttggtttgcaccaaccaagcggatatgaccggaaggctgcttgccggttcattggctcttgaaagccgcatccttcactatcttactcccaagatcttcaaaccttgcacagtcacttttttccttcaacattttaacatcccttttgattctgaaccttatgttctaatcaagagatctttcttgatcgatgctgctgtggttgcgtcctttggttaccgcaaagagcgtgacggctcttgggtaaaaaatggtgctcaaccaaatgatgatgaaggacaattactggttgaagtggactcttctcttcttcagagtattttggacagatttaatggacttcaaacctatgttggtgagaggtttgatgctttggaacgacaagtggacacgcgattcgacgaaatggactcaaggatcacaaag

SEQ ID NO: 44223 - DNA, 461 bp, Glycine max
  Peptide Sequence Number=SeqID_135908
ggaagctttcagcaggaaagctaagtgtgaagtatgccattctgcacagaattggagctgcaaactgggttcccaccaatcatacttccactgttgccacagaatcttttgctatcaaattacccattgccttccctactggacacatgtcccagacattgtctcgacccccccctcccacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgataaagaagcagctgaggaagaaggagaagcagctgaagaagaagaagaagctgctgaggaagaggaagatgcaacagaagagacagaatcagatgatgattctgaagccaccccatga

SEQ ID NO: 44224 - DNA, 504 bp, Glycine max
  Peptide Sequence Number=SeqID_135909
atgaccgacagattgcttgctgggtcattaacctttgacaatcgcatcatgcactacatcattgttcgcattttgttaccccgttcatctaatcttgctcaagcctctgaggaggatttgattctcatgtgggcttttcttaccggtcatcagatcgactgggcccacttgattcctttggatgatgaaccctttgttcaagtaaaacaatctttttctattggtgctggtgtggttacctcctttggttaccgaaaggatgttgatggtcagtggattcataaacaagacttgcctccgcctattcctgacgaacataccccatctcctccaccacaaagggttgattcctcttctcttctgaccgaagtcttcatagaacttcgtggtcttcgagcttttgtaggtgaacaatttgatgcgatggatactcgccttaatgcaatggatgcacgctttgatgggatggatacacgaggatcactagtctcaaagatgatataa

SEQ ID NO: 44225 - DNA, 303 bp, Glycine max
  Peptide Sequence Number=SeqID_135910
atgacccaaaagagaaaaaagagaagtggtggaggattggccgagtttgctgttgctaagaaaaacattttgatcaatgctgcattaggtggtgtaggttctatgggtaatgttgggtcctgcacaaagattaataggcccgtggacattatcacagttgtggggggtcaaggatactcattacctgcagatacagagtatcttgatgctagatgggaagttcatgttatgcttcctctacgtgattgttttgcccaagagatcaacatgctatgccgccttgatgggtttacactcctctag

SEQ ID NO: 44226 - DNA, 381 bp, Glycine max
  Peptide Sequence Number=SeqID_135911
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggcacatatctctcaaaccataggggagacacatgaaattccccaccacaatctagctgacttcgagccttggctcggatatgccactgaagggcaagcagttggtggtataccctttgaaaaccctttggaaggccctcagtatcacccacaactgcacctcttgcattccacagcggttaaaaaccctcatgactatggcaggaatgggaaagttgggatcatctag

SEQ ID NO: 44227 - DNA, 300 bp, Glycine max
  Peptide Sequence Number=SeqID_135912
atgggagccaatgcggttgcacttgccgctaccagggctgttgctaaggtgaacccgatgcccccatctgatctcaaccaaatgaatcatccaacctcagatatgggccctcagtatcacccccagctacacctcttgcattccacaacaagtaagaaccctcatgctatggaagaattgggaaagttggatcatctagaggaaaggctcagggccactgaaggaggcgaagattatacctttgctaacctagatgagttgttcctagtacccaatatcatcacccctcccaagttctag

SEQ ID NO: 44228 - DNA, 630 bp, Glycine max
  Peptide Sequence Number=SeqID_135913
atggatatgaacttggggtacctcatctcccaccagatctctcttactgcacagcatgatacatccaggcttgtattccctaccttgatcacagctctatgcaaggccagaggaaaaaactgttggaatcttgatgatccaacagtgacatttagagggccaaggaaggacaggggtaagagatcagaggtccccactacttcagcaccacccgagacaacagctccttcttcttccacaactccaatgctacattccatgctccagagcttacacagggggcagtccattatcatgcagagccttcaaggcttgggcttgccatccatcatgagcatggatgattttgatgcgcaggagcctaaaccagaggagccagcagcagagggggaggatgagctcacccctcctgagcccttttattttgatgtaggtgtacacatggctcaagaggaggagacttctacagaccatatcctagagtcatccctaacacccatacctaatgatgccataccatctgcaccagcatctgagttagagcagcctatctctcaggattcaccagctgctcaggtgttggttcttaatgagcatgcacaggagcaaccacaggagcaggacatttaa

SEQ ID NO: 44229 - DNA, 204 bp, Glycine max
  Peptide Sequence Number=SeqID_135914
atggtagaagtctccacaaaggccattgcctccctcgctcagtattatgatcaaccgttgagatgctttacctttggggacttccagctgtcacccatggtggaagaatttgaagagatcctaggatgtcctctagggggaaggagaccataccggttgaagacaaggaaaaagggaggtgcttgccgcccagaggcttcttga

SEQ ID NO: 44230 - DNA, 114 bp, Glycine max
  Peptide Sequence Number=SeqID_135915
atggctggtggagctatttcctggaggagtgttaagcagactttgactgctatttctaccatgaaagctgagcttgtctcttattttgaggctacatcacatggtgcacattga

SEQ ID NO: 44231 - DNA, 656 bp, Glycine max
  Peptide Sequence Number=SeqID_135916
atggctaagtttgacccagatatggtcctagagttttacgctaatgcttggcccacggaggagggcgtgcgggacatgcggtcatgggagggccaggagtgcgattttagtcaaagaaggaaccgggccgatggatttgacgaggaggccattgcccagctgttatgcatatcgggtcaagattttgcccggaccgctgccgggagacgggtgcggatcatgcgcaccagcatgaccaccttgactcagatgtggatgacgttactgctcagcaacgtcctgcctagcgatcataactccgacctccctctgccgaagtgtcagctggtgtatgccatcctgacacggatgagcgttcatgtggctcagttgatcgttgacgccatttatttatttgcaggtatgccacctaccaggcaccctctagacccagataagtctaacacggccctggggtttccagtgttgatcacgagtctctgccagtcgttcggggagcccgtcacacctagtaaggtgattcaaccgccgatcacccgggccttcattgagaagtattgcacgcctagacaggcgcagggtgatgcaccgcaggccacagacgcaccgccaccacctcatcaggctgatccagctgggtcatttggcatgcagcg

SEQ ID NO: 44232 - DNA, 812 bp, Glycine max
  Peptide Sequence Number=SeqID_135917
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccggtgggcttgacacccatcaggcgcgcattcaatgcatcctggatgtagcctttcaggatgccgtcctcgatcaggacattcgcctgcgaggggcagccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44233 - DNA, 216 bp, Glycine max
  Peptide Sequence Number=SeqID_135918
atgggtggaatggatgaatgcatgaggaaatatgacacagatgcaatttacgaatacgggagcccgagaaattgtttccttgttggatacaacgttccaacatatgtttttaagaaggtgacacggaccctccgtcggtttgctaaagtgaggggatcaaagacgaaacccacgcatgatgcatatgcgaaaggcacaacacggggatgtacatag

SEQ ID NO: 44234 - DNA, 588 bp, Glycine max
  Peptide Sequence Number=SeqID_135919
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggtccacgaatggttcgtgatgtatttcgtctcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 44235 - DNA, 204 bp, Glycine max
  Peptide Sequence Number=SeqID_135920
atgaagcatggctccaaactctttggtggaggatgcatgaacgaaatcgcaattcatagggctccgaaaaagggtagagaatggagaattgcactaagcaatcactacgcatggctccaaactcgatgcatgaacgaaaacggaattcatgggggctctgaaaaaggggagaggatggaggattgcactagggatcctcattag

SEQ ID NO: 44236 - DNA, 180 bp, Glycine max
  Peptide Sequence Number=SeqID_135921
atgtgtgcacaagaaatggctccgaaaaagctttccgtgaagagatctaggagggacgccgcggctgaagggaccagtgccgctctcgagtttgatagccaccgtttcaggagcgccgagcaccagcaacatttcgaggccatcaaaggatggtcgttccacaaagagagacccgtctag

SEQ ID NO: 44237 - DNA, 363 bp, Glycine max
  Peptide Sequence Number=SeqID_135922
atgatggaggccatgatgagcatgaagaagataatggaagccaatgcggttacaattgtcgctaccagcactgttgctaaggtgaacccgatgcccccatctggcctcaaccaaatgaatcatccaaccttagctatgccaatgtggcgtacactcccaatgagaatgtcaataactccactcctatactcattgagagccaacaacctcaatctgatcatgcacatgtctcttgacccatggggggaggcacataaaattccccaccacaatctagccgacttcaagccttgcctcagatatgccactgaagggcaagcagttggtgatatatccctgcaaaacactttggagggcccttag

SEQ ID NO: 44238 - DNA, 276 bp, Glycine max
  Peptide Sequence Number=SeqID_135923
atgcaccccatagactcatctaacacagtcatgtacaggaaaagaggtcttcctgttacaggtggcatgagcaccgggggattcacgaggctctgtttgattttttcgaaggcctcttggcagtcgttgttccacaggaaacctcacgatgtaattcaacctgcccaagaaacctcgaacctgcttctccgtgcgtggctttggcatttcaagaatggccttcactttctcgggatctatctctatccctttctggctcacgataaatcccaataa

SEQ ID NO: 44239 - DNA, 282 bp, Glycine max
  Peptide Sequence Number=SeqID_135924
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagccagttggaaaaactcttggaattatgccgcgacaccttctcacctagatcgaattcctggctttccggggaatccgcccactagttctagagccgtgccgcatcaccgacggtggagctcacaattcgccctatag

SEQ ID NO: 44240 - DNA, 701 bp, Glycine max
  Peptide Sequence Number=SeqID_135925
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaatgggtacctgtacccgaaaccgacacaggtgggggtcgcagtgaccaggcccgggcgactgtttaccaaaaacacaggtctccgcaaagtcgtaagaccatgtatgggggctgacgcctgcccagtgccggaaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatca

SEQ ID NO: 44241 - DNA, 342 bp, Glycine max
  Peptide Sequence Number=SeqID_135926
atggagatctggatcaggtggctcaggccgaggttggacaccaccatcgagaacaggcccagaataaacaccagcgtcttgtacgagaacggcaggtattgcgcgaagaactcggcgcaggcgcaggatcaccgcgccgttggtggcgtccggcaccagcgcgccgctgccggagcccagcttgaacaggctcaggtaaaccagcgtcaggcccacgccggcgatcaaaccggccagaatggtgtagcgggtcaacagaccggcgtctttcacgccgcgcgagcgcgccgcgttgacgataacgatgccgaataccagcgcgcccagcgtatccatggtcag

SEQ ID NO: 44242 - DNA, 138 bp, Glycine max
  Peptide Sequence Number=SeqID_135927
gaaccgatcgggaaaataacaaaaaccacatttccagtcatcggaggctccgcacttgatggtggaggacgcatgaacagcgctaggcaatcaattcatgggtctccgaaagattggaggatggaggatggaggatag

SEQ ID NO: 44243 - DNA, 338 bp, Glycine max
  Peptide Sequence Number=SeqID_135928
atgtcctatgctaacttgctcccatatctacttgataatttaatcgtagccataaccccagccaaggttcatcaacctccatttctccgagaatacgattcgaacgcatcgtgtgcttgtcacggagaagccccggggcgttccattgagcattgtagggctctgaagcataaggtacaaggtctaattgatgcgggctggctgaaatttgaggacaatcgtgtgattttcaactttcaccggaagtgggtgcaagccattggtctgtttgctcaagcgacctgtgctcctgagtttggacttccaagaccgttcaatcagagatactcgtcttgcac

SEQ ID NO: 44244 - DNA, 833 bp, Glycine max
  Peptide Sequence Number=SeqID_135929
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccgaaacatttggcaaccttcttttactttatatcaagtacgagtacgtggactctgctgcagatctgttggctgacaactcacatttggctgcatctcatttgagtccggtaagacatttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44245 - DNA, 860 bp, Glycine max
  Peptide Sequence Number=SeqID_135930
gcgcgcaaggtctcaaggttatacaaagaatccacaaggcgtggaggagtccgttgaggaaagacaaggagcttaggggcatccgaaacggcgtcattggaggttatcatggatggctaagaattcacacgcggggcttaggttggctctccaaattgaaagttgtcgatgaggagaacttcgaagctccggaggaagatgaagaagtccgtgctctaaagttagagctagggaaggcgagactcgccaaggagaagttcaaatcagctgctacacacatccggaaggagtgcaccgagttacaagaggaaaacgcggccactgcaagagctcttgaacaagaaaccaaaagggcccgcaaggaggaacatggccgagaaaaattccgaggagcattgtggggtagcaacaatgagctcaagctccgaagagaggacagagatcggtcacgggtgcatggcatgatcttaaaagaagagttagttgcttgcgcgaggtccaaaaggagtttggctctacacttggaagccacggagcaaagcatgctagccatcatagggcaatacaaggaagaattgaaccagtccatggcccatgaacaaaagctagtggaggattttgcacaagtgtatgccgaaaaagaagcaagagggagggtgattgatgcgttgcatcaagaagcgactatgtggatggataggttcaccttgaccttgaatggaagtcaagacctcctacgtctgttagccaaagcaaaatcgatggccgaagtgtgtactgcccctgaggagatccatgggctaatcaattactgtcagcacatgatagatttgatggcccatataattaggaatcgttag

SEQ ID NO: 44246 - DNA, 252 bp, Glycine max
  Peptide Sequence Number=SeqID_135931
atggctgaagaagacgcactccctcctcaagatgagcatactccttcacctcctcctcggcgtgaagattcagcactcctgaatgaagtccttaccgaattacgaggtcttcgttcttatgttggtgaacatttcgactcattggatacacgctttgccagcatggatattcgcctcacacaagttgaagaagatgtctccttcatccgtacttgctttgatccaccaccaccgcctccatcatcctcttag

SEQ ID NO: 44247 - DNA, 293 bp, Glycine max
  Peptide Sequence Number=SeqID_135932
atgtcacctgacttcacgggtcaggacgccaaatggtgtcagaagatgatgttagtctccgatgcgccaacagggctcgtttgcccatggttgaccaaaggtgcgggtaaccccgcatgtcactttacctcacgggtcaagccggaaaaaggtgccgaggacgatgttgagtctccgcgcgccaacaggctcatttgcccctggttgaccaaaggtgcaggacaacaaaaggtgcagacgacgatgttagtcctcgctcgtcaacaggctcgtttgaccctggttgaccaaag

SEQ ID NO: 44248 - DNA, 808 bp, Glycine max
  Peptide Sequence Number=SeqID_135933
atggaagggttagtggacctagcagcgattgacgctttcctcgcctttcatcatggcaaggaaagcccggtcgtcgccattttggccatgtatgacacgttcgactggggatgtgaaaagagcggcgcaagaattgaaggaagaatcaggattctatcttcatgcgaaggatgtcccatgagaggagtgccatcagacgaaagcatcacgcctttcatcgcacgaggtttcagtgaccacaacgcgagggacagagagcttaggggaagcagtaatgggatcatcggcggctatcataagtggctgagagttcgaacacaaggactggattggctcccaaatctaaagactgtgagagacgatgaggttaaagcttcgaaagaaagtgatgaggtacaagccctaaaggcagagcttgaaagagcctgggtagtcgaagagaagttcaaggcagcaatagtgagctcaagctccgaagaggtgaaaggaatcatcacgggtcaaaggcatgatcttgaaggacgagctaaagggaatatgtgggccatcatcgataagtacaaagaaaagctaaatctagcggcgactcacaagcaaaggctagaggatgagtatgccaagatatcagcagaaagggaagcaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccacggacttctcagctatt

SEQ ID NO: 44249 - DNA, 258 bp, Glycine max
  Peptide Sequence Number=SeqID_135934
atgggtgaagattcttggtcggtggttcgcaaccatatgcttaaagaacttgccaaattctcagaagactatatcaagctctttggtggcacagagagatttgagaaattaaggatgttactacttgttgatgggttaaccaaggtgactacggataagtggatggatataacggacatgagacatgtcattgcatcaaggtataacgtaatcgctgtatccttgtctaaacacaagcacgacattttttcctcttag

SEQ ID NO: 44250 - DNA, 183 bp, Glycine max
  Peptide Sequence Number=SeqID_135935
atgcttaaaaaaagaaaaatcgtgggtgctgggcagcttggacatacaaactgtgggaagacaagtgccaaagctagagggaattggaaaggaggattggtgtcatcccttgaagaatttgagtccagaagcaaggggccaaccaccttaagagctattggactaagaaacactccaaattga

SEQ ID NO: 44251 - DNA, 139 bp, Glycine max
  Peptide Sequence Number=SeqID_135936
atgtgttttcggggagaaaatccaagccgaggtgcttccgtaacgcttccgagacattttcataagcgattttgtggagattcttcatcgtttttcaccgttcttcgttcgttcttcgtcgttcttcggtcttcaaccg

SEQ ID NO: 44252 - DNA, 65 bp, Glycine max
  Peptide Sequence Number=SeqID_135937
gtggaggggatgtaggaggtggaggggatctcgggggtgttgccatgggtcctgcaaaaatataa

SEQ ID NO: 44253 - DNA, 360 bp, Glycine max
  Peptide Sequence Number=SeqID_135938
atgaccatgtccataagccatagccttatattattaagaacatatttggggattgtggcacgtgataaggtggacatcacctacgagaactggaaggagttccctactgctcagaaggacctgatttgggaggatattcaggcggaatttgatatcctagaggcttcttacagtaggacgaaaaggaagttactacagaccgtgggggagagatggaggcagtttaaatcagacctcacaaggaaatgggcccatgcagccgatcaagacggtgtcgaggacactgtctgtgacaaatacagcatcaacaagggaaaatgggtccagttttgccagactcgcagagactcttcttgggag

SEQ ID NO: 44254 - DNA, 747 bp, Glycine max
  Peptide Sequence Number=SeqID_135939
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggaactgcaatgggtcactgttacactcaaaactgctacccttaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 44255 - DNA, 243 bp, Glycine max
  Peptide Sequence Number=SeqID_135940
gtgagccttcatatgttagttagttataattgtaagggtagagggtgtgatgaggacatgatcaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 44256 - DNA, 513 bp, Glycine max
  Peptide Sequence Number=SeqID_135941
atgcccactgggagagaagccatatcttctctgggttctatccctcacgacaagagttgccaaggtagtgaaaatctcagcacaagagttggaccgtgtaaagcaaaacaggaatgggatagtcggagtaccaaggaagtgtttggaggaaagggcaaaggccttggcaaatcaaggcgaatgggctttcttttatctgactgctgcgttttgatcttcgaaggggagttgatacctctagaaaccatcaagagagatatgactaccttgggggttatcactaaaagcctaagtggcgtactaagaattgtactcccgtgttgtgccactcttcggcatatgcatcatggaggggtttcgtctgttgaaatgtccctcgactttagcaaaccgaggaaggaagaatccaggttcttcttaaaacatagcttgaaggatgtcccagctgcccagaggacgttgctatcagacaagaaacaatttctcagctcccgtattcaaattcgcatctga

SEQ ID NO: 44257 - DNA, 285 bp, Glycine max
  Peptide Sequence Number=SeqID_135942
atgacggtgaaaacctcggacacaggcagttcccggagacggtcacagcttgtctgtaaccggatcccgggaccagacaagcccgtcagggcgcttcaccggtttttgccgatgcgtaaggagaaaatcccgcatcaggcgccattcgccattcaggctgcgcaactgttggaaagggcgatcggtgcgggcctcttcgctattacgccagctggcgaaaggggaatgtgctgcaaggcgattaagttgggtaacgccagggttttcccagtcacgacgttgtaa

SEQ ID NO: 44258 - DNA, 792 bp, Glycine max
  Peptide Sequence Number=SeqID_135943
atgggattgagtcaggcatttttgcttaaaaagagattctatcaagtcaaggttaagagcctaggagtcaccagtctgaaagagttagggcagttgatgggtcagctccagcgacaagcttttcataaagcttacggtaagatatgggacctagccgtggcagaggtctccaccgaggccattgcctccctcgcccaatattatgaccagccgttgaggtgcttcacctttggggacttccagttatcacccacggtggaagagtttgaagaaatcctggcagcgattgacgaagaggtgcaggcccttaggacagaactcaagcaagctcaaacagtcaaagaaaggttcaaatcagcaactctaaaaatccgaaaagagaataccgaactgagagatgtaaatgtggctaccaccaaagccttggaacgagaaaccaagagggcttgtagggaagaacacggccgaaacaagttccgaagggctctgtggggtagcaacagtgagcttaaactccgaagagaggaaaaggaccaatcacgagtagacaatttgatcttgaaagatgaattgaaggcttgctcgaggtccaaaagaagtttgtctcagcggttatgcgagacagagaccaacatgttagctattatcaccaagtaccaagaggaactaagtctagccacggcccacgagcatagggtggcggacgagtatgcccaagtgtacgcggaaaaggaggctagaggaagggtgatcgactcgttacaccaagaggcaaccatgtggatggactga

SEQ ID NO: 44259 - DNA, 836 bp, Glycine max
  Peptide Sequence Number=SeqID_135944
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcacgcactgtgccatcttcgtagctatcaggactcagggacagagagaacttttcttgccctgtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44260 - DNA, 454 bp, Glycine max
  Peptide Sequence Number=SeqID_135945
atggaagggttagtggacctagcagcgattgacgctttcctcgcctttcatcatggcaaggaaagcccggtcgtcgccattttggccatgattctatcttcatgcgaaggatgtcccatgagaggagtgccatcagatgaaagcatcacgcctttcatcgcacggggtttcagtgaccacaacgcgagggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaaggcagcaatagtaagctcaagctccgaagaggtgaaaggaatcatcacg

SEQ ID NO: 44261 - DNA, 333 bp, Glycine max
  Peptide Sequence Number=SeqID_135946
atgcaccatctcttgttctcagttacaacaacccaagtagatgtaccctctacttgtaccacaaaggatgtaccctccaatgtgttaagacaaagttctcaggtggttagtcctttgaatctttgtaaaggggaaacaaaagatatcttaggcgaattttcacttgcagaagaacaaggtttgaaaaacagaaaacttagaaagcttttgagcaaaggaagaagaagaagaaagatgagtaggaaaggtttcaagatttctgaaaatattttcaaagaagttcaaaagttatatgaagatgttgaaatgcaagtcaaggtcttgcttttatag

SEQ ID NO: 44262 - DNA, 700 bp, Glycine max
  Peptide Sequence Number=SeqID_135947
gaaagttggaacctccttacgtgcccgatcaacgtctcattttcgccaaaagttggcccagggcttcccgggtatcaacagggacaccaggatttatttactctgcgaagtgatctccgtcacagtgctccagtggcttctgtttctatcagctgtccctcctgttcagctactgacggggtggtgcgtaacggccaaaagcaccgccgggacatcagcgctgggcaagtgtagcggtcacgctgcgtgggcgcgtcccattcgccattcaaggctgcgcaactgttgggaagggcgatcggtgcgggcctctttcgctattacgccagctggcgaaagggggatgtgctgcaaggcgattaagttgggtaacgccaggggcgaattggagctccaccgcggtggcggccgctctagaactagtggatcccccgggctgcaggaattcgatcccggaatcgaccaggtggaggaagtcgtcgaggctggcgccggtcgcggccagcaccttcgcgatcgattcggtcgaaggccaccgcttgcgcccgtcgggtccgatccgcttcgagcggttgaagctcgtggcgtcgaggcccgcgcgccgggggaggcccgaggcggagaagcatcaagcttatcgataccgtcgacctcgagggggggcccggtaccagcttttgttccctttagtgagggttaa

SEQ ID NO: 44263 - DNA, 351 bp, Glycine max
  Peptide Sequence Number=SeqID_135948
atggtgaaagttggaacctcttacgtgccgatcaacgtctcattttcgccaaaagttggcccagggcttcccggtattcaacagggacaccaggatttattttatactggaactgtccctcctgttcagctactgacggggtggtatccgcctgcccgtctttccagttcgggaaaccatgtcggtgccaactgcggagtgtgcatactggcttactatgttggcactgataacgccagggtgtcagtgaaggcgttcatgtgcaggaaaaagctgacgggaagtgagagggccgcggcaaagccgtttttccataggctccgcccccctgacaagcatcacgaaatctga

SEQ ID NO: 44264 - DNA, 810 bp, Glycine max
  Peptide Sequence Number=SeqID_135949
atggagattttcgtgaaacgaattttgattaccggtgctgcgggtggactggggcgcgtgatgcgcgaaaagctggtcggacaggccgaactgttgcgcctttccgatgttgtcgatatgggcgaggccaggccccatgaagagcttgtgcaatgcgaccttggcgatctgaatgcggtcatgcgccttgtcgagggctgtgacggcgttttgcatcttggtggcatttccaccgaggcgtctttcagcaagatactgaacgcgaatatcgtcgggatgtacaatctctacgaggcagcgcgggcgcatggccgtccgcgcatcatcttcgccagttccaatcacacgatcggtttctatcgacaggacgaatatatcgacgcaaaggcgcccacgcgaccggatggcctttacggcgtttcaaaatgcttcggtgagtccatcgccagcctctatcacgacaagttcgggcaggagacggcaatcgttcgcatcggttcctgttttgaggagccacgcaaccatcgcatgctctccacctggatgtcgtatgacgattttgccagcctgatcgaatgcgttttccgggcaccgatgctgggatgtcccgtcatctggggcgtttccaacaatgattcgatgtggtgggataacagccacgcccgtttcctcggctggcatccgaaggacaatgccgaacgcttccgcgccggactggagaaggcgaccccgcggcccgcgccggattcagcgctcgcggtctaccagggcggcgcatttgtcgacgagcccatccatcaggatgactga

SEQ ID NO: 44265 - DNA, 654 bp, Glycine max
  Peptide Sequence Number=SeqID_135950
atgatgcttccccgcgaaggcctttatattgaccccatcgtcaagattctacggaagacgattctccatccgattttcactttgacatgcctttacttcgttaagtcaagcgcttgtgcgcaatatgacaaacccgctcaactgatcgcaggcactagtgtcctcctgtggcttaacgattggttaagtgccaaaagccggaacaattgggtcatagatgatagctgggattggaagaaagagctcgtcgtcgtgactggagggagtggcggtattggtggtggagttgcgcagcgtctcgcgactatgggggctcgggttgtcgttttggatattatccccttgagctatgagcctgttgtagtcaacaatgctggtctatctcgtggccagacagtggtcgagggctcctacagtgacaacatcataaccctgaagaccaaccttctggcacctttcctactctcaaaagaattccttccatctatgatccggcagaaccacggccacattgtcaatattgcgtcgatgagtgcttatattccacccccaggcattgcagattatgccgcgtcgaaagctggtttgattgcgttccacgaggtatatctcaagtatctgctttcatcccgattgtctaacagattctcgtag

SEQ ID NO: 44266 - DNA, 294 bp, Glycine max
  Peptide Sequence Number=SeqID_135951
ctgggtcgtttgacatggagcagtatttacggcatgtggtttgccaggaggcggccaaccacagggcccatgtgcggaccaatgagaccctttaccagctgagcctcagcatgcagagccagggctttgcttctttttcatgccctactctagaccagttcagggcagaggtcgcatggcccggggattggcccgaggcccaggcaggagaggcactcccagaggctcccgacgatggagaggaggcccacgaggatgaggaaatgaccgatttgcttgacttcttgggaggga

SEQ ID NO: 44267 - DNA, 153 bp, Glycine max
  Peptide Sequence Number=SeqID_135952
atgactgaagcacgtcaaaagggggggagaagcttgccgcccagctcgcccaggcgagcaaggttgcttcctccagaagcaacatcgttctggaggaatcttctggagggcccaagtgggcctggttgctatttacaccctcatttttactaa

SEQ ID NO: 44268 - DNA, 426 bp, Glycine max
  Peptide Sequence Number=SeqID_135953
atgtcgaatgagatgcttcgacattttgtccaacagatgcaatctgatcaagcttatcgataccgtcgacctcgagggggggcccggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggtccctcgtgcgctctcctgttcctgcctttcggtttaccggtgtcattccgctgttatggccgcgttgtctcattcacgcctga

SEQ ID NO: 44269 - DNA, 382 bp, Glycine max
  Peptide Sequence Number=SeqID_135954
atgactagaggcaatccatctgacttacaaccctttgatcctgagatagataggacatttcacagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttatgcatccaataccctgatgaggatgtcccatatgttcttaaaactggactgattcatttgcttccaaagtttcatggccttgcag

SEQ ID NO: 44270 - DNA, 204 bp, Glycine max
  Peptide Sequence Number=SeqID_135955
atgaaagaaaacatgaatctggggatctcccggtcatgtagctccactccctcccaagaagtcaagcaaatcggccatcttcttgtcctcgtgggcctcctcgccatcgccgggagcttttgggggtgcctctcctgcttaggcctcgggccaatctccgagccatgcgacctctgccctgaactggtctggagtagggcatga

SEQ ID NO: 44271 - DNA, 459 bp, Glycine max
  Peptide Sequence Number=SeqID_135956
atgcgctcctgtccttactgcccgggtcgtgcctccggtgctgttactttgaagaaattagagtgctcaaagcaagcctacgctctgattctgatcctattgtgttggccttcgggatcgcccccccccctctttcagggacagtcgggggcattcgtatttcatagtcagaaaaaaaaatcttggatccccccaacacacaaaacaactgcgaaagcatttgccaaggatgtattcattaaaaaagaacgaaagttgggggctcgaagacgatcagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 44272 - DNA, 364 bp, Glycine max
  Peptide Sequence Number=SeqID_135957
ggtgaaacttcctgcttttattgttgaccacagagtgttacctggagatatgttatcggggttcaggagaccttggggacgtcaggcgagctcctggcagtcaacagataaaaggaacaaagaccacaaagcaaggaggcttgtggtggctggccagctgcttgaaaacgaagtcaggaaactaagggagcctctggagctaccttctgagcctgctgtggatgcccttgactttctagagggtgatgaggatccacttcttgaggtggattctcccgaggaagtcatgtcggcatctgaggcagactctacggaggatagcggcccgagggagatggcgatcagcggaggctcttcatcctag

SEQ ID NO: 44273 - DNA, 288 bp, Glycine max
  Peptide Sequence Number=SeqID_135958
atggtgaaagttggaacctgcgcttacggccgatcaacgtgctcattcgggcccaacccagctgttcccgcaacgaccgctgttcatttgcgaagctgggtttccgtcacagggcgcgctttccagtcgggaaaccatgtcggtgccaactgcttaatggaatcggccacgcgtcgggcgaggccggtttgcgctattgccagcggcgctaaggcggagtgtatactggcttactatgttgggatgcagggtgttccagtgaaggcgttctgtggaaaaaaaggctga

SEQ ID NO: 44274 - DNA, 435 bp, Glycine max
  Peptide Sequence Number=SeqID_135959
atgaggggagcactggcggaagagaacctctctcctttccttatgagaagtttcgacgcgcaaagtttcaagattatacaaagagaccacaaggcgtgggaaagcccgttaaggaaagataaagaacttaggggcatccgtaatggcatcatcggtggttatcatgaatggctgaaagttcgtacacgaggggttagattggctctccaattgaaagttatcaatgagggaacttcgaagctccggaagaggatgaagaaaggagttagctgcttgctcaaggtccaagagaagcttgtctcagcgtttatgcgagacagagaccaacatgttagccatcgtcagcaagtaccaagaagaattaaatctagccatggcccacgagcacaaagtggtggacgagtatgcccgagtgtacgcggaaaaggaggctag

SEQ ID NO: 44275 - DNA, 489 bp, Glycine max
  Peptide Sequence Number=SeqID_135960
atgaaaagatggtgggctgcgcaccctcaaagctttgcagatttggtcttcgccagtgaaaggatcaatgtgggtccgaaaagaggcaaatttgatcatcctactaggacgactgagaaaactggggcaaataaagagggtgaggatgagggagaaacccatgctgtgactgccattcctgtacggccaagtttcccaccaacccaacaatatctttactcagccaataacaaactttctccttacccaccacccagttatccacaaaggccatccctaaatctaccacaaagtctgtctaccgcacttccaatgacgaacaccacctttagcacaaaccaaaaacaccaaccaagaaccataaccctatccaaggttcatcaacctccatttctccgagaatacgactcgaacgcaacgtgtgcttgtcacggagaagccctggggcattccattgagcattgtatgaccccgaagcataaagtgtga

SEQ ID NO: 44276 - DNA, 696 bp, Glycine max
  Peptide Sequence Number=SeqID_135961
atggctgaaaagagtttcgaagcaccggaaaaggacgaagaagtccaagctctcaaaaatgagttaggaaaggcgagacttgccaaggagaagttcaagttagccgctacagacatccggaaagagtgtgccggattacgagaagagaatgcaactaccgcaagagcccttgaacaagagaccaagagggctcgcaaggaagagtatggtcgtaacaaatttcgcggagctttgtggggtagcaacagtgaactcaagctgcgaagggaagaaatagaccagtcgcgagcacatggcatggtcttgaaagaggagttagttgcctgttcaaggtccaaaagaaactcgtctcagcgtttgtgcgagacgcagaccaacatgctagctatcatcgccaagtaccaagaagagctaagtctagccacggcccacgagcatagggtcgcggacgagtatgcccaagtatacgcgaaaaaagaggctaaaggaagggtgatcgactctttacaccaagaggcaaccatgtggatgaaccggtttgctcttaccttgaacgggagtcaagaacttctccgattgctagccaaggccaaggcaatggcggacacctactccgcccccgaagaaatccacgggcttctcgactattgtcagcatatgatagacttaatgacccatataattagaaaccgctag

SEQ ID NO: 44277 - DNA, 471 bp, Glycine max
  Peptide Sequence Number=SeqID_135962
atgggtgaagtggaggaggtccaagagcaggtgaaggccgacacggaggccttgaaagagaaaatggccacaatgatggaggccatgatgagcataaaggagataatggaggtcaatgcggttgcaataaccgctaccagcaccattgctgagtgcaaaaacaagcatgcctttccaccatatgacttgcttcccaactatacaccacacaatgtggcatacactcccaacgaggatgttaataactctcctcccatactcattgaaagccaacaatctcaaactgatcatgcacatgtctctcaaaccatgggggagacacatgaaattccccaccacaatctagctgacttcgagccttgccttggatatgccattgaagggcaagcagttggtggtatacccctgcaaaacactttggagggccctcagtatcacccacaaccacaccccttgcattccacatggtag

SEQ ID NO: 44278 - DNA, 291 bp, Glycine max
  Peptide Sequence Number=SeqID_135963
atgcacccaacatttttcatgagtcatgtacatagggactcattaggtaggaataatcaacatgaaaatacagaaaaaggtacgctttattgcattactttccctaattttttaaatagtgatcaaagggttcccacagaccctaagagaataaaggtcattcctgaatggcctactccaccaagtgtcgagggaaggagcccagagtatgaagaacctcgggatttgaggtcaaatcctttccaaggtggaggggatgatgcaatcctacaccccaagggtattggatag

SEQ ID NO: 44279 - DNA, 555 bp, Glycine max
  Peptide Sequence Number=SeqID_135964
atgaccaccctgacccagatctggatgaccttgctgctcagcaacatccagcccaacgatcctaattccgacctccccctgccgaagtgtcagctggtgtacgccatcctgacacggatgagcattcacgtggctcagttgatcgctgatgccatctatctatttgtaggtatggagcctaccaggcaccatctggacccggataagtccaacagggccctgggatttctcgctttgatcacaggactctgccagtcgttcggaatccccgtcacacctagcaaggcggccaaccaccaggcgcatgtacagacccatgattgtctttaccagttgagcctcagcctgcagagccaaggttttacttcttttccataccctactcaggatcagtttagggcagaggtcgcatggcccggagattggcctgaggctcgggcaggagaggcaccagcagaggcacccgcagaggctcccgacgaggcagatgaggcccgcgaggatgaggaaatgaccaatttgcttgatttcttgggagggagaggagccacatga

SEQ ID NO: 44280 - DNA, 711 bp, Glycine max
  Peptide Sequence Number=SeqID_135965
atgttgaacaaaatcactggatataccaccgttgatatatcccaatggcatcgtaaagaacattttgaggcatttcagtcagttgctcaatgtacctataaccagaccggtcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggaccacttcttcgcccccgttttcaccatgggcaaatattatacgcaaggcgacaaggtgctgatgccgctggcgattcaggttcatcatgccgtttgtgatggcttccatgtcggcagaatgcttaatggattacaacagtactgcgatgagtggcaggcggggcgtaatttttttaaggcagttattggtgccctagaaatattttatctgattaattaa

SEQ ID NO: 44281 - DNA, 930 bp, Glycine max
  Peptide Sequence Number=SeqID_135966
atggccccaaggaagcttgcctcaaagagatccaggaaagacaaggcggttgaaggaaccagttccgctcccgaatatgacaaccatcattttaggagcgctgagcaccagcagcgcttcaaggccatcaaaggatggtcattccttcgggaaagatgtgtccagctcagggacgacgagtatactgacatccaggaagagatagttcgccagcggtgggcatcgctggttacccccatggccaagttcgacccagacgtagtcctcgagttttatgccaatgcttggcctagagaggagggtgtgcgagacatgcgatcttgggtgaggggtcagtggatccctttcgatgcggatgccctcagccagttcctgggataccctttagtgctggaggagggccaggagtgcgagtatggccagaggaaaaaccaggccgatgggttcgatgaggaggccatcgcccagttgctgtgtataccggagcaggatttttctcggactgctgctgggagacgggtgcggatcatgcgcaccaacatgactactctgacccagatatggatgacgttgctactcagcaacatccagcccagcgaccataattctgacctccccctgccgaagtgtatggcgcctaccagacaccctttggacccggataagtccaacagggccctgagatttcccgcattgatcataggactctgccagtcattcggagtcctcgtcgcacctagcaagagacaggcccagggtgatgctccacaggccgcagacgcgtcgccacctcatcaggctagcccagctgggtcatttgattcggagcagtatttacggcatgtggttcgccagcaggcgaccaaccatcgggcgcacgtgcagacccatgactgtctctaccagttgagcctcaacctgcagagctag

SEQ ID NO: 44282 - DNA, 297 bp, Glycine max
  Peptide Sequence Number=SeqID_135967
atgtcgaacagatgtccaggacaattccttgaggaacccaactatgaatactggaaagcaaggatggtgcttcctgcacaatgcacaaagctggataggcacgaacctgtcgaacgagctgtccaaaggctgggaacatcttgcccaaagatagctggacacagaaggggatctctagagtgcagattttcaggaagaatgatagatctcatccagcacaagctgttgcagcccatattcacacactgctataaaaacatggaggctgcacgagttctgtaccaagtccgggattga

SEQ ID NO: 44283 - DNA, 271 bp, Glycine max
  Peptide Sequence Number=SeqID_135968
atgccacgatggcatgaccttgctgggggggacgagcatcctgtaggactgacagaggcccgtaaccagagctggaaacccccagggccctgttggactcctccgagtccacttggtgtcttgtgggcacgatccctgcaaatagtggatggcatcagaaatcaaatgttgctaagtaacaacgtcatccatatctgtgtaagagtgttcatgttggtgcgcataatccgcactcgtctcttcgcagcggcacgagtgaaatcttactctg

SEQ ID NO: 44284 - DNA, 216 bp, Glycine max
  Peptide Sequence Number=SeqID_135969
atgtgttatgtacaagattcattggaggagcagacgtcacagggttcctttgtcccccatggatgtcgggatctcttgactgctgccattgggcgaccagaacaccctggtcgtgtgtgtgctgctggagccggtgtgaccatcaagcaatactttggatcggctccacaaacctcccacacttcttcctccatggctcccgaagaactagaatag

SEQ ID NO: 44285 - DNA, 351 bp, Glycine max
  Peptide Sequence Number=SeqID_135970
atgggtttttcctcatttgattctgcttcatacaaagtgtttaagcccgacaagcatggcaccttctggatcttttctaacccgtttcccacggaaaacacaagagttgtgaggttgaggaagggagcaaagtttccgatggcagctattagtgaggatttgataaagaccacactgacagtgcatgcagagaaaccagatttcaaagagactatcttgaagcatttggatgccatcaatgataggataggaacaagaaacattgtgctggagcttatgagcaccgagattgatccaagtaagccagcctttcacaactcaccattcgaatcattttctttttctagctag

SEQ ID NO: 44286 - DNA, 324 bp, Glycine max
  Peptide Sequence Number=SeqID_135971
atgggtctgggcaaggacagccacgggaatgccgatgtggttgacattaggggtaacccgcacaaatatgggttggggtatgagcccgggaaacctaaaagaaggaaagcaccgccaagactccgggcagatagggcatggcccgatcatgttagccagtgtttcacaagtgccgggataatgttcgaggaaaaggtggtggcaataggagaagaggctccacaagatccgccgagtttcgtgcgaccgttccatcccaatttccaattggggaactggcacgcgacgagccagtcggaagtctataccgttgattcaatgtaa

SEQ ID NO: 44287 - DNA, 394 bp, Glycine max
  Peptide Sequence Number=SeqID_135972
agggctacacgcccttgccttcagaggactgcacgtgctcgccttcagagggcttcacgtcctagccttcacagaactgcacgtccttgccttcagagggctacacgctctcgccttcagagggcttcacgtcctcgccttcggcggagtgcacgtcctcgccttcacaaatctacacgccctccccttcaaaggattgcacgtcctcgccttcagaggactgcacgccctcgccttcaaagggcgatgtcgcaacctacccttcgaagggagggcgacgcgtgactcgcgggatgcgtgttccacgaaaggaatacgcgcggagtcgccaccaacgtttattcgaggaaaacgtcggaaaaaccggaaaagacgcgatctacgaactttttag

SEQ ID NO: 44288 - DNA, 99 bp, Glycine max
  Peptide Sequence Number=SeqID_135973
atgtcttgggaattggaaaggaggattggtgccatctccttgaagaatttgagtcaagaagcaaggggccaaccacctttattgagctatttggactag

SEQ ID NO: 44289 - DNA, 222 bp, Glycine max
  misc_feature (151)..(151): n is a, c, g, or t
  Peptide Sequence Number=SeqID_135974
atgacagatcttgtaagtgcggaagatgatgtaaatctccgcgtgtcaacgggcttgtcggccgcgattgacgaagggtgcagaatgaccataatttgtctctacgtgccatcggacacaactgtgtctgaatggaaaaaaggcccaccgnctctgaatgacaaaagggtgcagaatgaccataatttgtctctgcgtgccatcggacacgactgtgtctga

SEQ ID NO: 44290 - DNA, 837 bp, Glycine max
  Peptide Sequence Number=SeqID_135975
ccgggcctcaaccgcgtgatccgcgccggttacgccctgctcaacctgcagacttacttcaccgcaggcgtgaaagaagtacgtgcctggaccatcccggttggcgccaccgcaccgcaggcagccggtaaaatccacaccgacttcgagaaaggctttatccgcgctcagaccatcgcgttcgaagatttcatcacatacaaaggtgaacagggtgcgaaagaagccggcaaaatgcgttcagaaggtaaagagtacatcgtgaaagatggcgatgtgatgaacttcctcctggctgcaaccaacggtactccctggatatacagcaatttaacttatcctgatgaacgaaagagcgcactcatgagccgataccatgttgctggcagtgaaggtaagtttgaaaaagactcaggcgagcaggtcatggccaataagctggggctcaccgattccactgagatgaacgaggcagaacttgttctgttagaacaactctaccagtcagtttttgaagaaaactttcccgaagggaaacttaacgtcgcgctactaaaaagctggcatcgccgctggctgggtaacatctacgaatgggctggacaagagagaacggtcaatattagcaagggtggttttatgtttgcgccttcagcacaattgccaaaactgctgaacgaatacaacaagtatcttgcgcattacacgccctgtaacgtcatggaagaagaagaactcatcattgctatcgccgttacccatgtcgagctgatacttatacatcccttcagagaaggaaacggacgtttgtcgcggctgttagcggatgtcatggcg

SEQ ID NO: 44291 - DNA, 570 bp, Glycine max
  Peptide Sequence Number=SeqID_135976
atggctccgagaaagctttccacaaagagatctaggaaggacgccgcagccgaaggaactagtgccgctcccgagttcgatagccatcgtttcaggagcgctgaacaccagcagcgtttcgaagccatcaagggatggtccttccaccgagagagacatgtccagctcagggacgacgagtacatagatttccaggaggagatagctcgtcggcgttggatgtcgctggtcactcccatggccaagtttgatccggatatagttctggagttttatgccaatgcttggcccaaggaggagggcgtgcgggacctgcgatcatggagagatgcaagctccattggagcttgtaggcctaggatcttcttcatcaatggattcctttgcttcttggaagatgaatggcagcggaatggagaaagggagagagagaggagatgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 44292 - DNA, 836 bp, Glycine max
  Peptide Sequence Number=SeqID_135977
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattctttttctctgcaggattgaagaattgttgcagatcaagttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44293 - DNA, 686 bp, Glycine max
  Peptide Sequence Number=SeqID_135978
ttggccccagggcttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44294 - DNA, 790 bp, Glycine max
  Peptide Sequence Number=SeqID_135979
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattgggaattagttgaaaaacctcaacatcagaaggtgattggagtaaagtgggtgttcagaaaaaaggagaatttgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44295 - DNA, 111 bp, Glycine max
  Peptide Sequence Number=SeqID_135980
atgcccagggcacagaattccacagcacaccacagtgcctatttcaagaaaagagctctggaggcagcaagaggagcaacttttgcagagatacctaggttttctggctaa

SEQ ID NO: 44296 - DNA, 926 bp, Glycine max
  Peptide Sequence Number=SeqID_135981
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtagatattgtcgagttggatcctgtagtgtacgattatgccaaatcgtatttcaatctctctacatcttgcttggcacatattggtgacggtcgtcactttattgatcacgttgctactcctgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44297 - DNA, 213 bp, Glycine max
  Peptide Sequence Number=SeqID_135982
atgaagcttcattatgaccagagtgatgagcaaaatgacggcgacagcgacgaagtctatttcgttgaagcctttgggaagagacgacaccgtgagtgcaccatttggcggaggagattccgattgtggtgcctaagtacgctgtcaagcctctggcgacagtggcattggaaagcacggaccaaaggtgacacggaggtagctgaaggcgcc

SEQ ID NO: 44298 - DNA, 676 bp, Glycine max
  Peptide Sequence Number=SeqID_135983
atggctggtgttgcaggaacaaagaaacgcgcaagactgtttaagcagcttcagacacagatccaaacagaaatcgccattggaaatccaagtgaaggagatgtgagggatgcaatagagaaggttttggctctagacaaggcttatccactccccttgttgggtggtgcaatgctcgaaaagtttccagcaaagtttgaagcagctagatggtggccggaaagtagattatcaagcaacgacgaagacaagataatggagattaagaacaacaataataatggatggaatgtggagttggaagaggaaatgagggaggttattgaagtgttgaagagaaaagacatggaagactatgagaggttagggaatattgcactgaagaaaaacaagggttttgctgtttcagcacctttgctcacaggaattgttgcactagggtctgtgttttcaggagatggattagttcctgcccttgctggggcgttggccacggtggttaatgcttttgagcatggagggcaagttggcatggtgtttgaaatgtacagaacctgtggtggattttttcagctgttggaggagacaattgaaaccgcaattgaagagaaagacttggacaaaagagaaaatggagagctatttgaaatcaagatggctttgcaattgggaagaa

SEQ ID NO: 44299 - DNA, 301 bp, Glycine max
  Peptide Sequence Number=SeqID_135984
atgggagaaggaaacattagaaatcagtacaaggcacaaataaagaatgttctatatgttgatggactaaagcataacctcttgatcattagtcaactctatgacaagggcttcaaaattgaattcaacaagcattgttttcttattgatgaagctatatccggtgaggttgtccatattggaaaaaggataggtcatatctatatgttaaaaattgaacatgcatcatttcatgagcttagttgtttgggctacacagataaacatgcatcatctcaatcatctagtcagaaaagactta

SEQ ID NO: 44300 - DNA, 555 bp, Glycine max
  Peptide Sequence Number=SeqID_135985
atgtcatgcataattttaaagtgcgtcaaaacaacgatcagtacaaagtttgtgatcaccaatctaaattggtgttttattggagcagctcttgtaaggcagcgtgttctagatgacctcccttttagaagatacaggtttgttggattcgccgatgttgtggctgggcaatttgtacctggcctattggttgatgaggttgtctttcgccatgtttcaggaaaaggtagaaggccagcaattgctatcttgcactttgtgggacaattattgcttgcatttttaaagttcttagatgatcatgaaggtcatagcccaattacagttctattgacccatggtagaataaaggaagttcaaggatcttatccgccatcggttaacaattctttcaaggcttcaaagttagttattaaccaaccggtgatggagattcaagaattcaatgaacggtttgcagagttgggcattgaggcctggtcattttttaaatcccatggtgaaggcagttcacaactttcaggttctatccaattatcatcggggatcctctag

SEQ ID NO: 44301 - DNA, 180 bp, Glycine max
  Peptide Sequence Number=SeqID_135986
atgaagaaagttagctatgaaatgcttcttagtccaatagctcttaaggtggttgaccccttgcttcttgactcaaactcttcaagggatggcaccaatcctcctttccaattccctatatggcaattcacaaacaaggaaacaaagagacaagcaataaccaaagaccaaaaaacatga

SEQ ID NO: 44302 - DNA, 669 bp, Glycine max
  Peptide Sequence Number=SeqID_135987
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccctccacgatcagccgcgcatcgtcgcgggcagcctccaagagatcgccgtcgctctccagccgtgcgaggcggaaggcggccatgccggattgacgcgtgccgagcacctcgccctcgccgcgcaggcgcaagtcctcctcggcgatgcgaaagccgtcctcgctcgatcgcatcatctcgagccgcgccttggcgacctgtcccagcggaccgcgatagaggtaccgagctcgaattcgtaa

SEQ ID NO: 44303 - DNA, 240 bp, Glycine max
  Peptide Sequence Number=SeqID_135988
atgcttcctttcgactgccggcatgtcacagaacttcacagactgcctaatgatgggtgccaagtacctcaaagtggtcaaacgagggtcgcattccaacaaacggatggtcctcggacgaaattagggtatgacagtaataccggtgtgcggaccgatgacgtaggatttacgttggtggatcttaacaaactcgcttaccagaatgatcctttcatcatggcagaacaagcgaaatag

SEQ ID NO: 44304 - DNA, 104 bp, Glycine max
  Peptide Sequence Number=SeqID_135989
atgacagaatttgttccttggcaaaaacagttcaacaaagtgatgaacagaatggacaggaggagccacgatgtcacaacatcggtctcgacatcaggaaccag

SEQ ID NO: 44305 - DNA, 384 bp, Glycine max
  Peptide Sequence Number=SeqID_135990
atggaatcagaactagcttcagtaccagattcaacttcttcgataataggatccacgtggtgtatgaagaagaatatggagaagggaaggaacggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 44306 - DNA, 108 bp, Glycine max
  Peptide Sequence Number=SeqID_135991
atggagacctacggcggttcgtggtggctactggtggttgagggtgcttttaccgagacagcttcaggcagcttccttaagaagctttctcgtgaggcttctttgtga

SEQ ID NO: 44307 - DNA, 189 bp, Glycine max
  Peptide Sequence Number=SeqID_135992
atgggtacctcaaagccttacactagggcaatgaggggcatcacgcatgagcctcaagcgagcataggggcagatcaaaagttctcatccatccatggtggacccttgggtactagtaccctcgccttttgtgggctacacgccctcgccttcagaggactacgcgttctcaccatcagaggactacac

SEQ ID NO: 44308 - DNA, 447 bp, Glycine max
  Peptide Sequence Number=SeqID_135993
atgacatcggcagaaatgcagttgagaagagaaaggggcctatgctttacttgtgatgacaagttttcccctagccatcgttgtcctaataagcaatattttgttccacagtgggaagaagaggatgaacctgcattacaaccagatccaccagacgaggttgagacagctggtgaccccagtttgcaagatcatcatttgtcttataatgctttaaaaggctcatcaggttttggtggaaatggaaatgccttcactgctgaaggattaattcaagacttggaggtgaaaatccaaggtcatacactgaagctaccagtgtacctacttccagtttctggtgctgatctagtgctcggggctgcatgttttacttgggtaatcaatttatcaccttgcatggcgagagaccctctctacgacaacaggctcaatttaatcacctga

SEQ ID NO: 44309 - DNA, 915 bp, Glycine max
  Peptide Sequence Number=SeqID_135994
ctgcagaaactgcagaagcagaatgtcgacagcatcgtcattgatctgcgtactaacggcggcggcgcgctgaccgaggcggtttcgctctctggcctgtttattccgagcggtccggtggtgcaggtgcgtgacaacaatggtcgcgtgcgtgaggacagcgacaacgacggcatcgtttactacaaaggtccgctggtggtgctggtcgatcgctttagcgcctcggcgtcggaaatctttgccgcggcgatgcaggattacggccgcgcgctgattgtcggcgaaccgactttcggtaagggcacggtgcagcagtatcgctcacttaaccgcatctacgatcagatgctgcgtccggaatggccggcgctgggctcagtccagtacaccattcagaagttctaccgcatcaacggtggcagtactcagcggaaaggcgtcacgccagatctgctgatgccgaccggtgtggaagcggcagagaccggcgagaagtttgaggataacgcgctgccgtgggacagcatcaacgcagcgacctacaccaaaaccggcgatatcacgccgctggtgccgcagctgaccaaagagcacgccgatcgcatcgccaaagatcgcgagttccagtacatcatgaaagacatcgcgcgtttcaacgcgatgaaggacaagcgtaacatcgtgtcgctcaatctggctcagcgcgagaaagagaaccacgaagaagatgcgctgcgtctggaacgtatcaatgcgcgctaccaggcggaaggcaaagcgccgctgaagagcctggacgatctgccgaaagactacaaagagccggatccgtatctggatgaaacggtgaaaatcgctaacgatttggcccagctggaaaaagatcagccagcgccggcggcagcgaagtaa

SEQ ID NO: 44310 - DNA, 411 bp, Glycine max
  Peptide Sequence Number=SeqID_135995
atggcggatgagatcgatcgctatcagccggattacgtggtgctggcgaaatacatgcgcgtgctgacgccggcgtttgtgcagcgttatcccaaccagatcatcaatattcaccactcgttcctgccagcctttattggcgcccgtccttatcatcaggcctatgagcgcggcgtgaagatcatcggtgccaccgcgcactacgtgaacgacaacctggatgaaggcccgatcatcatgcaggacgtgattaacgtcgatcacagctataccgctgaagagatgatgcgtgccggacgcgacgtggaaaagaatgccagtggcgggattcccgagcggccaaagggagcagactgtaaatctgccgtcatcgacttcgaaggttcgaatccttctcccgccaccatctga

SEQ ID NO: 44311 - DNA, 210 bp, Glycine max
  Peptide Sequence Number=SeqID_135996
atggcaaagattaaaggtcaggttaagtggttcaacgagtctaaaggttttggttttattactcctgctgacggcagcaaagacgtgttcgttcacttctctgctatccagggcaacggttttaaaaccctggccgaaggtcaacaagttgagtttgaaattcaggacggccagaaaggcccggcagcagttaacgttactgctatctga

SEQ ID NO: 44312 - DNA, 3163 bp, Glycine max
  Peptide Sequence Number=SeqID_135997
tattctgctgagctccttctcgtcgcgtctcggtatcccgattctggtgatcttcctggcgctggggatgctgaccggcgtggacggcatcggcggcattgcttttgataactacccggtggcctatctggtgtccaacctggcgctggccatcattctgcttgatggcggcatgcgcaccaaggccagctcgttcaaggtggcgcttggtccggcgctgtcgctggccaccgttggcgtgatgattaccgccggcctcaccggcctggctgccgcctggctgtttaagctcgatctgatgcagggcttcctgattggcgccattatcggctcgaccgacgccgcagcggtgttttcactgctgggcgacaaagggcttaacgagcgcgtcagttccacgctggagattgaatcaggcagcaacgatccgatggcggtgtttcttaccattacgctgatcgacatgatccagcaggggcagagcggcctgagctggatgtttgtggtgcatctggtgcagcagttcggccttggcattgtgctcggactgggcggcggctgggcgctgcagcaactgatcaaccgcatcagcctggcgcaagggctctatccgctgctggcgctgagcggcggcatcattgtgtttgccctgaccacagtgatggaaggcagcggcattctggcggtctatctgtgtggtttcctgctgggcaacagcccgattcgtaaccgccacggcattctgcaaactttcgacgggatggcctggctgagccagattggtatgtttatcgtgcttggcctgctggtgacgccgtctgacctgtggcatatcgcgctgccggcgatgattctctcactgtggctgattctggtggcgcgtccgctgtcgattctggtcgggctgctgccgtttaaaggctttaccggacgtgaacgcatctttatcagttgggttgggttgcgcggtgcggtgccgatcatcctcgcggtgttcccgatgatggccgggctggagaattcaaaactctacttcaatatcgccttcttcgtggttctggtatctctgatgctgcagggcacgtcgctgggctatgccgctaaacgggctaaggtggtggtaccgccgaccgcgtcgcccatcagccgcgtcgggctggatatccatccggaaaatccgtgggagcagttcgtttaccagctcagcgccgacaaatggtgcgttggcgccgcgctgcgcgatttacaaatgccgcgcgaaacgcgcattgccgccctgttccgcgataacgcgctgatgcaccccaacggcaatacgcgtctgaaagagggtgacgtgctgtgtgtgattggccgtgagcgcgatctgccggcgctgggcaagatgttcagccagacgccgccggtggcgctggatcagcgcttctttggtgactttatccttgatgccgaggcgcgcctgcgcgatgtcgcgcagatctatggcctggagctcgatgaagagactaacgatcagcagtcgctcggccagttgattatgggtctgctcggcagcacgccggtggtgggagatcaggtcgagtggaaccagctgacgtggacggtggcggaaaaagaggataaccaaatcgtcaaaatcgggattggtcgttacgagatcgtcgatgcagtaatggatgtggagaagctggataccgtcggcatcccctgtcataccaaccccggcctgagttatcagctcgacggctgggatcatgaaaccagcgtaccggcgtggattgatggcgaaccggtcgatctgcaaatcggccactatgacaagcagcaagaccgctggggtatttggggagaactggacagttttattccgccgcagcaaattgaataccgctttgtcgcacagttaggtctgtcagtgctgtgcacggcctggttctgggtgcgtatgcgccactacacctaccgcaaaccgttctggtttgagctgaaagaaatcgtcaaaacgctgtttgtgttttcgctgctggatctggcgctgattgccttttccaaatgggacttctcgcgcatggtgtgggtatttagctggacttatgccctgctgctgctgccgctgatgcgagccggcgtgaagcgtgccatcaatcgcgctggccagtggcaaaaagagaccattatcatcggctccggtaaaaacgccatggaagcctacgcagcgctgcagagcgaggagattctgggctataacgtgcaggcgtttatctcgctggatgatgagcctcaccaggaaagtgttaacggtgtgccggttattacctggaaagacatcaactggcaaaccatggaccgtgacaacacgcaatttatcgtcgccaccgaatttgaacagcaggtggtgcgcgataaatggctgaagtttctgtccaaaatgaaatgccgctcaatttcggttatccctacgctgcgcggtgtgccgctgtatggcaccgatatgtcgtttatcttcagccatgaagtgatgatcctgcgcgtcagtaacaacctggcgaaacgctcctcgcgtttcctcaagcgcactttcgacgtagtggttgcctccctgctgctgctgtttcttgccccggtgttcggtctgctgtgctggatggtgaagcgcgatggcgggaatgccatttacggccacgaacgcgtcggtcaggatggcgtgaagtttaagtgcctgaagttccgttcaatggtgaccaactcacaggaagtgctgcagaatctgctggccaccagtgccgaagcgcgcgctgagtgggatcgtgatttcaaactgaagaatgatccgcgcatcaccaaaatcggtggcttcctgcggaaaaccagcctggatgaactgccccagctgtggaacgtcattcgtggcgaaatgagtctggtgggaccgcgtccggtgattgaagccgagctggaacgctacgccggcgatgtcgactactatctgatggccaaaccgggcatgaccggtctgtggcaggtcagcgggcgtaacgatatcgactacgacacgcgcgtctattttgactcctggtacgtgaagaactgggcgctgtggactgacatcgccatcctgttcaaaaccgctggcgtggtgctgcgccgcgacggtgcttactga

SEQ ID NO: 44313 - DNA, 810 bp, Glycine max
  Peptide Sequence Number=SeqID_135998
atgggtgaattaccgattctggtgatcagccatccgaaagtacgcgccgccattgccctgcagggtgcgcacctgctggcatggcagccggccggtcagcagcccgccatctggctcagcgacaagacgccattcgtcagcggaaaagccattcgcggcggcgtgccggtctgctggccgtggtttggtccggcaggtgaacctgcgcatggctttgcccgtaatcagccatggacgctgacggcgcatgatgagaacgaagatgcggtcatgctaacgttcacgctggagagtaatgcacaaacgaaaaaactgtggccgcacgatttcacgctgctggcgcgcttccgcattgctgaacactgtgagattgagctggaagcctggggcgactatgaagccactgccgcgctgcacagctattttcaggtagcggacattgcgcaggttgaagtcagcgggctcggcaacagctatatcgataaggtgcaggacaatgccatcggcagcgcagcggacggtaaacaaacctatcccgatcgggttgatcgcattcataccgcagcggaagactgtagcgtaatccacgatcgcgcaggtaagcgccagattgaagtctatcaccattatcaaagtgacgttgtcacctggaatcctggcccggcgctgtcctgcagcatggccgatatgcctaatgatggttataaaacgatggtgtgcgtggagacggcgcggattaacaagccgatgaaaagtgccggagaaacccctgcccgccttggcgtcacgctgagaatccgtaataagtaa

SEQ ID NO: 44314 - DNA, 2085 bp, Glycine max
  Peptide Sequence Number=SeqID_135999
atgaacccgacatcggggcagaccgcataccggctgccctggctacgtgaatatggagagtttatgcgcacattgtggcgaattattgctggcctgttccgctggagctggcgggtgctgaattttatccgggaatttatcctgaatctgttcctgattgtgttaattctggccggcgtcggcatctggctgcagctatccagcgccagcagcagtgaaccggtgcagcagggtgcgctgaaagtcgatctgagcggcgtgctggtggacaaaccgtcggtcagcaatcgtctgagccgcatcagccgccagctgctgggtgccagcagcgatcgtttgcaggaaaattcgttgtttgatgtggtcgatgccattcgtcaggcaaagagcgataaaaatatcactggcatggtgctggatctgcgcgattttgccggcggcgatcagccttcgctgcagtacgtgggtaaggcactgcgcgaattccgcgacgcgggcaaacccatttttgccctcggtgacagctatagccaggcgcaatattatctcgccagctacgccacgaaggtctatctgtcgccgcagggcacggtggatctgcacggtttcgccaccaacggcctctattacaaatccctgctggataagctgaaagtcagctcacacgtgttccgtgtcggcacctataagtccgcggttgaacctttcctgcgtgatgatatgtcgccggaagcgcgcgatgctgatggccgctgggtcggccagctgtggcagaactacctcaacacggtgtccgccaaccggcaaatcacgccgcagcagctgttcccgggggcggcgggcatcatcagcggtctgcaggccgttcagggcgataccgctaaatatgccctggataacaaactggtggatgtgctggattcgcgcgctgccgccgatcgcgagctggtaaaaacctttggctgggataaagccagcaacgactaccgcaacgtcagcatctatgactataacgtcaaacaaccgacgcagcaggatggcaacattgcggtaattctcgccagcggcgccatcatggacggcgaagagagcgccggcaacgtcggtggcgacaccaccgctgcacagatccgcgacgcccgcctcgacgacaaaatcaaagctatcgtgctgcgcgtcaacagcccgggcggcagcgtaacggcctctgaagccatccgtgaagagctggcggcagcgcatgacgccggtaagccagtggtggtttcaatgggcggcatggcggcatcgggcggctactggatctccacgccggccgactacatcgttgctgcgccgagcaccctgaccgggtcgatcggcatctttggcgtgatcaatacggtggagaatagcctgagcagcatcggcgtgcacagcgatggcgttgccacctcgccgctggcggatgtgtcgaccaccaaagcgctgccggctgaagtgcagcagctgatgcagctgaccattgaaaacggttatcgcaactttgttggactggtggcggtgtcacgccataaaacgccacagcagattgatgccattgcgcagggtcacgtctggaccggtagcgatgctaaagccaatgggctggtggatgcgctgggcgacttcgacgatgcggtggccaaagccgccgagctggcgaaggtcgcgaaacctgaactgagctggtatcaggacgatccgggaatgatcgacctgctgctgaaccagatgaacgcgtcagtgcaggccgtactgccggccgcgctgaaagtgtggctgccggcaccggtcagcgaagtgatgggaacgctgcaggcgcagccgggcctgatgaataatctcaacgatccgcaaaaccgttacgcgttctgcctgacctgcggcaactctgagtccattcatgcaaaagaaaaatatctatgtagcctacacgggcgggaccatcggtatgcaacgctccgcgcagggttacattccggtctctggccatctgcagcagcagctggcgatgatgccagagtttcaccgtccggaaaaatgccggaatggggaatcctctag

SEQ ID NO: 44315 - DNA, 1254 bp, Glycine max
  Peptide Sequence Number=SeqID_136000
agagggcaacatgccctcgcctttagaggactgcgcatcctctcctttagagggcttcacatcctaaccgtcagaggcctacacgtcctcgccttcatagggctacacgccctcaccttcagaggattgcacgtcctcatctttagcagagtgcaagtcctcacctttagcagagtgcacgtcctagtcttcagagggctgcacgccctcaccttcagagggctacatgccctcacattcagaggacagcatgccctcgcctttagatggcttcatgtcctcagcttcagaggactacacgtcatcgccttcagagggctacacaccctcgccttcagaggactgcacgtccacacctttagagggctacacgccctcgccttaagaggactgcacgttctcgccttcagcggagtaaacgtcctcgcctttagagggctgcacgtcatcgccttcagggggctacacgccctcaccttgagagggctacacgctctcaccttcagagggctgcacgtccttgccttcagaggactgcacgtcctcgactttaaagggatacatgacctcaccttcagaggattgcacgtccttgccttcaaatggcttcatgtcctcgccttcagagggctacacgccttcagtgggcttcatgtcctcacttttagaggattgcatgtcctcaccttcagaggagtgcatgtcttctccttcagagtactacatgtccttgccatcagcggagtgcacgtcttcgccttcagaggaccgcacgtcctcacctttagagggctacacgccctcaacttcagaggatatcacgtcctctccttcagagggcttcacgtccttggcttcgaaggactaaagatcctctcctttagagggcttcacgtcctcgcctttagaggactgcacatcctctcctttagagggcttcacgccctcaccttcagaggattgcacatcctcgtctttagaagagtgcacgtcctcacatttagcagagtgcacgtcctagtctttagagggctgcatgccctcaacttcagagggctacaccccctcacctacagagggatacatgccctcaccttcagaggacagcatgccctcgcctttagagggcttcatgtcctcgccttcagaggactacacgtcatcgccatcagagggctacacgcccttgcctttagaggactacatgtccacacctttagagggctacacgcccttgccttaagtagactgcac

SEQ ID NO: 44316 - DNA, 222 bp, Glycine max
  Peptide Sequence Number=SeqID_136001
atgttcgtaaggaagaaatggcctcgaggaagcttgcctcaaagaggtccaggaaggaaaaggcggccgaaggaactagttccgctcctgagtatgacagtcaccgctttaggagcgctgtacaccagtagcgcttcgaggccatcaagggatggtcatttctctgggagcgacgcatccagctcagggacgacgagtacactgatttccaggaggaaatag

SEQ ID NO: 44317 - DNA, 147 bp, Glycine max
  Peptide Sequence Number=SeqID_136002
atgaatgctaagatcaaaagtgaatccacagataagagcttcaaggtcaatggacaccgactgaaaccattcctcacaaatccctccttagtggatgtagtggtggaagagacctccttacttcaccctacttctcttccgtcatga

SEQ ID NO: 44318 - DNA, 282 bp, Glycine max
  Peptide Sequence Number=SeqID_136003
atggaagaccccctcccccttaatgatcgtcttatgattatgctaatcgatggagcgtttcatgcatctaaggttgcggcaaaggctgtcactctgtccattaggcaacaatttggtcggccttggcctacttggggagtgattccaaaagatcatcatgatctttttttccagcgttttaagagaaaattggtctggagacctgaggaatacaatgaaattaaaaacgcttttcactcgaaagcatctcatagactttctaagatgtttagggatgcctga

SEQ ID NO: 44319 - DNA, 471 bp, Glycine max
  Peptide Sequence Number=SeqID_136004
atgctagctatcatcgccaagtacgaagaagagttaggtctagccacggcccacgagcatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgctggaggccatgttaggtatgaagcagctcatggagaagaacgcggccactgccgccgct

SEQ ID NO: 44320 - DNA, 432 bp, Glycine max
  Peptide Sequence Number=SeqID_136005
atggtcccgcaatggtttaagcttgcggttgtacccttccttaggcaacttaaccacagtagatctcccaccggaacttatgatcggttccgtctcggtcgtgcctttgcttctgttgcctctgcgttttctcctgagtatcagcaacctgcccatggtaccgccgagataggagatgtaccgctgactgggttcaggacacaaccatcgtccgaaccgtcagctaccaagtcccatgggggcctttggttggaacccataacaaacttaaaaagcacttctgccggtcgacaaatgcgtgctccggttgtagcagtgttgaatgaacggcaggtttggaaccagaccggtgctcctcttcatttgttcccgttaacgaccacaaagcccttaactgctcctcctcgctacttgcccttttttactacaaag

SEQ ID NO: 44321 - DNA, 771 bp, Glycine max
  Peptide Sequence Number=SeqID_136006
gggcattgatctctggccagatgaccttatagcccagtctaatacttctagacttgggttccttgctctaatcaccgcattatgtagagccagatgggttgtctctgatagcctcacttttgagcgcttgatcccggtcattaatttggcctacatcaggaagaactgggctaggagggcgagggcaaggctagctaagcttccttctacttctgcagctcctactccatcatccacttcagcagccccttttgtcccagttcagatagattctcagcgctttgaagccatgcttcagagcattcatcagggacaaatcattttactacaaagtttacagatgatggcacctccagactctattccttcagtagagcagtttaatgagatagtagcctggcccaggacccaaccttctcttcacagggaagatgaaggtcccacagcccaggtacctcagcatatggaggatgagtcatctgaggccaccatcccagagccatttgttataagagaggaggcagaggagacacaggtgagacaggtagttgctgccacacctaagcgatcccttgaggctacttcagagccttctgcacaagaggaggatataccctcacctcagcacgcaacagacccctttattcctcttatagagatgccagaggacccgactacatcagtcctggctatggacacttctcctccacctactccagtattgcatctgacagatgaggaggatgttcagacacaggacacccaggacca

SEQ ID NO: 44322 - DNA, 519 bp, Glycine max
  Peptide Sequence Number=SeqID_136007
atgggtcaacttcaacggcaagccttccgcaagcctatggacttccagctagtgccgactgtgaaagagtttgaagaaatccggggatgcccactgggaggaaggaagccatatcttttctctgggttctatccctccacgacaagagttgccaagtaccaaggaagtgtttggaggaaaggtcaaaggccttggcaaatcaaggcgaatgggctttcttttattgacatcttggcacttttgatctttggagttgtcctctatccgaatatggaagggttagtggacctagcagtgattgacgctttcctcgtctttcagcatgacaaggaaagcccggtcgccgccattttggccatgtatgacacgttcgaccggggatgtgaaaagagcggcgcaagaattgaaggacgaatcgggattctatcttcatgcgaaggatgtcccatgagaggagtgccatcagacgaaagcatcacgcctttcatcgcacgaggttacagtgaacacaatgcaaag

SEQ ID NO: 44323 - DNA, 480 bp, Glycine max
  Peptide Sequence Number=SeqID_136008
atgtcgtgtggatttgggatgaccgaccctctcgatgagtcgatctcttgctttctcataagggtggacccttgggtactagttaccctcaccttcagaggactacatgtcctcactttcagagggctacacaccctcgccatcagaggactgcatgtcctcaccttcgtagggctacacgccctcacctttagaggactacacgtcctcgccaacagagggctgcacgccctcaccttgagaggactacacgtcctcgccttgagaggactacacgtcctcaccatcagagggctgcacgccctcacctccagaggactacacgtcctcaccttgagagggctacccgccctcgccttgggtactagttaccctcaccttcagaggactacatgtcctcactttcagagggctacatgccctcgccatcagaggactgcatgtcctcaccttcgtagggctacacgccctcacctttag

SEQ ID NO: 44324 - DNA, 690 bp, Glycine max
  misc_feature (568)..(568): n is a, c, g, or t
  Peptide Sequence Number=SeqID_136009
atgaacttaatcattgttatcaaaaagaaaaggacacgctttacggcgcctgaccgaactcgtgctagagctagagtaatgggtgaagcagaggaggtgcaagagaagatgaaagccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatgcacgccttcccgccatatggcctgcctcccaactatacaccacccaatgtggcgtacactcccaataagaatgtcaataactccactcctatacccattgagagccgacaaccccaaactgttcatgcacatgtctctcaacccatgggtgagacacatgaaattccccatcacaatctagccgacttcgagccttggctcggatatgccactgaagggcaagcagttggtggtatgccccttgaaaacacttcggaaggccctcagtatcacccacaantacacctcttgcattccacgacaagtaaaaaccctcatgctatggcagaaatgggaaagcttggatcatctagaggaaaaggtcagggccatagaatgaggcgaagattatgccttagctaa

SEQ ID NO: 44325 - DNA, 123 bp, Glycine max
  Peptide Sequence Number=SeqID_136010
atgatgctcgacatagttctctatacaggcaatggtgcgcgcaaaaagcttagcaaccatgtcagcttcagtgcggctcctttacgtgcattttcaggagggacttcccctagtaactcgtga

SEQ ID NO: 44326 - DNA, 321 bp, Glycine max
  Peptide Sequence Number=SeqID_136011
atgctggctactggtaatcgattactaccttctggtaatcggttaccagagattaaaactctttgtcattgcttccacacttgtaaaatcctttacaagcaaagagccacaaaggatgtaccctcccttgttaatgaggacaaggcaaggaataagggcaaggaacctttagaaggacttggaggacctatggcaacggctagaacaaagaaggccaaggaagctcttcaacaagtgttaaccatgctatttgaatttaggctcaagttacaagtggagaagcttcggattgttaattgcaccatgttccaagaagagtag

SEQ ID NO: 44327 - DNA, 696 bp, Glycine max
  Peptide Sequence Number=SeqID_136012
atggatgtggcgacccctaggaggtttatctatgaggccctacaaaagggaggcgtaattccccacggtgggcatggggaagattcctgtttgatgcatcccggcgagctacataacatggaaacatgtttaggagtggaggacatgttgcaacagatgatagatcgaggccggctggaagtcggtgatgaggggagtgaagagcagcatatatgtatgcggtctgcagatgagagaagttttggaaggcctaagcctttggtggtatatttcaccagagacgcagctccccaaacgccccgatacccctcagtagttaaacctgttccgtttgcataccgaaacagccatgcagttccgtggaggtatgcgcctccgagcgaaaggaacgaagaagccactgacatcaactcattatcggccaaggtaaccaatatcacgggactgagcggcatgacccgcaacagtcgcgtgtttgcaccccctgacctgctgacacaacccgcaaacgttaaaggaaaggcaaagataacggaaggaaaagatgacaaaataatccccacttcgaatgagaatattccagtgaaaggtctttcggagaaaaaggatggatgtggcaagaaagaagtatcgctagaggagacaggcgagttcctccgcattattcagcaaagcgagttcaaggtcattgagtag

SEQ ID NO: 44328 - DNA, 432 bp, Glycine max
  Peptide Sequence Number=SeqID_136013
atggtggaaccatcaaagaagcgcaaagctttttattctaatcttgaaattcaagaaagtaccttgatttcagaagtttatgggataaagatggtcattgaccaatccctcttctatgatttgacccaattgtctagtgacaatgtaccatttgaaggtgcactggacgatgattggaagtttgatttttctgtacatgatgcccgccggttggtttgcaccaaccaagcggatatgaccggaaggctgcttgccggttcattggctcttgaaagccgtatccttcactatcttatagttcgcatcttactccaaagatctttaaaccttgcacaggtttctgaagaagatcttataatcatgtgggcctttcataccggccgactaatgataaaaatatcaataatactcccagctcttccaactccttaa

SEQ ID NO: 44329 - DNA, 402 bp, Glycine max
  Peptide Sequence Number=SeqID_136014
atgaactttgtaaggagtggcacaaaacaagctgagaaaagagcaaacacatgtgcccactatgatgaattgataatgaataagcaatactatattcattcagcatcgcagaagacattacggtctcatcaagaggtcattgagtttttgctcgacgtagaaattcctcgaaaaggtggtagcaagaaagcaaaggttgtcggggctgtagataatcagaacattcaagaaatcatgtcaaacacaatcaggattgagaaattcaatgaaaagaacagcttcaatctgtggcgcatcaagatgcatgctttgttgaaggaacaacgtgtgtgggctcctgttgcttatgcatctgtgaagaaagaagtggcttctgaatcaaaagaaaaggcctttatttaa

SEQ ID NO: 44330 - DNA, 399 bp, Glycine max
  Peptide Sequence Number=SeqID_136015
atgggatcaagtcaaaagccttcgcttaaaaagaggttctatcaagtcaaaatcaagagcttagaggtcaccagtttacgaaagttggggcaattaatgggtcaacttcaacggcaagccttccgcaaagcctatggacttccagctagtgccgactgtgaaagagttggaagaaatcctgggatgccaactgggaggaaggaagccatatcttttctttgggttctatccctccacgacaagagttgccaagggcaaagaccttggaaaatcaaggcgaattgggaccaacttttagcaagcaaagaaggagcatctgtcaactggttccctcgatggaaggaaggaagaaccagagttcttatttcatgcggaggatttccaaatgttcccttgatg

SEQ ID NO: 44331 - DNA, 168 bp, Glycine max
  Peptide Sequence Number=SeqID_136016
atgggacttatcaaggtaatccttgtggcgtctacccggacttatcttccttcaccggaagtggcgtctaccctgacttatcttccttcaccggaagtgactctaaagcctgtatcaagcgatccgctcctagtcaggttcacatcaagatcaacgatcgaggtttaa

SEQ ID NO: 44332 - DNA, 203 bp, Glycine max
  Peptide Sequence Number=SeqID_136017
atgagtgttgatgctccccaaccccaggtcagaatagcaatcaacaaaatcttgcaactcataagcattgggctcagctccattgaaacggtcggtgggagacagaatggagttgaagtcaccaatgaggagccaggggcaattcatattagcattgatactattccagatttatccaaagaggatcttcttgccataatgga

SEQ ID NO: 44333 - DNA, 420 bp, Glycine max
  Peptide Sequence Number=SeqID_136018
atggaggccatgaaagagcaaatgactacaatgatggaagccatgatgagtatgagaaaaatgatggaggtcaacacggctatagtcgttgccgcaagtaccaccactgaggtggacccgattcacccatctggcctctatcaagtccagagtaagcattccttctcaccatatggcttgcctcccaactatacaccacccaatgtcgataactccgctctcatacccattaagagccaacaaccccaatccagtcatgaacgggtccctcaacccatggaagagacacttgaagtaccccgagaccacactctagccgacttcaagcctcacctcggatatgccactgaggggcaaacatttggtggcatacccctaccaaatactttggggggacctcagtattgcccacaaccataa

SEQ ID NO: 44334 - DNA, 776 bp, Glycine max
  Peptide Sequence Number=SeqID_136019
atgttcccgacatcaagaggaccaagacatcagggaaaaaggtgcctgataacgtccctgatgcaccattggacaacatctcattccactacattggcaatgctgagaggtggaaattcgtgtatcaacgcagacttgccttggaaagagaactgggaagagctgccttggattgcaaggagatcatggacctcatcaaggctgctggactgctgaaaactgtcaccaagttgggagactgctatgaaagtctagtcagggaattcattgtcaacattccctctgacataacaaacagaaagagtaatgagtatcaaagagtgtttgtcagaggaaaatgtgttagattctcccctgctgtaatcaacaaataccttgacagaccaacagatggagtggtggatattgctgtctctgagcatcaaattgccaaggaaatcactgccaaacaagtccagcattggccaaagaaagggaagctttctgcagggaagctgagtgtgaagtatgcaattctgcacaggattggcgctgcaaactgggtacccaccaatcatacttccactgttgccacagggaaagttgctgcttcaggtgctgtgtccaaggatgctctgattgctgaactcaaggacacatgcaaggtgctggaagcaaccatcaaaggcaccacagagaagaagatggagctggaacggctgatcaaaaggctctcagaaagtggcattgatgatggagaagcagctgagcaagaagatgaagcagctgaggaagag

SEQ ID NO: 44335 - DNA, 186 bp, Glycine max
  Peptide Sequence Number=SeqID_136020
atgcgtaaggagaaaataccgcatcaggcgccattcgccattcaggctgcgcaactgttgggaagggcgatcgggttttcccagtcacgacgttgtaaaacgacggccagtgccaagcttgcatgcctgcaggtcgactctagaggatcccctcactcccgactggcgatgtcccgccccacataa

SEQ ID NO: 44336 - DNA, 325 bp, Glycine max
  Peptide Sequence Number=SeqID_136021
agtattcataacttggctcagcatcggcccatcatcagcatggaggatttcatggctcaggtggcctggccaggagtccagccttctactttgggggaaggtgaggcttcttacatcccaggagctgcagccagaggccaaggcccagtcggaggtcacactagaggccactctagggacttcgcctgttacgacaccacttgtggaggtctttgaggaggatgatggcgctacaaacacatattatgcagcttatttagcagtgatgcagagcacctgggatccctggcctgctacagctcaggagacatctcagccagcctag

SEQ ID NO: 44337 - DNA, 99 bp, Glycine max
  Peptide Sequence Number=SeqID_136022
atgaaacagcagcactgcccctggggctgcaacttaagaggttgtttgataggttatcatttgctactggtaattcgcgttgctctggaaggtctttga

SEQ ID NO: 44338 - DNA, 315 bp, Glycine max
  Peptide Sequence Number=SeqID_136023
atgagagtacatccggaggtacccgcacgcacacttcagcagcctgtggattggatactacctacacctactccatatcgactagttgagccggttcaagtgatagaggtgtcatcctctaaagaggatcttgaagagaacctagaggagttacctcctgaacctgctgtggatgcacttgacttacctatggatgatgaagacccactcattgatgttgattctccagaggatattatgtcagcatccgaggcagactctacagaggagagtggccctggagggacagcgaatagtgacgactcttcatcatag

SEQ ID NO: 44339 - DNA, 692 bp, Glycine max
  Peptide Sequence Number=SeqID_136024
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctgaatgcagaaaccaccttcagaaagaaagacatttgattggggagaatggagatggtgaagcccttcagaagtatttggtgaggatgcaagaacaggatgggaacttcttctatgcaattgagtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaaaccg

SEQ ID NO: 44340 - DNA, 518 bp, Glycine max
  Peptide Sequence Number=SeqID_136025
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgctgcagaattctcattttaccgaagatagtagtactgttgaaggacctcatgatggaaaagatgtcaagcctggtgcggaggaaccaaaggacacttctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 44341 - DNA, 354 bp, Glycine max
  Peptide Sequence Number=SeqID_136026
atggtggtcatcgtgcccaaggaacacctagttgtgtggttttgtttattgcataacaggccagacaactaccttaaggggataattatcagtgctttaaaaggtcttgatgatgctccacaacctaaatcaaaggctccggctaggtggattgtcgccaagtgtaatagacaaaaaggaagtactgagtgcggctattatatcatgcactggatgtccaccatcattttaggaagtttcaggaataactgggaagcgtattttaacgatcctagaccattggagccagagagattaaaggcgctgcggatccagtgggcacattattatctccgagttagagctcagagctag

SEQ ID NO: 44342 - DNA, 356 bp, Glycine max
  Peptide Sequence Number=SeqID_136027
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccgattaaattgttattctccgtacggtggtccaacgacaagcaaaggcggctcatggcagtcatcggtggtcagtggtggtggaggaggaggttgggggtgttgggagagggtttaa

SEQ ID NO: 44343 - DNA, 273 bp, Glycine max
  Peptide Sequence Number=SeqID_136028
atgaggacgcgtagccctctaaaggcgagagcgtgcagtcctctgatggcgaggacatatagtcctctaaagattgactgtccttttggaaaaggtgataattcatgcaacccttatcctatcttttgcaaatctttccgagaactccctcagagtgttcgcttgaggtttatgcatggtgcctttcattgccctagtgtagggcttagaggtaccatcgttgtctttcgtcatgaccttgtagcaaggaacctattgggtgagaacttctaa

SEQ ID NO: 44344 - DNA, 153 bp, Glycine max
  Peptide Sequence Number=SeqID_136029
atggacttgatgagggctgctgcttggaaagctggaaaagaggatgccttgtcatccaagtcccttgagaagagggactccagaccacattatagagagcaaaagaaagaatggatcccaaggtgtcactactgtggcaagtatggcacataa

SEQ ID NO: 44345 - DNA, 170 bp, Glycine max
  Peptide Sequence Number=SeqID_136030
gattttacttttgtcgttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 44346 - DNA, 393 bp, Glycine max
  Peptide Sequence Number=SeqID_136031
atgaggtttcactgtcatcaagcaagtcggagacttagcatgatcacagattcacctctacttcctatgttcccacggacccgggagggcgacgcgagactcacgggtgcatcttccaagggaggaaaatgctcagagtcgccaccaacatttattttgaggaaaacgttagaaaaatcaaaacatgcgtctacgaactttaagtatgaaaggttcaggagttgtttttacacacggggaagggagaaaaataaatcccatgaagacagtacaagtggaggcttcaatcccttctctgtctctttgacgtttgggaactctatcggagcagttagaggaaaaaaatcggaggaatctcaggatacctctagagatgctgctattgctggctga

SEQ ID NO: 44347 - DNA, 300 bp, Glycine max
  Peptide Sequence Number=SeqID_136032
atgccttactttggagtgattgaagaaatctgggagcttgattatagtgaatttagagcacctctttttaagagtaaatgggtgaatggaaatacaggtgtgaatgtagatgaaatgggattttctttgaacaagcaacacaggtgttttacatccaagatctgcaagactcaagatggtcagtggttccacaaggaagaacaaatagatttaatctccaaaaacatgatgcaacacttggtatttgtgagacgcattctttctccacacaatttccttccagaattgaagaacaagtag

SEQ ID NO: 44348 - DNA, 183 bp, Glycine max
  Peptide Sequence Number=SeqID_136033
atgagtgtgaggtcgtggaggggagaggccctgatggactcttcggagtgtaagccttggggggtcaccgtgtttgagtgctcctttaagcctatgctgatcccatatgattggagcattctcgcaaaacatcgtgaccctgactggtctccctatgatcttactttagtgagagtgacctga

SEQ ID NO: 44349 - DNA, 252 bp, Glycine max
  Peptide Sequence Number=SeqID_136034
atgtcgcgaaactttacggattacctaacgatgggtgttaagtaccttgaggcggtcaagcgaaggttgcatgccaccaaaaaatggtccccggatgaaattaggaacatcattgggccagtcaatatcccaaccagcggaacctgtcattcagaaggaaagaaaaggcatcagaagcgtcaacaaaacttcagtgtcttgaaagcgataaagtgggacatccaggacatttctccacgccatcgaacttga

SEQ ID NO: 44350 - DNA, 627 bp, Glycine max
  Peptide Sequence Number=SeqID_136035
atggccttcattattggagaatcatttggtggtggccatacccgggaaggtcttccagccaccctaccccaagtggtacgacccgagtgccaagagcaaggcccaaatgttaaaaccaacccgctagctagtcatggaggggctagcgtgaacgccgtcaaagaggacgggccatcgcaggcaaagaggttaggagagcggctcatagattgcgggcagcttgaagtgtccataggagggagggaagaaccacaaatttgcatgcagtcggaagagaagaaggttcctctaacccccaaggccctagtgatatgttttactaggaaggggaccggctccacacccatatacccccgaacggcacccaagccaacaccttttgcatatcaaagtaataaggccgttccgtggaagtatacccctcccgcgtccagcgaaagagttgcaaccgaagttgactccctatcagctaaggtaaccaacatcaccagcctcagtggcgtaacccgcagtggtcgggtgtttgcttcccctcacccggcggaattaccctctaaagggaaagcgcccatggtccaagagcccacagatatagccaccccctcgaaagaagtagatcctccagtg

SEQ ID NO: 44351 - DNA, 237 bp, Glycine max
  misc_feature (143)..(143): n is a, c, g, or t
  Peptide Sequence Number=SeqID_136036
atgactaaagcacgtcaaaaggggtacagaaaggttgaacatttttgttctgccctcctccccctatttatagggaaaagagggaggtggttgccactcaactcccccaggcaagctaggttgcttccacctgaaggcaccgncttctattggaagatcctggaagacccaagtgggcctgattgctatttgtaccccctgtttactaaatacaccccctatgcccttttttgctaa

SEQ ID NO: 44352 - DNA, 747 bp, Glycine max
  Peptide Sequence Number=SeqID_136037
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccatctggttcgccggatctccctcctcacccacctcttcgaggagattaaggaactcagcaacaacgttgtcggtggttcttcttcttctccttctccttcttcctcggcttcttcaaagtgtcttctgagtggatcctctagagtcgacctgcaggcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 44353 - DNA, 159 bp, Glycine max
  Peptide Sequence Number=SeqID_136038
atggtcatcataaaaaagggggagattgtagaagcaaagcttcatggtgatgacaaaaagctcaaagatcaatcaaagaacaactcaagtgaatcaagaacaagtcaagagttcaagataagaatcaagaagaattcaagactcaagaagaaagtctag

SEQ ID NO: 44354 - DNA, 399 bp, Glycine max
  Peptide Sequence Number=SeqID_136039
atgcacaacaaatttgtgcattcagggaatacatctttcactgcattcatcaatgtttggtctctatcagtgacaataactccagggagggcatcacgctttaaaaaaaggtctcagaagcgttgtaaagcccataccaaattattaacacgttcaccctccacatatgcaaaaccggcagagaatgtcatcccagtcggtgtcaccccaacaaaatcgagcaatgggagtctataccgggtgacaccaaaagatatcacgaaccacgtcttcatcctttattctgtgccaataaaatatattgatcacgttcaagaagcttcatcaaatgttgcatttcaagatcgcttcctcttatggaagaacggaatgcacttcttgcattgtatatctgtttaa

SEQ ID NO: 44355 - DNA, 493 bp, Glycine max
  Peptide Sequence Number=SeqID_136040
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatcccg

SEQ ID NO: 44356 - DNA, 233 bp, Glycine max
  Peptide Sequence Number=SeqID_136041
cccatgggcccgaaatctaccctaaggctcatgagaaccctagggccttctcttgcatctccagttcaatcttcttggagtcttctatccaatgcccttgcggggtaggattgcatcaaggagccttaacatactgtggtggttccatatctactgcagctcactttgaaaagctgtcaaaggagtttcaaagaccaccaactgcttgggagatgatggagaaaactaagtaa

SEQ ID NO: 44357 - DNA, 1249 bp, Glycine max
  Peptide Sequence Number=SeqID_136042
ggatttccagcacttcggcttcggcctcggtgaggatgcccttcttctcgtccgggatcagcatgtcgtcgatgccgatggagacgccggcgcgggtcgcgtacgcgaagccggtgtacatcagcttgtcggcgaacacgaccgtgtccttcaggcccagctggcggtagctggagttgatcaggcggctgatgttcttcttggtcagctcaacattggccagcgcgaacggcaggccttccggcaggatttcatccagcagggcgcgaccgatcgtggtgtccacgatcgaggtcttgttctgcttgttgccgtcttcgtcggtcaccacctcggtgatgcggaccttgaccttggcgtgcagttccaccacgcggttgtcgtaagcacgcttgacttctgcgatgttggcgaaggccatgccctcgcccttcttgttttccagcgagcgggtcatgtagtacagacccattaccacgtcctgcgacggcacgatgatcggctcgccgttggcgggcgacaggatgttgttggtggacatcatcagcgcgcgcgcttccagctgggcctcgagggtcagcggaacgtggacggccatctggtcaccgtcgaagtcggcgttgtacgcggcgcagaccagcgggtgcagctggatcgccttgccttcgatgaggaccggctcgaacgcctggatgcccagacggtgcagggtcggcgcacggttcaggagaaccggatgctcgcggatgacttcggcgagaacgtcccagacctcgggcagctcgcgctcgaccattttcttggcggccttgatggtggtggccataccacgaccttccagcttgccgaagatgaacggcttgaacagctccagggccatcttcttcggcagaccgcactggtgcaggcgcagggtcgggcccacggtgatcacggaacgaccggagtagtccacgcgcttgccgagcaggttctgacggaagcgaccttgcttgcccttgatcatgtcggccagcgacttcagcggacgcttgttcgagccggtgatggcgcgaccgcgacggccgttgtcgagcagggcgtcgacggcttcctgcagcatgcgcttttcgttgcgcacgatgatgtccggagcagccaggtcgagcaggcgcttcagacggttgttacggttgatcacccgacgatacaggtcgttcaggtcggaagtcgcgaagcgaccgccatccagcggaaccagcggacgcag

SEQ ID NO: 44358 - DNA, 303 bp, Glycine max
  Peptide Sequence Number=SeqID_136043
cacttctgcacttggatcctaaatcacctgaagctcaagctggtaatcaaattggtcagaaatccaatggtggttctatcagtccttcgcccactacttctgttgaaggaagttcccagaatggtagaaagcaagggacagatgaaacggccacagctaagaagaatagtgcgtcttatatcgggaagagattgttagaaagaaccttgaccaatgattccatcataaatttctttactgatccttctgctccacaaaccattgactccacacatagttctgtagcattagcacttatggagg

SEQ ID NO: 44359 - DNA, 417 bp, Glycine max
  Peptide Sequence Number=SeqID_136044
atgattggcaagcgggtttgtctttatgttgggccggtcctcttgaaatgtcagtcatccggtttctatcaaactttgggctttgcgtttgagggccacgcactgttcggtagagtggcccgggattttcccacggtatgtgcaggttgcgttagggttataccaccttgggaaaggaggctggaagatctttccgggagatatcacagccatctagttggcgatgagggatggcaagaggtcttcgtacgtcatcgggattggggcgaattcttgagttggccttgggggaaagttccttgccgcgttagaatcgacgccaaggtgggcattgccggccaggcgagtctgggttggagccggagcttgagggcctccctctggacaggcgctgagttggaggagtcccggacgtga

SEQ ID NO: 44360 - DNA, 264 bp, Glycine max
  Peptide Sequence Number=SeqID_136045
attcaaaggactaaccgcctgagaattctttgtcccaacacattggaggataaaagtagagggtacatctacttggggattgttatactgagaacaagagagggtacatctcttgtggatcagttcaagtggaaggtacatccacttggttttttcaaagagaacaagggatggtatataccttgtggatctttggcttgtaaaggatttacaaggttgaaaagaaatctcaagaactgcaggttgcttggggactggatgtag

SEQ ID NO: 44361 - DNA, 282 bp, Glycine max
  Peptide Sequence Number=SeqID_136046
atgaggctgattaggtctgcaatcaattgttggatccaagcccaaagaagcctaaggtctagaaagtttatgagcactgctagcttcttcttcctcggaggaaggtgtgggtctgcttcttcttcgcgtttctgcttcttctttgcatttttgcttcttcttcgaggcgatggcggaaaccgctatcgggaagttgctgggctatttacggatcacctgatccataagcatcttccggatcaagttgatctggaagaggcttacagatcaagtgatccgtaa

SEQ ID NO: 44362 - DNA, 1434 bp, Glycine max
  Peptide Sequence Number=SeqID_136047
atggcagactggtctgaactcccaaaggacctcctacacaaaatatcacaactcctcctcgaaagccctctctacctcctccgcttccgatccgtctgctcctcatggcgttcttccactcccccgtctcccttcaacccctcaatctccctcaccaacaccttctccctctcccaccgcaccctcctcctcctcaaccctaactctaaccctaaccctaacccccgcccccgcccctggctcgtcaagctctccctcgacccacacgccagcaccgcgcgtctcttccaccctctctcccgcttccccatgaaactgccccgtttcgccctcgacctcttcaccctccccgccctcgacctcggccgcgagttcctcctcaccaacacgcgccacacccgcgactccctctacattgaaaagctcgtcttcctccctctcacccatcgaaaagaccgttttgccctcctcacgatccacgtctccgggaaactcgccctcttccgctccggcgaggacggctggaccgtgatccccgacatgccgaccccctacgacgacgtctgcgtctttaagggcaacctctacggcgccgacagtaacggccgcaccgtcagggtgcggccggatgacggtggcctcaccctcgccgccgagcctgtctttggtggcgacaagaagttcctcgtggagtccgagggcgcgctgctgctcgtcgacatgtacctctcctactactcctgcacgcagggtttgttccacgaggatttcgacgaggaagatgtggccgggatggggtgggagaggacggtgaagtttgacgtgttcaggctcgacgaggaggggaagaagtgggtggaattgaccgatttgggggagagggtgttgttcttgggggatgattgtgctttctcggcttctgccaaggatttgaaccttgggagagggaattgcgtggcttttagagatgatgggttggatctcgcccttgtcggagtgtgccgggttttcggagttgttctgcccgccgccggattgggtcgggttgcagtgacacatcacacatgggcatcgtttgttgctagttctgttgttggtctacaaagctatatgcttctgtcctgtatttttcaaactaagggattgattagtgcatggctttcgagtgtttccatggtgaattgtgcttatcaatgtcatcaatggaagaacatggcagagggccaaaactccgccatatcaacatgctattacaccttatggtgccaccatgggcaccaagtcattggtacgagtagtattgggctcaatctccttaagcaagggggagggttcgagctttgtagatggaaaaaacgtggttgggagggtagtcccattaaaggtggccagccggattttctggcaaagattagtcatcagcaaagctggtag

SEQ ID NO: 44363 - DNA, 231 bp, Glycine max
  Peptide Sequence Number=SeqID_136048
atggccatgcattgttacatggcacacacattacgttttccatactcgagtccacggattcactcttgcacagagcttcaatattatgaacattcttgcttgtatctcgggctagaagagtcacaccatgatttggaattcctgttgactccaatggagtacgatgggcggggcaacgtttgctactacaacatggagcaagtgcacccagtggaggttacagaggactga

SEQ ID NO: 44364 - DNA, 231 bp, Glycine max
  Peptide Sequence Number=SeqID_136049
atgagaaaaatcaagaggctaagatctgataggggtggtgagtacactttgtttaatgacttttgtgaaaaagaaggtataattcatgaacatgattcaaaagaagaaaatttcaagtgctttggaagaaaattgatgcaaaaacttgaagaaaaagccttgaagaaaaaggtggagattgagacagttcgcttagtgcacaagacaaacccaacgagtctcttcacttag

SEQ ID NO: 44365 - DNA, 81 bp, Glycine max
  Peptide Sequence Number=SeqID_136050
atggcctctgtggagacctctgccatggctaggtcccagatcttaccactggcgactcctaggctcttgaccttgacttga

SEQ ID NO: 44366 - DNA, 744 bp, Glycine max
  Peptide Sequence Number=SeqID_136051
atggctgagtatattgcaccagtgattgagggtgctgttaaccacattgcctcaagaagatttgagtttggaggtattgatctaactaatttcctggctcaagaacttggcaaatccaatccgttagtgaatatcagcatctctgatgttgagaacataaaacagcaatactcgtgctgtgttgaagatgaattagcttatcagaagacccaaggttcctgccctgtggagacacatacccttcctgatggacaggtacacctattggttcctctatcaaataattattacccaatgcttgctcatttacttgttcctgatatatttgaccagaaacatctaaatttgtgctttgagctagtgtacgaagttattggtttcctacttgttgaatgttatgatcatagaggtggtggaaaggccatgaacctttcacaagggtgggcatgtgatggcggctttgaatggttgaacaatgatagtgggggctttgaattgaaccaaggtggtaggggcttcaaacagttgaatgtggcggtggtgattacaattggaagagaaagatatactgttggcgaagctttattccagccatgtctattgggtttggaggctcatggcattgttgagcagcttgtccatgctatttcaacggtgtcatctgaaaatcataggcaacttcttgaaaatactgtggtttgtggtggcacttcttctatgactggtaaaccgttatttcattag

SEQ ID NO: 44367 - DNA, 375 bp, Glycine max
  Peptide Sequence Number=SeqID_136052
atgaatctaaggaacaatttgaagaatcttcgacagaagcagaaaaatcttattctggtgaagaagaagagaagaagaaccaatgatctcaaagggttcatcctccaagccgaatggaggaaaaaacttattgagatgggagcatggctcgatacaaaattcatgaaagatgcagatccttacaaagtaattgaagaattttgttgtcggatgacgggaacattgaaagaatggtaccacaatctaggagctgtgcgtcaaaaccagttccatgaattgagatctgctgtagctgttctggaactctccatcaagaatgtactggagaaggaaagatcattgaaagaaagatcaaacaagaattgtttgaaatga

SEQ ID NO: 44368 - DNA, 1224 bp, Glycine max
  Peptide Sequence Number=SeqID_136053
atggccactctaagcttcaaccccgttagaataaaaacctcaacgttgaaacattccaaactcaccactactccatcaaaacccatcacaatcccatgcaccactccctccaacagccatcccaaactgctccacttccgaacccgttcggtgtccgagagcacccaccagaaagaagcacccgaagcggttctcggagaacatgaagaagaagaagatgatgatgatgacccaacttcggaactgagctacgtggacccagaaactgaccctgagagcatcacggagtgggaactggacttctgctccaggcccattctcgacgtcagagggaagaagatttgggagctcgttgtgtgcgacaagacgctgtcgttgcagtacaccaagtatttcccgaacaatgtcattaacagcattaccctcaaggatgctattgttgccgtcagtgaccagttgggtgtcccgttgcccagaaacattcgcttctttaggtcgcagatgcagacaattattacaaatgcgtgtaatgagcttcgcataaggcctgttcctagtaaacgggtatgtatggagaaattactttatggtctagaaccacatatccttgtcagaggtgccccagcatatactttatgtggttcatctgatccttttcagtgtgtgtcaataattctgtggctagaggagcgctatgagaccgtatatagaaagcatcctggatttcaagaaggatccaaacctcttttggcactagataatccttttccaacagaacttccagacattctttatggggaaagatgggcttttgtccaattaccttactcagaggagatatccacatttgagagaggagtttgtggttctgggctagatcttgaattattgggtcttgacattgatgacaagacattgatccctggactgtccgttgcgtcttctaatgctacagcattggcagctttgataaatggattggaggtttccgcggtggaagcggatgctcctcgtgctcgcctgattctttctgctggaatttctactcggtatatctattctacctataagaaaactcctgagacaactagtgaagctgaagcttgggaagctgctaagaaagcttgtggaggtttgcatttcattgcagtccaaccagacttggattctgaagattgtgttggcttctttcttttactagacttgccatttccacctgtatga

SEQ ID NO: 44369 - DNA, 3867 bp, Glycine max
  Peptide Sequence Number=SeqID_136054
atggggaagaagtctgagcctgtgataacaaaatgcaaagttggtgagaactggactaaggtgaccttcaagcctgacttggaaaagtttaagatggactatcttgaagaagatgtcgttgctttgatgaagaagcgtgtggtggacatggctgggtgtcttggaaagactgttaaggttgaactcaacggacaagtgatccgtatgaaatcatttcgtgactatgctgatctttacctcaaatcagtggagaaatccagaccagtgcctcttccaaggattcacgcaaaagtaggtgaaaggtgggagatttgcgtgagtctaagtgatgggcagtttcaacaggtcagctttgttaattccattgctacaatcaagggtgggactcatgttgattacgtcaccaatcagattacaaactttgtgatgaataaagtaaataagaagaaaaaggatgccaatgtcaaagctcacaacgtgaagaatcatttgtgggtttttgtcaattcacttattgacaaccctgcttttgattctcaaactaaggaaactctcacgactagactggctagttttggttctaaatgtgatattcctgagtcgatgctgaaggaagttgccaattctggtattgtggacaccctcctgtcatgggcagattttaagcaaagcaaagatctgaaaaaatctgacgggacaaaaactcagaggcttcgtgggattgtgaagctagaagatgccaatgatgcaggtggaaggaactcagagaagtgcaccttgatattaacagagggtgattctgctaaggcccttgctatggctggcctctctgttgtgggtcgagaccattatggggtgtttccattgagggggaaattgctgaatgtacgggaagccagcagtaaacagataatggataatgaggaaattcaaaatataaagaagattcttggactgcagcaaaacaaagagtacacaagcgtgaagtctttgagatatggtcatttgatgattatggctgatcaggatcacgatggttcccacatcaaagggctattgataaacttcattcattcgttctggccatcactgctaaaagttccatcttttatggttgaatttaccactcctataataagggcttttcattcaaacgggacaaaattatcattttattccatgcctgaatatgaatcatggagagaaagcttggggaataatgcaaatggttggaagataaagtactataagggtttgggtacaagtactcctcaggaagggagagagtactttcaagatcttgataagcataagaaagactttgtttgggatgatgagcaagatggaggtgcaattgagatggcattcagtaagaaaaaagctgaggataggaagatctggattcgtaattttgagcctggcacttgtcgtgatcatatggccaaatatataaactacagagattttgttaacaaagaacttatattgtactccagggcggatcttcagagatccattccctctatggtcgatggcctcaagcctggccaaaggaagattcttttctgctcatttaagaagaagttgttcaaagaaataaaagtaggccagtttattggttacgtttctgagcactctgcgtaccaccatggtgagcaaagtctagctagcacaattattaatatggcacaggattttgtgggtagcaacaacatcaatcttcttaaaccaaacggtcaatttggtactcgtaacctgggagggaaggatcatgctagtgctagatacatctacactgaactgagcactatcactcgttgcatattccatgaggatgatgacaagcttcttgaatacttgaatgaggatgggcggtgtattgagcctacatggtacataccagtcataccgttggttcttgtcaatggtagtgaaggaattgggacaggctggagttcttacattcccaattataatccaagggacatcattgccaatgttaggcgtttgttgagtggggagacaatggtgccaatggatccatggtacaagggattcaaaggaaccattgagagaagccccaaggaaggtggatacatagtcaatggctcagtggaggaaataaatgaacacaatttcagaatcactgagctgcctattcgcaaatggacccaagattacaagcagttccttgagtctataactgatgggtcacctaatgtcaaggatccattaattgatgatttcaggcagaatggtgatgatgcaactgtaaacatagaagtcaggatgaagcttgaaaaaatagtgggcatcatgcaagagggtctacttaagaagtttaaactcacatcctctattagcacaaacaacatgcatctatttgatgcagaagggaaaattaagaaatatgacaatccagaacaaattcttgaagagtttttccccctccggctggagtattatgagagaaggaagaaccatatattgaacaaccttgaacgacttttgctgattttggacaacaaagctaggtttatattaggggttgtgaatggagaaattattgtaagcaacaggaagaaagctgatttgttgattgagctgcagcacaaaggtttcactcccatgcctaggaaaggtaaatctgcagaaccccaagttgctggggcaaatgaagatcaagaagatgacaacactagagagcaggaaactgaaagtgttgaagtagcgaaaggaggtgactatgaatatttgttatccatgtcaattggaactttgaccctcgaagctgttcagaagctgctagcagagaaagcagaaaaagagaaggagttcaagattttgaaggaaacaccatcaaagtctctgtggttgaaggatctagatgagcttgagaagaaacttgatgacatagatagtatagaggccgaggaggaacgaaaaagatcaagtcaagcaaatagaaagaccaaagaagcttttacaaaagcagctaagaagccaccacaaccacggaagtatactaagaaggccaaaaatgttgagccagagaatgataattcttcaatggaagtcgagaatgttgcggaagtcgttaaaccaaaaggcagagcaggttccaacaatacccagaagaatactctgccggttgctgaggatgatgaaattctatcacttcaagaacggctagctgcatacaacttcggagcatctagtgatatatcagcgggcatggaaactgaagaacctcctgcacctgctgagaagaaagaggcgccaaaaagacggggtgctgctaaaaagatgtcaagtgccatagtgttggacgactcagatagtgataatgaaattcatgatgttgaggacgacgatgacaactttgaaatcatgcagccggttgccctagaagcagggaaaaagaaaggagggagaaagcctgctgctcaaaatgccaagaaggcacctgctgctgcttctaccaaaaagagaaacgtaggtggcaagcaatctcagttattgggtcaaaaactcataactgatatgttggaaagtacagggatatcaccagagaagaaagtgaggaagatgagggcgtctccatttaacaagaaaagcagttctgtgttgggaagggttgctgctgctgacaaagatgacagtgtaagtgaagacttgtccggtgattctgctggctcttctccaaggatcacagaggaggtggttgagattgcaccaccaccagcaagagctagaccccagagggctaatcgtaggcaaacgacatatgtactgagtgaatctgaaagtgacaatgattctgatgttgatgaagattattctgatttcgaggaagatgaagactag

SEQ ID NO: 44370 - DNA, 1594 bp, Glycine max
  Peptide Sequence Number=SeqID_136055
atggcagtgactcttacatcaacactctttctggctttgctatttgctgcttcagcttttgctgctcttcagcctagagtacctgaagcttacctccaaaatgggaactttgaggagcagccaaaccctaaatacctgaagaaaacaaagctctttggtaaatacgctttgcctaaatgggagatcaatggtctggttgagtatgtctctgggggtccccaacctggaggcatgttcttcccagtgactcatggaatccatgctgtgaggcttggcaatgatgcctcaatctcccaaagcatcaaggtcaaacccggtcaactgtatgctctaattcttggggcctcaaggacttgtgcgcaggatgaagttttgaggatctctgtgcctccacagactggtgatgttcctttgcagaccctttatagcctcaatggtgacgttattgcttgggggtttaaggccacttctagtgttgtcaaagtgactttccacaaccctggagttcaagaagatccatcttgtggccctcttttggatgccattgctatcagagagttctacccgccaatgcctacaagagttaacttggtaaaaaatcctggctttgaggagggtccattccccattttcaactcaaccaacggtgttctgctcccacctcaacaacaagatggcttctcccctctccctggttggattattgagtccctcaaggctgtgaagttcattgattcaaagcatttcaatgtcccatttgggctgggagcagtggagcttgtggcaggtagggaaagtgccattgcccaaatcatcagaacagttaccaacaaagtctacaacatcacattctcagttggagatgccaaaaatgggtgccatggatcaatgatggttgaagcatttgccgccaaagataccttcaaagctcccttcaaatctgaagggaagggaacattcaagactgtaagcttcaagttcaaagcaattgcaccaagaactagactcactttctacagctccttctaccataccagaattgatgactatggttctctttgtggccctaaagggtaccattggtgtgtggatgctgaagaggcgcttgacaaagacgaggaggtacatgatgacacggatgaggagctcaacctaagtgaaggtggatctaaagtgggagtttgcttcgatttggggttcatgggtttgccttatcattgtgggcttaatggagttcacactaaccacgctttgtcgtcacaacaaagacatcagcacgatctggatctagatttggagaggaaggttcaagataatgatggtgttggtggtggcagtggtggttgcaacgacattggtggtggttgtggtgacaaaggtgatggtagtgacagtgacaataatgatgatgttggtaacgataatggtggtggtagtggtgctagtgtcatggtggtgatagttagttttggcggtgacaacgatgttgatggtggtagtgtggtggtggcaatgacgaagatgatattagtggtgaagtatagtgatggtgatggtggtagtgacaatggtagtggtggtaatggtggtagcg

SEQ ID NO: 44371 - DNA, 504 bp, Glycine max
  Peptide Sequence Number=SeqID_136056
atgacatacaacctcttgacagatccatataaagatgaatatcttttatggacaatgttagagtggttttctcctttagcatggtggcgaatgaagctgaaacaaattatagacattgagagacaaagaggaatctcagaagatcacataggagaactagtttctattgtgattattcaccatccttactttatggagcaagaacaactctggtttagaaatgaagctcaaatttggagaacttttgaagcatatcccttggaagaaagttatcgcaaccagttggcaagacatctgggtgaagtcaacaattactcatacagacctttggatccaaatctaccaagttcatctcaaaggccaagggatagtaatcctactgataggataatacttcagaatactaatgacggtcggatcgacacagagatttatgttccagaacccgagtttcaaaaggtggaagatttgggtgatgactattctgcattagaacaagactga

SEQ ID NO: 44372 - DNA, 714 bp, Glycine max
  Peptide Sequence Number=SeqID_136057
atgaaggtcaacaaggaatgcgatgccctagactgctacgggaactgcctcacaaagatggtgacaataaagggagtcctcctcaatgccatcatcatcatcaacgatgagaaggaaaaccttagaggcgcatttgtggccgcggtggaacttctaatcgcaattgaagcaaaggccgtgctcgtgcccttcgaaggagtgggcagcaatgaaggaggggaagacacagggttgaccctaccacgtaatgcctggacctcaaaacggatttccggcgtgagtctagagatgaaacaactcaagaggaacgacgggggaaggccaataatgtggttagctaagttttcaaacttggagagggcttgtaggaagactgaccaagatatccaatcgagggggtcactgtcatcaaatcgcggaacatcaagtttcatgcgatgggagttcactgaagtggctgaagaaggagtagtagtcgaagaagatggggaagaagtggtagagtccttggtggctaaggtatggatctattcatcaagcttcagtgtcatggtgtggatggtctcactcagggataagtggttcgaagtgagcttcacaatggcatcctcaagcctgtcagaggacacctttgaacgggtggattcgaccatgggagagggacaaggagagcaccaaaatgttaggctcatcactcacaactctggactttga

SEQ ID NO: 44373 - DNA, 381 bp, Glycine max
  Peptide Sequence Number=SeqID_136058
atggtgcaggagtacgcagaagtgcagaaccaaagtcagaacagaacggaggaacaaaatagaacaggtgtcgcaggtgtaggagtaagcagaagtgcagaacattggagcagagcaacaacgacagcgctaggaacagacagtggccgaaaggcagagcagcaacgacgccggaacggacggtggatggaacgcagagcagcaacaacagtgctaggcggcacaaaaaaccgctccgccacgcttcgctgcaatagcggctgctccagccacgacccgaaaccgagccgctacacacgtgtccgtcgcggatgggtgcctctccgctccgccgctatagtggccgctattcacaacatagctagggacaaagaaaattga

SEQ ID NO: 44374 - DNA, 1503 bp, Glycine max
  Peptide Sequence Number=SeqID_136059
atgcaggaacaccagatccagatgcagaagtggtgtcgctctcacccaagacctttgctggaatcagattgttatgtgtgtgagatctgcaaccaggattctagagagaccagaaccttcagatgcacaggcggaggcacaagggcgagccctggtgcagcagtaaagttgtgccttggtgacttgttggtcatgggttcgaatccggaaacagcctctttgcatatgcaagggtttcttctctgtgctgtcgtcgctcatattgctcgtgagcgtaagcgcaatcgtcgtcgtcatctttcgtctctccgtcgtaaatctcagtttcctctttgtcgttcggtggcgtctttggtcattatggttagaacgggaggttcgggttggactttggacagggttataagaaaagctttagttgcacctgttgttgagcatgtggatcatgctactaaagaggtccatgaacaacctcaagaggcacctggtgatgatgtagttagtgttgtcgagggttttccaggcgggccttatgacacattagttttgatggactatgcttatcatgtgactgtgacagtttggaataaagaggaacatcctgagttgaagttgtcctcccatgtaaggaaggtagagaaatttggtaggcatgctcctgagattgaaggcttagagaggtggcataaggaaactagtagtttccatataccgataggagaggtgactatcaccctggatgatgtgacatcgttgctacatctgcccattacaggcgccttccatagctttgagactcttcatgtggacgatgtcatcttcctcttagttgaattgcttaaagtgagttttgaagaggacaagagttgggacggtataatgccacaaggcatatgttgcacactatttgctaacaagagtgccacacacgtgcatgtggtattcttggacgcatttcgtgacctgacgcaaagtggaagttatgcatcaggagctgctgcactggtccatatgtatgacattttgaatgatgcgtcaaagagcagcgctagacaacttgcaggatatatcacacttttacagcattttccttcaattgtttttgctattactgcaagagattatgatgagaggaaaccacatgcttgtcgttggaagtctgggaaagcattgtcaatgttgacgtattgtaagcatctggatgtattggtgtcttatgctatttgttggattccctatagtgaccatcgtgcattcagagagtttgagctgatatctttatttttcagacacatgtgttggggtccatctatcatcatacaccgaccagaaagggttatgcgacagtttgagtatgtgcaaaccattccaccacaccctgctactccatgtctatctgtagaagaaattgatgatagatggattcaattttttgaataccttgcactggtgggtcaagcatgtgttgcgcccagacagtgtgcaacagactacatggagtga

SEQ ID NO: 44375 - DNA, 249 bp, Glycine max
  Peptide Sequence Number=SeqID_136060
atgagtgacataaagcaagtacaggagcaaatgacaacgatgatggaagcgatgatgagcatcaggaagattatggaggttcagagcaaacattcctttccaccatatgatttgcctcctaattatacaccacacactgttgtatacgctcatggtgagaatatcagcagttctgcacccgtactcattgagaatcaacaaccccaacctgatcacacccatgcctttgtctctcaaaccatggggtaa

SEQ ID NO: 44376 - DNA, 459 bp, Glycine max
  Peptide Sequence Number=SeqID_136061
atgaaggaatgcacatggagatggaaaaggttagcaaatacaaatttcatcaaggcagaattaccacacttcattcctcacaaggctagtgtttccctcagcacacaaatgttttggctaagagtgtttttgaattcaacaactgaactaatgttcccatctttgcacttcttctctgttaaggttctaagagagcacctacctcatgtccttctgataacccactatcgcaacctaccctacgacgggcgtgtgggaaaaaagccaaaggagcgtctcccaaaaaggaaaacgcgtgggagtcgccgccaacgtttattcgaggaaaacgttagaaaaaccaaaaagacgaaaggaaaatgggcacttggggcaatggcagctcgcccaagcgagctgatgcttactcctgaagtaactgcctcgcccagccaagctggttccttcatcctgaagtaa

SEQ ID NO: 44377 - DNA, 984 bp, Glycine max
  Peptide Sequence Number=SeqID_136062
atggtagccataatccctgccagggttcctcaacctccatttttccgaggatacgactcgaacgcaacatgtgcatatcgtggaggagttcctggacattccattgagcactgtatgaccttgaagcataaggtgcaagccattggtttgtttgctcaagcgacctgtgctcctaagttttttgacttccaagaccgttcaatcagagattactcgtcctgcacgttggtgggggtcatgacaaaagataaggttgatacctcaaagccctacactggggcaataaggggcaccgtgcatgagcctcaagcgaacctaggggcagatcaaaagtactcacccgtcgatggtggacccttgggtactagtaccctcaccttccgaggactacacgtcctcaccttcagagggccgcacgccctcaccttcaaagggctgcacgccctcgccttcagaggactacacgtcctcgcctttagaggactacacgtcctcgccatcaaaggacaacacggctacatgcacgccctcagaggactacgcatcctcatctttagagggctacatgccctcgccttcagagggctacacgccctcaccttcagaggactacacgtcctcacctttagaggactacacgtcctcgccatcagaggactacacgtcctcgccttcagaggactacacgccctcaccttcagaggactacacgtcctcacctttagagggttgcacgtcctcaccttcagagggctgcacaccctctcctttagtgggctgcatgccctcgcttttagagggttggacgccctcgccttcaaagggctatcgtgcagggatcgcgcccacaagacacccagtggacctggagaagtccaacaaggtcttggggtttctagctctgattacgggcctttggcgagacaccacaacagcctgggaatggctgacagcgggcaacaggcacactgccaccacctctag

SEQ ID NO: 44378 - DNA, 777 bp, Glycine max
  Peptide Sequence Number=SeqID_136063
atggccctggtcaaggaattttataccaacttgtttgatcctgaagacaactcccccagacaagtcagagtccggggcaagcttataaagttcgatgctaagacgcttaacaccttcttggagaccccgatggtttttgggccaggggagctatactccacttactccaggttctgccattcgcacccagaccctcaagagctcgtcgccagattgtgtattacagggcgaggttttgtactcaatgctgagggagcaccctggaagctcctgaggaaggatctcaccacattagcacagacctggagtgtgttatcatactccaacctcgcccccacctctcatacgtctgatcttaatatggacagggcgtggttggtgatgaagatggacatggacttgggctccatcatctcaggccaaatctcacagatggcccagtccaactcctctcagctcgaattccctgcacttatcactgccttgcacattgccagaggggtggtccctgattccctcaccttcaagtccttgagtccagccattaacttggtctacatcaggaagaactactggaacccagaggatccgacaatcacatttcctaggtctcgcaagcccagggctcggggccccttagatacttccacttctacccctactcctactccagctcccacacccgcacttgcaccagtaccagttcctcttccagcacccacgacaccctctgacacctccatgcagacactaaatgtgatagtgccaatgctgtag

SEQ ID NO: 44379 - DNA, 303 bp, Glycine max
  Peptide Sequence Number=SeqID_136064
atgagtttatcatcaccaaaaagggggagattgttaagtttggacagtccattgagcagtagacgacccaaccctaccttggattttgatgattacaaagagcgcgcaatgcacaccgcttccttttataagacaacagtcttttcaagacatattgttgatctcgtaatgaatccttcactaaagtctaaaaaggtgtttcatgctcaggatttcaacaacgaaatatatcaagtaaaaatgagcaaaggatctttgaagcgaagtgctataaaattagtggacgatgcactttgtacttaa

SEQ ID NO: 44380 - DNA, 339 bp, Glycine max
  Peptide Sequence Number=SeqID_136065
atgcctcacatttttcaaggttgccaagtcgaatatgtgaagtacaacacaactcaaagtcacacccttaagaaacaacaaaccaatgagcatacctcagcaaaacaaagcatttgggatcatgacagcttgcccaagcgagctggttactttaccatgaagctatttcgtggcctgggcgagctaggggtcagaaaaagccttaaaatgtcccttttgccctcccctttgggtatttttgtgttcttttccaaaatgttgaaaaacctttcctattgtgcggtaactggcatcaagcagctcaatttggcttgcaaggatgaaaattttagcaaatga

SEQ ID NO: 44381 - DNA, 90 bp, Glycine max
  Peptide Sequence Number=SeqID_136066
atggctattggcactgccactcctcctaactgtgtgataggggtgtacacggctgaagttgggctgggttgggttgggtcatgggcctaa

SEQ ID NO: 44382 - DNA, 429 bp, Glycine max
  Peptide Sequence Number=SeqID_136067
atgtggagttatcatatctgttgttcttcatttcgcaaaggagaggagatcattgacgaggctgacgacaacgggtgggagtgtgatgcgaggaataaggcaactgtcacggaggtgtttgcaatgcaactgaagacagaggtcccagtgctcgaagatcactctagagttgctcctcatagagatgaggaaatctctcgtgaaaaaatgaagtgctttcggagactatttccaaataatgatgattttgataaagtctatgatgagtatgctcaattctcacttatgacgggtccatttgaaaatccaacttctcttacaaagagatactctttggatcctaggaattggtgggctaactttcgtgccaagactcctttccttcaatctttggctttcaagttgcttggacaaccgattcttctttag

SEQ ID NO: 44383 - DNA, 563 bp, Glycine max
  Peptide Sequence Number=SeqID_136068
atgagtgatggattttgcggtactcatttgcagatcatggttaggactagaggattaggtcgtgccttaggtcaagtcactggcagaggtgtgggcagaggagatcgtgatgattccgatgatgctccacagcgtcgacggcctactgcatccacacggaggcagcgagtcgctgtgactgcggatcacgtcgatgagtcagtcatccctgcgccagatgttcaagatgactcgatggaggcaccagctgctgtggaggacattcctgcaaacattcctgcggacacaggcgcaaaggcggctgaggatcagcctcagggattttcgggtggtccgagcgacccatccgtgttgacagcatttgcggatcacgttgcttgcaaggtatggacgggagaggagcgtcctgaattgaagctatcctctcataggaggaaggtccacaatttaggtaggcctgtccctgccattgagggacttattgctggtacaggactaagtcctctgatcgcgtgttcggtagacaccggcgatcgaggacttttgtccgcgtttgtggacgg

SEQ ID NO: 44384 - DNA, 189 bp, Glycine max
  Peptide Sequence Number=SeqID_136069
atggactctagacagtacataagccccccaagctctaagccagcttatgggagaaagaggttatccaatgttgaagattgtttgatgtctacggtattagccttgacaagtaggagggtcgatgtggcttgtcaagcccctgagcctggactggcaaggtctgacatgtcaggtgaaggaagtctctag

SEQ ID NO: 44385 - DNA, 1378 bp, Glycine max
  Peptide Sequence Number=SeqID_136070
gcgagctgataacttcatccagaagcaagcctgctcccccaggcgagttggttacttcatgatgaagttatctagctcaattcggttggcaagaatcaaaacgttagcaaatgaaggtccctggacgaaattagggtatgacactggctatgtgtgggtgaggggcaatgttcttaagaataagtcctcttttacctctgtggtgagtgtcgctgctctacaatgtcaggtgaagctgtggcgttgggtagtccacccttcttctgtatgtataggtgcttgtttgaggtcttgggacttgaccgctttgccgtgtgctcttcttgagcacttgaacgtggcccttcctcaacttcacccaaatagttgggccatggtcttggctactgatgtcctggttgatagtttgtcactaatgttcaacaaggatggggagccccactttcggttctactggcagtcagaccctgctaggttcaagtcatttgacaaggatttgttgacccttgtggaaagggtcgacaaagctattttggagcagctcccgaccttgttggacacacgggacattttgtctcttccctcggtgagcgatcctcttgctgccttggacaataaagccactcatgaagcaggtcagacctacgggtgggactgtgccatcgtcacctctagtgccccttcctttgttttggcaaagaggaaacaagatgatggtgttgggccgcaagctatagggttgatgctcggtgcgggtagcttttcaagtgtgcaagatatgcctccgactccaccgaccgttaaggctcctgttggcaatgttatagttactgttactcctgctcccccacctcctcttgtggcgcttgagaatggacaacagaaccaagagacttttcacaaggtggcgtccttggaggcggaggtcgccaaatggagggctactactcgcactgtttggagagtagagcgccttaaggtagctaacgccaccatccccttcgctgaggctgagtcagagtctaggctggaggagttcgagctgtgggctactagggagaaggaggccaacaaggagtttaaggaggaactactcgtttacaagaaggaggccgtggagcagcatgaaaagggctttaacaaggttttcaggaaggccgagttcttctctgatggttatgaggatttccgtgagcaagtggaccaaggagatgccttgggttttgtgtgccgtgaatcaataggactcaccaacaataggcctttggttttgagagccatttggaggatcgactatggaattgtccaacctgggttttgggcgtcattctcttccatacatgtcactcgccatgggcgacacatactggagacttag

SEQ ID NO: 44386 - DNA, 1389 bp, Glycine max
  Peptide Sequence Number=SeqID_136071
atggctccttcccaactatacctgaacaatcgggccatgatgatggcctttgagattttgtgccccttctttaacatccgacctaacttaaacaacttttgctacttcaaggatcgtttcttcaaggtcctggttactgatgtcgtggctaatggattttttgatgacaaagctattttggaacagctatcgacctcattggacgcacgggccattctgtttgttcctttggaaagcgatcctcttgttgccttagacgataaattttgtaccttgtcttgtcaattcaagccccttatgaagcaggtcgaacctactgatgggactgtgccaccatctactgtcccccctgttattggagaaaggggtcaacctgttgatgagattggctctattgttggtattgttaaggtcgcccccaatgctcgtttctatgttttgactaagaggaagctagatgatgacactggggtgcaagctacagggttgacacttggtttgggtcaccctccaagtttgcaagatgtgtctccggctccaagggttgttgaggctcctgcttccactgttattgttgttgctactcctgctcctccacctcctcatgacactcctgctactggagttggtgcgatggctacttcagttggttctattgcgacatcttcttccaacgttgccacacccttgttgagtgctggtgtggagaccactaatgctcctttgatgccgcctcttccttctttggctccaccggttccaccttttattgtgttggcagcggcggtgccttcctcatcttctcatccccatgtctctttggatcacttgtatgattcattgtggggtgcaaattacaaaccgaagaagaagaccccaactggctttgtgtcatcctgtgatagaaacctcatccagtcagttggggtgcagaacactatgaattctgccaaagtcttcctcttgagaagcttggcgattttgaaggagaatggacaacgacaccaagagactctgcgcaaggttttgtccttcgagacggaggttggtagtgtcttgcccaagttgttgttcacaaggttggacggtgatgaactgtccgcacactgcaagggcttgtgggaagagaaaaatgacttggctggcaaggtggaaggcattgcggcagagagggatgagcttgccaaggttgttgttgatttaaaggcttggctgaaagagtcaaagtccaggctagaggagttcgagctgtgggctattaggcaagccaggttcttcaccaaggaccttgacttgggtctttttgaccttttcaaggatgtgaaggacggtgttctgcttgacgaggaagatattgctgctgaggaagaggctggcgaggaggcgtag

SEQ ID NO: 44387 - DNA, 306 bp, Glycine max
  Peptide Sequence Number=SeqID_136072
atggttgctggaggaggattggagtcttcgaaaagagtctcacatcggaggctagactgtgtgctaaccatgggtgcgaaagaaagagataacgagagaccgcaagatatgttttaccacagcctctcggtgggtgccaaatgtacttaccaaaatttgaagatgacacatgtcagggtggacatgactaaggtgggcttccagacttcgcacgtcagactgagagtgacctttgttaggaggacaagagaggggacctacaaaataaaggactctgacgctcaaataatagccggtagcttatag

SEQ ID NO: 44388 - DNA, 813 bp, Glycine max
  Peptide Sequence Number=SeqID_136073
atggacctcatcgaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacctgggcagaccaactgaaggagtggtggatattgctgtgtctgagcatagaattgccaaggaaatcactgccaaacaagtccagcattggccaaagaaaggggaagctttctgcagggaagctaagcgtgaagtatgcaatcctgcacaggattggcgctgcaaactggaatcttttgctgtcaaattacccattgccttcccaactgtattgtgtggcattatgttgagtcaacatcccaatattttaaactacactgactctgtgatgaagagagaatctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaggcaaccatcaaagccaacacagagaagaaaatggagctggaacgcctgatcaaaagactctcagacagtggcattgatgatggtgaagcagctgaggaagatggtgaagcagctgaggaagaagaagaagcagctgaggaagaggaagatgcagcagaggatacaacatcagatgatgatgattctgaagccaccccatga

SEQ ID NO: 44389 - DNA, 201 bp, Glycine max
  Peptide Sequence Number=SeqID_136074
atgcaacatctaatgaagcttcttgaacgggataaatatattcattggcatagattaaaggaagaagatgtgtacctacaaacaaacaagtacagactcccactacttgactttgttggtgtgacacctacggggatgacattctctgttggttttgcatatctggagggtgaacgtgttaatatgtggtatgggctttag

SEQ ID NO: 44390 - DNA, 216 bp, Glycine max
  Peptide Sequence Number=SeqID_136075
atgtacaaatatcaacaatacagctccaacgtcaccatcaaaaaaattgcaagaaaggtcaatgtgacagacttgcagccctgctatatgcataagctatcagtcaagcacccaggatgtcgtaccggatgtcacgacatcacgcttcagaacatgcagattatatttgacagtatgaacagattaaacaagtcaataacacaagagaattgttaa

SEQ ID NO: 44391 - DNA, 255 bp, Glycine max
  Peptide Sequence Number=SeqID_136076
atgtccattttaaccccaattgcgataaacgcatcccttacctctaagcaggatcacgtgtgtattccgaaagtgatagcggcatatctagtagttgcttcaccaagggtggtccttgggtttgtcgagccttggatcagggacgtgtttgtcctggattttgtcaagcccacagagctgtgtcgaggcttaccaaggatagaccttgggttttgtagacctgtgaagatcagcaagcacaaagcttgggtttga

SEQ ID NO: 44392 - DNA, 1782 bp, Glycine max
  Peptide Sequence Number=SeqID_136077
atggtcttgaggtgcccaaccttcttggtgctagccagcttggagagtaggttcgctctgcaacctatccttggagaagctgctctgaagttgagcttgagggtttgctctaaagtgatattgtcaaggccttcgaggatgatccctgccccacttccttttacgatggaggcccgtcaatgtaaagggtccacctgtctaggtggttgtgtctttaacgaaccaagctaccatcctttctacgagttcagactttctcaaaacctgcttgatagggtagttcgtcttgactaccatttgatgactttggaagtagagcctaagtcatcatgtcaagcttcgtcggctactgagagatacaggagcagagatgctcctagcctgggtcgactcaaaactggcgatgtggctatggtcttcttgaaagccaggaaggcttgttcacaagtctcctcccttgagaagggctcagctgcgcatctccaatatggcagtgcatttgtcgaggttggcttcaatcccccagtgtgtgatcatgaagccgaggaacttgtcgctgcttaccccgaaagtacatttttaagggttgaggccgaatggcatgaccttgtagcaaaagttggcatcttcaatgatgaatgtcattttctcctcgtctggaggatgcattctgacctggcataccctattcagatcaatgtagtcgatgcatattcaccatttatcgttggcctttttgaccatgacaacattggcgagccaagtatgaaacctgacctctttgatgaagttggcatggaggagcttatagccaatttgtggcaaattatgccgggatggatccccggtgttatttcatggatttatgtcaaattctctgcctgggctggattggtagaaggtcagggctcggatttgagacccttcgtccactatcatgacttgagtgccttcagccactgttgggtgaggcatgctcctagagagcttgccttaaccgaaggtggtcatcaagtcaatgtagcctctggtctcaactctttcgcctgcaaagacgaggagtggaccaacgtaaaggtggacagtgttaggggaggcttcaagtctttggaaggttttccagtacaggattccagtagaacttccctggtcgataaggaccctggacaccttaaagttctctatgacgatggagacaaccacgaggtcgtcttggttgacagggttgatgcccttgaagtccctgtccgcaaaggtgataggagggagactccgttactggttgtactgtcttccatagaaaaagccgccagcgatggtgttgattacacctctgattcttctgctcttcttttgtctgcttcctggttcttgttctactcctctggatgtcctttgggtcttgctcctgcttggttgttgtctgatctcttaacaaactgggctaagtacccaacctatataagtttcgtctggggtagctggatgggtacctctaggttgaatgctttctcgagaatcatggactcatcgtctgcttgtcacggactagccaaggcggccgagattataacaaaagatgatgacaaaggtgatgacaaaaagctcaaaggtcaatcaaagaatgagttcaagatgttcaagatagaatcaagaacacttcaagattcaagaggaaagttgaattcaagaatcaagaatcaagattcaagagatcaaggttcaagactcaagattcaagaatcaagaaaaggctattcaagaatcaagaaaaaagcttaa

SEQ ID NO: 44393 - DNA, 183 bp, Glycine max
  Peptide Sequence Number=SeqID_136078
atggaggccaatacattcctgccaccagccacaaagtcccaggccaagtactctgatgacaaatcaaaaacgggaagacaaataccaagtggctctctatacctagccaggaagcatcttttggaaagggttagagagatcaaaaacgggaagataaagggaattttgagggcacaaaattaa

SEQ ID NO: 44394 - DNA, 1794 bp, Glycine max
  Peptide Sequence Number=SeqID_136079
atgaagatgatcatcgagagtggtactatacacaaggatatcatccaagaaaaccaccgtgaatttacgcaaaaatggctgcaacagagcattcatcgtggcctgaaaggtagaaggtgcattgctcaagccaaaaggcattacgcgatattcgtaatggccttgatgggtgcgaaaggcggtcttcggtcaagcttcgaaaaccatgaggcgtggccaaggtcgtccaacaattcatcaatggttggcatggggaaacgatccttgatcgtgacggagtttagagcacggactttgactcaggcgaatcagaccggcctggaggagagcaacaacttgcctttcgattttggacttctggcaatagggataacgataaggacagacgttaataggtggggcagaaggttaaaggttgatacgatggacaatttggcggggcggagagtgggtgaaggttcgggtagtaaagccaaatggaatagggctgaggttgaacgggtctggataagccgtttaacctgtggtgcagatatgggtgtaagcccaaaagacacgtctgccttcaatgtaactgggcctaacccttttaaccaagcaatccctaatactacgtctgcgccgctaatgaggaacctggtggcagtcgaggacggaaccgttgccgaccaggacgcgcaatggcgtggtctcggtgacaggcaagtgcaggaacttggcgacgcgtggctagacgaaattgtggagaccaaagagggcgtggagactgatatgagaggaggatgcgacctttacaacgatgtgatgagctccatttctcatcacagttgtaacaaaggcccttctcgcgacgaaaaaccatctcctctggcgtacggtggcggtagctgcggcgacggtcagtcaacttgtcctcctggagtttcgccaaggcggcggcctgggcccgacgatgcggttagcaagacgctcgaagtccgtaaggccatttcacgaggtaataaagccattgcggtacatccattggtaccagctcagggctggaccatccatgtaaaacgaggccatgcggggaacatcaagtttgactggcggtcggtgctgagaaaacaccggcgacggtggcggaggaagcaaggcatgggtgttgtgcttgtcggagagggaatcgtggtggatcaagaggcgcgaaattgcatcttccaatcgatcagtggtagtctttttggtcgagtgcttcgccatggcatggcaggtgtcgaaccaaatgttagagacgagagggacggggatccttggattcgaggtatactgatccaagtacgtagggcgtttggtgcttcgtttgggcctctccctatgggtctcgacttcactgggcttgctgcttccttgtggcaccgtcactctttcattgtcaattcaaacatgaatcttttactcgccgctgtaactctcctcgtattctacatggtgaattttttttactcaaacctgtggatcccatggagaacagagcattatttcaaggagcaagggatatggggtcctgactaccgtctgatcttggggaactcattagagatccgtcggctctacgatgaagccaagtcagaaccaaccccttcatttgaccaccaccatgttatcatgggacgcgtggagtatgtgaaagttccgttcaaccctcagtccaagatgctttttggacaaggccttgtgggcttggagggtgaccaatgggccttttacagaagtatcataaaccttgcctttaactttggaacttgttaa

SEQ ID NO: 44395 - DNA, 360 bp, Glycine max
  Peptide Sequence Number=SeqID_136080
atggtagagcgtggccatggaatgtattacacaccaccaatattttctcagtatccattcgaaggtcatcaaaatgatacttctgcaagcgaacattcattaggtggtgttgcggagacatatcccaatttttcatggcctactatgatctcttcacagcaatatgatgctccaatcccaacacctaatgtactcggagcaatacctgatatggatgaaattgtgaatcccaacaacaaatatattagggatatcccaggattggcgcctccagtttcgagcaggaggcttttgcctagaaagaaaatagtaccattgtgcgatcttgatgtacatgtcccattgaagagaagagattaa

SEQ ID NO: 44396 - DNA, 522 bp, Glycine max
  Peptide Sequence Number=SeqID_136081
atgtgggacttggatttttcccaatacactccctcacacccaacactttttaaggcttggtgcgtggataacatggctcttagaataaatggcttcgagaggctggataagattaaagattccaatagacaaagtaagcagctggaagaacttacagacaagatgagggagtgcaaaaggctgataaaggaatttgatcgtgaaattaaagatgaagatgggaggaatctcccagaagtgaacaagcaactcaatgatgaaaaacaatcaatggggttgatgattttctattggaagatcaaggaactaaactcatatgtggcattgagaaaaacgtacatgaatacccttggtaacaagaaacttgaactttttgacacgggagcaggagcaagtgaacctatagctgaagaaaatgttcaattggcatcagatgtccctctcgaatggagacataagggtcatatgcaccaagcttgttgcaaagataacttatccaaggatctcttaaagattttgtga

SEQ ID NO: 44397 - DNA, 636 bp, Glycine max
  Peptide Sequence Number=SeqID_136082
atggaggcaattcaagtatggcctgatccagaaacatgggcggaatttgcaaaaagccgcaaaacccctaattgccagggtatacgaaagaaggcccaggaaattcaaaaatttaatgactgcccacacgtactgtctcgtggggggtatgaactgcttgacaagaaacttatggaggagaagagcaagcgtggacatgaggaacatttgtgtactgaaagcccaacactcaacatcgacccaccatccccagttgtaagacacttgaagtggaagatcgcctgcaaaaagcggcatggccaaatgacgtctgaagtggcacaagaaattgcagacaaaattgacatactcaacacggcccttggccgacctgagcatccaggccatgttcgtgtcgcagggacaggtgtcacaataagccaatactttggccaagcctcacgtgcttctagcacatcgtcaccatcgatcaaccaacaacaattggcttatatcattggtggaattaaggatgacataagaaagcagctacaagatgagataagaaaggaggaacaggatgagataagaaaggaggtacaacaagaacacaagcagcaacaaaaggcttggatgagggcagttgaagaaaaatag

SEQ ID NO: 44398 - DNA, 417 bp, Glycine max
  Peptide Sequence Number=SeqID_136083
atgtcttcagtcatttacatttcaaatacttcaatgtcttcagtcagttacgctttcaaagactacaatatcttcatttacatttcaaagacttcaatgtcttcagccatttacacttttcaaaagacaacaatgtctttatttacatttcaaagacttcaatgtcttcggtcatttacgctttcaaaagactacaagtcttcatttacatttcaaagacttcaatgtcttcattcatttacgctttcaaagactacaatatcttcatttacatttcaaagacttcaatgtcttcagccatttactgatgcaatcctccctaggaagggaccagtcactagaaccatgagcaagaggctccaagaagattgggctagagttgctgaagaaggccctagggttcatcatgaaccttag

SEQ ID NO: 44399 - DNA, 717 bp, Glycine max
  Peptide Sequence Number=SeqID_136084
atgggaacgatgtggctgcgacgtggaaatcaacatatcggcaatgatgatgtgagagttttttgttgcaagttggatattatgaaacgtcatgagtttgtgtgggagccttacacaacaactgttatatcattgttgtctcccatttgtgtagtcagaagtgacgcacggcgaaagacaaagatgtttgttgacccagcaaatgcaaagacggctacattgggtgaagttgcggaggcattacaatacatggtgtctcctcaagggaggaatacatgcacatttgatgatctcgtgccttatgtggaaaaaattacaattttatccgaagagcaagagagagtcactgagccagtgtcacatggtcccgcatcagagcgtcaatttcctgcacaacagtttcacatgcttcagtcaagtattgaaactcaggggatagacagaagaagggacattgttgaagcggaagaatattcccaacaaatggcggagcgtggccatggaatgtattacacgccacaaacatttgctgagtatccgacccagatgtatcaatatccttttcagggtcatcacactgatacttctgcaagccagcaatcgttcggtggtgttgcggaaacacaagctcatttttcatggcccacaatgaccccttcacagcaatatcatggcccaattccaacacctaatgccccgttaggaacacaatggaat

SEQ ID NO: 44400 - DNA, 159 bp, Glycine max
  Peptide Sequence Number=SeqID_136085
atggcctcagcaaacttcttatttccagaaggaaattcaatcaatagacctccaatctttaatggagaagggccttatgtacccaccatagtagaaagaaccacaatagatgggagcacaacaagtggtattagagcaggattcttgtataaagtttag

SEQ ID NO: 44401 - DNA, 162 bp, Glycine max
  Peptide Sequence Number=SeqID_136086
atggcttcctatggtggtgagcttatgcttgactcatctatctccttaagatccaaggcctacaagctccacatggagctacatcatggggtattagagcatcttcgtcttggtgatgttcttttgcttcctctatctttttgttcgatcaattcactttaa

SEQ ID NO: 44402 - DNA, 127 bp, Glycine max
  Peptide Sequence Number=SeqID_136087
gatcatgagcaactatgatgcaatcctccctaggaagggaccaatcactagaaccatgagcaagaggctccaagaagattgggctagagctgctgaagaaggccttagggttctcatgaaccttagg

SEQ ID NO: 44403 - DNA, 629 bp, Glycine max
  Peptide Sequence Number=SeqID_136088
atgtcctctcggggaaagaaagccatatctttcctccgggtgtctcccctctttgagcagaattgcaactgtggtcatggattcagcaagaggtttggaccgcataaaacagactcggaacggcatagcgggcctaccacagaagtacctagaagacaaggcgaggggtatggccaatcaaggagactgggtccccaatcgacgctttccttgcctaccaccgatagcaaggaaagtccggtggtagctgtcttggcagatctatttgacacatttgaccgaaggtgcgaaaagagtagcgcacagatcatctgttgcttacccgccctctgtgtcagaatagattgggaccagctcttggccgggataggaggtagaacaatcagttggttcccccgattgaaggaaggaaaagaaggagtccttttctcatgtggaagatacccaatcattccgctggtaggaacgaggggttgtattaactacaatcccgcgctcgctataagacaactagggtaccccatgaggggagcaccgacggaagaaagcatgtctcctttccttgtgagggatttcggcgcacataattccaagactatgctcagaatccataaggcgtgggaaacccc

SEQ ID NO: 44404 - DNA, 249 bp, Glycine max
  Peptide Sequence Number=SeqID_136089
atgggtgaaatagaggaggtgcaagagcgaatggaggtcttaaaagagcaaatggccacaatgatggaggtcatgatgagcatgaagaggataatgcaggttaatgcggttgcagttgctgctattagtaccattattgaggtggacccggctcccccatctggcctcaatcaaataagtcattcgacctcgggtgtgagaggcaaagagttggcaagtacgggcggcccccattgtgtgcaaatttaa

SEQ ID NO: 44405 - DNA, 894 bp, Glycine max
  Peptide Sequence Number=SeqID_136090
atgcagggtgagggtggcgttcttccggcacaaaaagcgttcctgcaggggctgcgcgagctgtgcgatcgtcacaatgcggtactgattttcgatgaagtgcagaccggcgtgggccgtacgggtgagctgtatgcctatatgcactacggcgttacgcctgacgtgctttctactgccaaagcgctgggcggcggcttcccgattggggcgatgctgaccaccgataaattcgccagcgtgatgaccgtgggcacccatggcaccacttacggcggcaacccgctggccaccgctgtcgccgggcaggttctcgacattattaataccccggaggtgttgaaaggcgttaagcagcgtcacgactggtttgttgagcgtctgaatgccatcaacagcaaaacggggctgtttaaagaaattcgcggcctggggctgttaattggctgcgagctcaccgctgagtttgccggaaaagctaaacttatttcacaggaagcggcaaaaatgggcgtgatggtcctgattgccggtgccaacgtggtgcgttttgctcctgcgctgattgtcagcgaggaagaggtgcaaaccggtgaagtccggggtgtcatcatgatggtcatccgtcccgttgagcgcggcgatctcgccgggctcatgcagcttgccggtaagacgggaggcgggctgacctcgcttcctgccgatgaaaaaacgctgtcggcgcgcattgagcgcgccctgcaaacctggcaggggacgttgccaaaaagcgaacagggatatgtgttcgtgctggaagacaccaccacggggaccgtggccgggatctgcgccatcgaagtggccgtggggcttaacgacccgtggtacaactaccgcgttggcaccatg

SEQ ID NO: 44406 - DNA, 105 bp, Glycine max
  Peptide Sequence Number=SeqID_136091
atggccgaccagcaggtggccaagtccaaagccaaagctcaagacgttaaagaagcgctactaggaggcaatctagtaccttttaaatctctgcttgttatttga

SEQ ID NO: 44407 - DNA, 223 bp, Glycine max
  Peptide Sequence Number=SeqID_136092
atggctctcacatcttatccaaggaaggaccaagcccatggaattttgggggctgcaccttctaaacctaaggaagataaggacattcctagtagtcaagaggagactacttcttgcccttcctctagtggaagtgaagatgaagtaaggggtgaagagtctagtgaggaagtctacccccatgaagaaggtgacctcctaatggttagaaggctccttggag

SEQ ID NO: 44408 - DNA, 180 bp, Glycine max
  Peptide Sequence Number=SeqID_136093
atggtgaaagttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactga

SEQ ID NO: 44409 - DNA, 716 bp, Glycine max
  Peptide Sequence Number=SeqID_136094
atgaccggccctctcgatgagtcgatctcttgctttctcataagggtggacccttgggtactagtacctatcgcctttagaggactacacgtcctcacctttagggggctgcacgccctcgccaacagagggttgcatgccctcaccttcagaggactacacgtcctcgcctttagaggactacatgtcctcaccttcagaggactgcaagtcctcaccttcagagggcttcacgccctcgccttcaaaggactacacgtcctcaccttcagaggacctcaagtcctcaccttcagagggcttcacgcccttgccttcagaggacaacacgtcctcaccttcagagggcttcacgcccttgccttaagaggacaacacatcctcaccttcagaggactacacgtcctcgccatcagagggctgcacgccctcaccttcagaggactacacgtcattgccttcaaaggactgcacgtcctcacctttagagggctgcatgccctcacctttagaggactacacgtcctcgccatcaaagggctgcacaccctcgccttcagagggctgcacgtcctcgccttcatagggctgcacgccctcacctttagaggactacacgtcctcgccatcggagagctgcacgccctcaccttaagaggactacacatcctcgccatccagagggctaacagccctcaccttaagaggacctacac

SEQ ID NO: 44410 - DNA, 1271 bp, Glycine max
  misc_feature (19)..(19): n is a, c, g, or t
  Peptide Sequence Number=SeqID_136095
ctcgcgttcgacacgatcntcgccgaggggcagcgtcgctacgtcgaatcgctgagcgcgtacgcgcgccagttcctcggccaggtggaccggcccgacgtcgacttcatcgaggggctgagccccgcggtgtcgatcgaccagaagtccacgaaccgcaacccgcgctcgaccgtcggaacgatcaccgagatctacgactacatgcgcctgctctgggcgcgcatcggtgtgccgcactgtcccgagtgcggagagaagatccagcggcagaccgtccagcagatcgccgatcagctcatggagctgcccgagcgcacgcgctaccaggtggtggcgccgatcgtgtcccagaagaagggagagttcgtcgatctcttccgcgagctcggtgcgaagggctactcgcgcgcgatcgtcgacggcgagctcatccagctcgccgagccgcccacgctgaagaagagctacaagcacgacatcgccgtggtcgtcgaccgcctggtggcctcgaacgacatcctcgggcgcatcaccgactcggtcgagaccgccctgggcctcgccggcggcgtcgtgcagatcaactacgtcgacggcgagggagacgacgcgtggcagacgttctccgagaagctcgcctgcccgaacggccaccgctcacgctcaccgagatcgagccgcgcaccttctcgttcaacgcgccgttcggcgcgtgccctgcctgctctgggctcggcacgcgcatgtccgtcgacgtcgacctgatgctcggcgatgaggagctctccatccgcgagggcgcgatcatcccgtggacgacacagggcaaggggctgttccagtactacgagcgactgctcgaaggtctggccgccgacctgaacttctcactcgacactccgtggcaggacctgcgggtcgacgtgcaggatgcgatcctgcgcggcgacaactacaaggtcagcgtcaagtggaagaaccgctacggccgcgagatgcgctacacctccggcttcgagggcgtcgtgccgtacatcgagcgccagtacgcgcaggccgagtccgacacgcagcgcgcccgctggggcgagtacctgcgcgaggtgccgtgccccgtctgcgacggcaaccgcctcaagcccgaggtgctcgcagtgcaggtgcacggccactcgatcgccgaggtctcgcacctcagcctcgccgacgcgcgcgagttcatggagacgctcaccctcaccgaccgcgaggcgaagatcgcggcccag

SEQ ID NO: 44411 - DNA, 204 bp, Glycine max
  Peptide Sequence Number=SeqID_136096
atgaagtcagatgacatgcggggttaccttattgttacgcacaccgttcgtcaaccatgggcaaacgagctcattgacgcacagagactaacatcgtcttctgcaccttttgtcgtcctaacccgtgaagtcaggggcaaacacgcccgttggcgcccgaagatttgcattgtcttctgcaccttctgtcgtcttgacccgtga

SEQ ID NO: 44412 - DNA, 525 bp, Glycine max
  Peptide Sequence Number=SeqID_136097
gtcgactctagaggatccccgtccaacagggccctgggatttcccgcactgatcacaggactctgccagtcgttcggagtccccgttgcacctaccaaggtgattcggccgcccatcacccgggcttttattgagaagtactgcacccagagacaggctcagggtgatgctccacaggccgcaggtgcgccaccaccacctcatcaggctggcccggctgggtcgtttgacatggggcagtatttacggcatttggttcgccagcaggcggccaaccaccgggcacatgtacagacccatgattgtctttaccagctgagcctcaacatgcagatccagggcttcgcttctttttcatgccctactccagaccagttcagggcagaggtcgcatggcccggagattggcccgaggcccaagcaggagaggcacccccagaggctcccgatgatggagaggaggcccacgaggacgaggagatggccgatttgcttgacttcttgggagggagtggagctacatga

SEQ ID NO: 44413 - DNA, 234 bp, Glycine max
  Peptide Sequence Number=SeqID_136098
atgttggagaacaacccattcaatggcactgcccatgaagatcctatgcaacacttgaggaagttcatcaagttgaccaacacgagaaagcaagaaagtttacttgaagccttggagagattgcaagagatgataagaagttgtctacatcatggcttctcccccacaaaggctagttcatatttttcaatcaccaatcacattacgcatgaatcacggactggatcaagatga

SEQ ID NO: 44414 - DNA, 249 bp, Glycine max
  Peptide Sequence Number=SeqID_136099
atggatgacgaaataccagttcggggtcgttcaagagcagaagggaggactatcactaatcttcatcattaccgtgcagagattttttatgttgctattgataaaatatgtgtggagatggatcaccgctttagtgaaggaagtagcattatacttgattgcttctcatgtcttgaccccaagaactctttctccaagtttgatgttgataagcttgctcgtcttgctgatatatgcagacttttctga

SEQ ID NO: 44415 - DNA, 282 bp, Glycine max
  Peptide Sequence Number=SeqID_136100
atggcacgcagcgtgtttgctctgtgcccctatttaagggacctatatgggagggagctaaaagggctcttagtgataattcccaaggcggtcatatctctcttgatggtctctagagtccccagtggagtcgccaactgtcgcaacctacccttcggcgggagggcgacgcgtgactcgtgggtgcgtgtcccaagaaaggaatacgcgtggagtcgccaccaacgtttatttgaggaaaacgtcggaaaaaccggaaaagacgttatctacgaattctaa

SEQ ID NO: 44416 - DNA, 174 bp, Glycine max
  Peptide Sequence Number=SeqID_136101
atgagtttcaatgccgagcatgggttatcagactggtcatctggagtgatggatggacggaatgatcgtgcgatagctgatgcccttcaagccttagctctggctatagggaatccaaacaggggagaagttagtggagctgttgagtaccaggggttagactgcttccaatga

SEQ ID NO: 44417 - DNA, 796 bp, Glycine max
  Peptide Sequence Number=SeqID_136102
atgcgcgtctaccagccgcatcaggccattgtgctggaagccaacgactcggcgcccggtggcgcgccgaagcttaagagcatcatcattaaaaacgttcccgatccggcctcccgccgcctgctgatccagcagggcgacgcggacgtggcgcgcgatctgggtgcagaccagatcagcgcgctcgacggcaagccgggcgtgaaggtactgagcatcccgtctgcggaacagaattatctggtgtttaacaccggcaacagcaccaacccactgctgaacaacccggccttctgggaggcggcgcgctggctggtggactatgacggcattaccaaaaacctgctgaaaggccagtattttgtccatcagagcttcctgccggtcggtctgccgggcgcgctggaagataatccgtttaaatttgatccggcgaaagcgaaagccatcctcgccagggcgggtattaaagatgcccacttcaccctggacgtggagaacaagccgccgtttatcaccatcgcgcagtcgatgcaggcgagcttcgcgcagggtggcgtgaaggtggatctgttgcccgccgccggtagccaggtgtacgcccgcgtgcgtgcgaagcagcatcaggcggcaattcgtctgtggatcccggactactttgatgcgcattccaacgccagcgctttcgcgtggaacgacggcaaatccagtaccgtggccggactgaacggctggaaaattccggagctgaacaaggccacgctggcggcggtggccgagccggatccggcgaaac

SEQ ID NO: 44418 - DNA, 414 bp, Glycine max
  Peptide Sequence Number=SeqID_136103
atgcagagttcaaaacgcgatgtctatcttggagcctacctaaatggcagacactggcagatggtggtcatcctgcccaaggaacacctagttgtctggttttgttctttgcataacaggccagacaactaccataaggggattattaacagtgctttaaaagatcttgatgatgctccacagccaaaatcaaaggctcctgctaggtggattgtcgtcaagtgtaatagacaaaaaggaagtactgagtgcgactactatgtgatgcactggatgcccaccatcattttaggaacttttaggaataattgggaagcatattttaacaatcctagatcattggagtcagagagattaaaggcattgtggatcaagtggacacagttttatctccgagttagagatcagacctag

SEQ ID NO: 44419 - DNA, 588 bp, Glycine max
  Peptide Sequence Number=SeqID_136104
atgtctcgcgatcgtatcccggtttccattatcaccggatttctcggcgccggaaaatcgactctgctcaatcggctcctcaaggatcctgacatgagcgacgcagcgatcatcatcaatgaattcggcgatgtcagcatcgatcacatgctggtcgaaagcgcgggcgagggcattatagaactggcggaagggtgcctttgttgcaccgtgcgcggcgaactggtggacacgctggcggaactgatggacggtatccagaccggcaagctgaagccggtgaagcgcgtggtcatcgaaacgaccggccttgccgatcccgctcccgtcatgcagtcggtcatgggtaacccggtcattgcgcagaatttcgtgctggttggcatggtcactgtggtggatgccgtgaatggcctctccacactcgacaatcatcaggaagccgtgaaacaggtggctgtggccgatcgtcttgtggtgacgaaacgagcgctcgccgatgacgccacgattgcggcattgactgcccgcctagaggcgctcaatccgcgcgcgatcatcgaggacggtcacaaggggatcctctag

SEQ ID NO: 44420 - DNA, 453 bp, Glycine max
  Peptide Sequence Number=SeqID_136105
atgatacgcgaagataccttacggttatccgcacccttttgtcatccagaggcggcgggcccgatgacaagcagagaccaagtttggtcattctgcacccttgtatcatccagaggcggcgggcccgatgatacgcggagataccttacggttatctgcacccttttgtcatccagaggcgaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcgaagataccttacggttatccgcacccttttgtcatccagaggcggcgggcccgatgacaagcagagaccaagtttggtcattctgcacccttgtatcatccagaggcggcgggcccgatga

SEQ ID NO: 44421 - DNA, 96 bp, Glycine max
  Peptide Sequence Number=SeqID_136106
atgggacaggtgggttttgtggctgatttagggatgacctttgtggatgattgggcgttcttggctggtagggtggtgggtaatgagaatgactga

SEQ ID NO: 44422 - DNA, 315 bp, Glycine max
  Peptide Sequence Number=SeqID_136107
atgggtctaaaaagaggcaaatttaatcatcttgcttggacaaatgagaaaactggggcaaatgaagagggtgagaatgaaggagaaacccatgctgcgactgtcgttcctacatggaaactcccccaccagctcaacaaacatcattactcagccaatatcatcccttctcactacccaccacccagtcatccacaaaggccatccctaaatcaaccacaaagcctgtctaccacacttccaatcacaaacaccacctttagcacgaaccaaaacaccaaccaaggaaggaattttgcaacgaaaaacttgtag

SEQ ID NO: 44423 - DNA, 825 bp, Glycine max
  Peptide Sequence Number=SeqID_136108
aactcgcccgcgggctccagctatcctagagggaaacttctggagggaaccagctactagacgagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgg

SEQ ID NO: 44424 - DNA, 522 bp, Glycine max
  Peptide Sequence Number=SeqID_136109
atgaaagataagagggatgaggaagaaaaactagaaaaacaaaagaaaaagaaggatagtaaggccttgtcttcaaagtccaaggggaaggaaaaggaggaaaaggattcctccaagaagattgttaagaaggaaaatcattttgcaagaaaaggtgatattaaaatagcactccttcttaaacaatctttctaccttatcctatcaagggaaacatcccttagcactgccatacctcttaagcttgaggttattcctcaagtaaaggagttgttggatgagggtttggttcgcaagagcttaaatccttatgctttgtttgtgccaaaaataggtattattaggcaccaaatccctatgataggtggtatgatgaatgtgttgagtggtgcaacactcttttgtaaaatcactcatgtacccaacatcttcatgatttatgtacatagggactcattaggaaggaataatcaacatgaaaataaagaaaaaggtatgttttattccattactttcccctga

SEQ ID NO: 44425 - DNA, 291 bp, Glycine max
  Peptide Sequence Number=SeqID_136110
atggctgtagaggaattgcacgaagagcagcaaaaagcacctgttgaggatcctcctactgatgttgagggtttcctaggtggaccccatgacacatcagttctgagtgattatgaaaatcacaatgctttcaaaatctggaatggagaggaacgtcctgagttgaagttatcttcccttggaaggaagatgactaagtttgggaggctggcactagtgatagaaggccttgtgggtgctagtgaactaagttctctgatctcatgttccctggatacaggcgatcgatga

SEQ ID NO: 44426 - DNA, 392 bp, Glycine max
  Peptide Sequence Number=SeqID_136111
ggatcgcacccgcaaatcacacagtgcacccggagaagtccaacaggatcctggggtttccagctttgattacaggcctttgtcggttctacagagtgcccgccacccccaacaaggtcatcaggccccctattaaccgagctttcatcaagaagtactgcgccccccaggcagaattcgctaagcgcaaccttcaattgctaagcgcgaggaagaatccagaagaggatgagctgtcaagttcgctaagcgcaccattccaggtcatcaagcgcaccgcttcagctcatctgctaagcaaaacaagcgtgctaagccaaaatccacttatgcgcgctaagcaatccagatctgcactaagtgcacgagcacgaacaaggccacctatttaa

SEQ ID NO: 44427 - DNA, 189 bp, Glycine max
  Peptide Sequence Number=SeqID_136112
atgggtccgaaatctaccctaaggctcatgagaaccctagggccttctcttgcatctctggcccaatctacttggagtcttctatccaatgcccttgcagggctttttggcatgaattggaaaaccaaagattctccaagtagcttcacagggagaaatgtatcttccatgaagacatccatcaattaa

SEQ ID NO: 44428 - DNA, 419 bp, Glycine max
  Peptide Sequence Number=SeqID_136113
atggatgagaagacaaagaaaagactggaagaagctgcccaatccggaagcactgagggcgtcattgaccatgcatctcccatcagatgccacgtgaaatggaagatggcccgcaccaagaaaactgggcagatgacgtttgaggcagcaaaggaaataactgagaagattgattctttggacgagcaggcgtcacaaggatcgcgactagagcacccttgccgtgtccgtgctgctggagccggtgtcaccataaagcaatacttcagatcggctccacaaacgtcccgtagttcttcctccatgaatcctgaagacctacagcagttgacccaacaactcagggaccagctggaggagtcgatcacaaaaaaagtgactcgacagctgatgacatccttcagccagatacagtctca

SEQ ID NO: 44429 - DNA, 84 bp, Glycine max
  Peptide Sequence Number=SeqID_136114
cgattctgtggaaattcttcatcgttcttcgtcgttcttcaccgttcttcatccgttcttcgttcgttcttcattcttcaacgg

SEQ ID NO: 44430 - DNA, 325 bp, Glycine max
  Peptide Sequence Number=SeqID_136115
gctagcctctggctcgcctgggcccccaaattacttcaaggtgaaggaaccagctcgcttgggcgagccagttactttaggagtaagcatcagctcgcctgggcgagctgccattgccccaagtgcccattttcctataaataggtgtgctagggaggatgaggagaagttccaaggttcagtacttgagggaattgaaagaattaagaaagaagaagaagaagaagaaagaagaggaaatgaagctgaggcgctgccaaatcacgactgtgatcaatctctagatcgttcctcgttcggtattctttgtgctaccgttggttag

SEQ ID NO: 44431 - DNA, 174 bp, Glycine max
  Peptide Sequence Number=SeqID_136116
atggcctccatcgttgtggccattttctctttaatggcctccatgtcggctttcatcttctcttgtatctcctccgctttacccattactctagctctagcacagaaatgggtttatgatcccaacatggttggctcatggtacttaacaaatgcaactaagaatgcatcatga

SEQ ID NO: 44432 - DNA, 810 bp, Glycine max
  Peptide Sequence Number=SeqID_136117
atgggcgatgatgtgatgcattacgggccgggcgatctgctgctggtcaccatggacatgccggtgcagtcctgcgtggtgctggcgacaccagagaaaccctgtcttggcgtcggcatcaccatcaacgaagcgcgcctgctgcgctatctggaacattttccgccgcagcagattggcagcgccgcccccgaacgcagcattaccgtccataaagtcgcgccgccgctggtggatgcggtgatgcggctggtggcgctgctggatcagccgcaggatatcgccgcgctggcaccgctgattgagcaggagattttctatcgcctgctgaccgggccggaagggccgcgcattctgaacatggcgctgaccgagcgcccgggcaacaaagtggcgcgcgcggcgcgctggctgcgcgaaaactttcatcaaccgctgaaggtggatcagctggccagcagcgttggcatgagcatttcatcgctgcaccatcactttaaagcggttacggcaatgacgccgatgcagtatcagaagcagctgcggctcagcgaagcgcgccggctgatgatgattgagaagctggatgccgggacggcgggctaccgggtgggctatcagagtgcgtcgcagttcagccgggagtacagccgtttttatggccagtcaccggcgcgcgatgtgcgcaagatgggcggtggggccggaaggactctccccaccgcagtaaggcttacagcgtgcgtgcggcttccatcgccagcgcgaacgaacgcaggcgcgcctgcggatcgtaaatctggccgttga

SEQ ID NO: 44433 - DNA, 273 bp, Glycine max
  Peptide Sequence Number=SeqID_136118
atggcctctttatattctttgtctttcaaaagtattttcaggaacaagttattccaagatcatgatgaagaccaagtcaacttgtgtctcatgacaaaatctgatgagaataacaatgaagattctgtaaggaagaaatggtacatagacagtggatgttccaagcacatgacagcagatgtatccaaattcacaaccatttcccccaagaaaagtggacatgttacatacggtgacaacaatatcagtaaaatctcaaaagaggataattga

SEQ ID NO: 44434 - DNA, 168 bp, Glycine max
  Peptide Sequence Number=SeqID_136119
atggatgaagatcaatggatgtatgatagtataatgtctaaagaagttgatatggatgatcaaaatgaacaagaatgtggtgtgaatgaacaacatgttgattgttcgaatgcgttcaatacttctcaagtgtttggtatccgagatgatgttttgcaatgggcttga

SEQ ID NO: 44435 - DNA, 402 bp, Glycine max
  Peptide Sequence Number=SeqID_136120
atgatcagtgaagttgtcatcatcaaaaagggggagattgtagaagcaaagcttcatgatgaatcaagattgattcaaagatgttttgatgataacaaagatgatgacaaaggtgatgacaaaaagctcaaagatgttcaagatagaatcaagaacacttcaagattcaaaaggaaagttgatttcaagaatcaagagtcaagattcaaggatcaagctttcaagaatcaagctcaagattcaagactcaagattcaagaatcaagagaaggcttaatcaagataagtatgaaaaggttttttcaaaaagtgagtagcacagggatgtttctcaaaacatgtttaccaaagagtttttactctctggtaatcgattaccagattgttgtaatcgattactag

SEQ ID NO: 44436 - DNA, 333 bp, Glycine max
  Peptide Sequence Number=SeqID_136121
atgggcataagctctacctatagtttcttgttaggccggccttggatccactcggttggggtggtcccgtcaatgctgcaccagaaattaaagtttgtggtggaaggacagctgggttatagtatcaggagaggaagacatactatgcagccacgcttatctggtgctactttgatggtggctcgggttatgtcaagggacagatatgagcctggaatgggtttaggccgaaacgaggatggcatggcaagcttggtggagttcactgagaatcatggaaggttcgggttggttacgagcctacatatgctgacaagaaaagggtcaccttag

SEQ ID NO: 44437 - DNA, 238 bp, Glycine max
  Peptide Sequence Number=SeqID_136122
agatactcttgatgagattttgaaagatgccaaatatcactcttattttagggattgtattggtgcaatagatgatactcatatacaagttgggaagattctacacatgatactaagatatttatggaggcttaatgtaagcctgcattgcattttccacatcctcctcaagggtcgtaagggaaaactaggtatcatctcccacaatttagaattgagcctagaatcaaggagatag

SEQ ID NO: 44438 - DNA, 261 bp, Glycine max
  Peptide Sequence Number=SeqID_136123
atgaagaaggagattacatcagggcaattggcaaatgctaagcttgcaggggtcggtggcagactcaagaataatggaatgtgtattggtttagtcccatacctccattgcagttcagttgtgcctgagtttgcttccctatttttattaattttgttcatgtttatgtgtgagttgaaacttcctgctgaggaccaaaagggactaaaaagaaaaattatcacaactatcaagactaaaagggtagttaaaccaaaataa

SEQ ID NO: 44439 - DNA, 441 bp, Glycine max
  Peptide Sequence Number=SeqID_136124
atgaccagccctctcgatgagccgatctcttgctttctcataagggtggacctttgggtactagtaccctcacttttagaggactacacgtccttgccatcagagggctacacgccctcgactttagaggactacatgtcctcgccttcaaagggttgtacgccttcgccatcagagggctacacggcctcaccttcaggaggactgcacgtcctcaccttcagagggttgcacgctctctccttcaaagggcgacacatcctgaacttcagagggctgcacgctctcgccttcagagggctgcacaccctcgccttcaaagggcgacacatcctaaacttcagagggttgcacgccctcgcctttagagggctacatgtcctcactttcagtgggctccatatccacatcttaagagaatttaaggtcctctgcccttaa

SEQ ID NO: 44440 - DNA, 375 bp, Glycine max
  Peptide Sequence Number=SeqID_136125
atggaactccgacatcttaatcaaaatgaagaaatcgacaaaaagaaaagaagtatagcacttaaagcctcctcatcaatgcaagaagaaaatgaagaagaagaatcagatgatgaagaagacttctcactctttgtgaagaagtttcaaaaatttgtcaagaaaagaagaatcgagaggcatcagaacttcaacaatggaagaagatctcaagaagactctcaaaaaagtgataagaaaaggtatgatgaaagaaggaccaagaaggcctacattgcatgggatgacaatgactcatccaacggttcagagaaggagatcaaccttctaaccaaggactatgagagcgatgagaacatctctcaagaagattaa

SEQ ID NO: 44441 - DNA, 444 bp, Glycine max
  Peptide Sequence Number=SeqID_136126
atggcagatgatatcacattcaatcatagaaaacaaggtatccaccttactgaaaaggaaacaattcatttatgcttgactgagattgagaatatgctacaagccaatagaaggagcttgcgagattttccatccatgccatacccaataggatatgcacccaaccaacatcataataaactgatccataatgaaatggcatatgacaaagaaatgctagcagcagaattcaacacagcataccatttgctcacagatgagcaaaaaactattgtcgatatcattatgcgtgtagttaacactcaatcagctgcagtttacttcctctatggatatggtggaactggcaaaacatttgtttggacaaccttatcatctgctatatgctccaatggtggaattgtttgtacagttgcttcaagtggaattgcttcattactctag

SEQ ID NO: 44442 - DNA, 222 bp, Glycine max
  Peptide Sequence Number=SeqID_136127
atggcgattcaacctgaggaaagtagagctgatcagaaggtggagggatttaaacaacagctggttgatgaaccgacactggaaccggttgatgatttagttgaacttgaagaaattgttgaggaagcagaagaaaaggttgttgagattgagaagaagaaaggcaagagtgaggccaacatagaaaagaagacagaggctactcctattgtcataccctaa

SEQ ID NO: 44443 - DNA, 300 bp, Glycine max
  Peptide Sequence Number=SeqID_136128
atgcatagatctcccaaaggaaatttagttcctctggacttggagattgaagctacattgagaaggaacagagcagagaggacaagaaaattactgcaagacaagacagtagcgtccattcttgaggaagaaactcattttttttattcttcatcacctgattcaccatcatcaagggaatctgcgacctattttccagaagtcgtttccatggcaaataagcaccagcaaagggttacccttaaggacgattcaagcagttcagtgctgcaattctttactagcattgcacgtcctgaa

SEQ ID NO: 44444 - DNA, 347 bp, Glycine max
  Peptide Sequence Number=SeqID_136129
acgtgatgccctccctggagttattgtgactgatagagacctagcattgatgaatgcagtgaaaattgtattccctgagtgtacaaacttgttgtgcaggtttcacatcgacaagaatgtcaaggcaaaatgtaaatccctaattggtcaaaaaaatgcttgggagtatgtgatggatgcctggggaagtttggttgattgtccttcggaacatcagttcaatgattgtcttaagaagtatgctttaaatcagattgctgctgagtatgatcgtgtacattatgctgacaagaatccttctcattatggttgtgtcatgagaactacacatggttttccttgtgcat

SEQ ID NO: 44445 - DNA, 111 bp, Glycine max
  Peptide Sequence Number=SeqID_136130
atggaaagaaactcccctctcccccttggtgatcagcctgagtctcaagggagttccaaaccgagtgacatgcccccaagtacaagtattcctcctcatgagaaactacaa

SEQ ID NO: 44446 - DNA, 276 bp, Glycine max
  Peptide Sequence Number=SeqID_136131
cttgggaggattgatggggacccggtgttgagagaaacgaggatatgggctacgtgggagtacgtgagctcagttggaggtgagcaacaggggatgagtgtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaggtcaggaagctaaggaagcctctggtaatcgattaccaaggg

SEQ ID NO: 44447 - DNA, 492 bp, Glycine max
  Peptide Sequence Number=SeqID_136132
atgggtgatcaagaggagacacaggaacagatgaaagccgacatgtcggctctgaaagaacagatgacttccatgatggaggccatgttaggaatgaggcagctcctggagaaaaacgtggccaccgctgccgctgtcagttcggctgccgaagcagacccaactctcttggcaaccgcgcgccatcctccctcaaacatagtaggacggggaaggaacacgctggggcacgatggcaaccctcatctgggatacaaccgagcggcttacccttatggattgctgcccaactactcaccacccgttctgcaagacgatgcgggccacattgcttctcccgtccttgaaagagagcctcctcaacgaagcaactacgaggtccacgaagaccctcaagactatgctcgaagggatgtcgagttttatcccccgatccccgaagggccagaacccagcacgttgcctcaacccaacatcacgacacaccaatag

SEQ ID NO: 44448 - DNA, 693 bp, Glycine max
  Peptide Sequence Number=SeqID_136133
atgaattcctcctccatttatattcttgtctttgtccagctttggttgttgagcttaccatgcagagagagtgtgtgcatcccaagtgagtgtgagacacttatgaagattaagaataatctgaatgatccttcaaataggctttggtcttggaatcataatcataccaactgttgccactggtatggagtcctctgccacaaccttacttcccatgttcttcagcttcacctcagctcttcacattctcctttcgatgatgactacaattgggaagcttatcggagatggatctttggtggagagataagtccttgtctggctgatttaaagcatttgaattacttggacttgagcgccaatgtatttcttggagaaggtatgtcaattccttctttcctttggacaatgacttccttgactcacctcaacctcgctcttacttcattcatggggaagattcctcctcagatcgggaatctctctaagcttcgatatcttgacttgagcttcaattatttccttggagaaggtatggcaattccttctttcctttgtgcaatgagctccttgactcacctagacctctctggtactgtattccatgggaagattcctcctcagattgggaatctctcaaatttgtaccctctcagatcgggaatctctctaagcttcgatatcttgacttga

SEQ ID NO: 44449 - DNA, 399 bp, Glycine max
  Peptide Sequence Number=SeqID_136134
atggtgggttacacaccttcaagttttacagatttggtcttcgccagtgaaaggatcaaggtgggtccgaaaagaggcaaatttgatcatcctactaggacgactgagaaaactggggcaaatgaagagggtgagaaagagggagaaacccatgctgtgactgtcattcctatacggccaagtttcccaccaacccaacaatgtcattactcagccaataacaaacctcctccttacccaccacccaccgtaaccccaaccaaggttcatcaaccttcatttctccgagaatacgactcgaacgcaacgtgtgcttgtcacggagaagcctcggggtgtcccattgagcattgtagggctctgaagtgtagggtgcgaggtctaattgatgctggctga

SEQ ID NO: 44450 - DNA, 243 bp, Glycine max
  Peptide Sequence Number=SeqID_136135
atgaagggaagaaggcataaatatgggtttaacaacaacaaacgtgagaaggcagagaagaaaagggtggtggatgatgaaactggcgacaaacatcagctggatgaaatcatgggttctccacctccctccactcctcctcctcctcctccacctcctcctcctccttcggacgcatcggcttcgccgtctgccgtgaaagcggaaatgcaaagcctcacgtctacgatcattgtccactag

SEQ ID NO: 44451 - DNA, 227 bp, Glycine max
  Peptide Sequence Number=SeqID_136136
aagatgacgtaaatctccgcgtgtcaacaggcttgttggtcgtgattgacaaaggtgactccagtgtcagtatgacagaatttgtctgcgcggaagatgacgtaaatctccgcgtgtcaacgggcttgttggccgcgattgacaaaggtgactccagtgtcagtatgacagaaattgtgggggcagccgacaaaagcgaggctcttgctcctacgtatcctcaatga

SEQ ID NO: 44452 - DNA, 249 bp, Glycine max
  misc_feature (219)..(219): n is a, c, g, or t
  Peptide Sequence Number=SeqID_136137
atgtgtcgcaacctacccatttgcgggcgagcgaggcgaggctcatgggtcgacaaaagcggggctcttgctcctacgtaccctccatcaaagaggaaatcagacctacgtaattcttttaaaaggggcgaatcaagtgattcttttttacttggaaggtggtcatttaaggcgttggaccttaaactgatccatttttacttggtgagaaaagctaangcgttggaccttaaaacgttttttcagtga

SEQ ID NO: 44453 - DNA, 258 bp, Glycine max
  Peptide Sequence Number=SeqID_136138
atgctttgtgtaatcgattacaatgatttgggtacatcctttgtggtacaagtaaagggtacatctacttgggttgttatgactgagaacaagagagggtacatctcttgtggatcagttctagtggagggtacatccactaggttgttcaaagagaacaagggagggtacatcccttatggatctttgcttgtaaaggtttttacaaggttgaaaagaaatctcaaggaccgcaggtcgcttggggactggatgtag

SEQ ID NO: 44454 - DNA, 209 bp, Glycine max
  Peptide Sequence Number=SeqID_136139
atgtcacgaaaccttacagattacgcaatcgtcccttctttggcttctggaatgttacagaactttacgtattatgcattaacgcttcctttcgactcccgacatgtcgcgaaacttcatggattgcctaacaatgggtgtctagtacctcaaagtggtcaagcaaaggtcgcgtcccaacaaatagatggtccccggatgaaattagg

SEQ ID NO: 44455 - DNA, 387 bp, Glycine max
  Peptide Sequence Number=SeqID_136140
atggttaaggaggagtgtaaggaggtaagtgtctccgccaagaggttagctaagaaggaaagtcattttgcaataaagacaaacattaaagaaacttcccctcttagacaacctccacatcttctcctttgtaaaaagacacttgttagcattgccacacctcttgggcttgagattattcctcatgtaaaggagttgttggataagggtttggttcgtaagagtgatcaaggggttcccatagacgttaagagaataaaggtcatttctgagtggcccactcccactccaccaagaggggtgtgtgtagctaagctcaagcatctcatctcaaggagctatgctctaacttctcaaggaagtttctcaaggaagcttctcaaggag

SEQ ID NO: 44456 - DNA, 362 bp, Glycine max
  Peptide Sequence Number=SeqID_136141
atggagcagcgtggccatggaatgtattacacgccaccaacatttgctcagtatccttcgcaaatgtatcaatatcctttcgaaggccatgacactgatatgtctgcaagcgaacattcgtttggtggtgttgcgaaaacgcagcctcatttttcatggccgaccatgaccctttcgcagcaacatgatgccccaatggcaacacctaatgccccattaggtcagcaatgggatgtacccggagcaatccctgctatggatgacttattaggtgttgatttgcatcacgagttttctgcagaggctgaggaacaagggcggagactgcgcgcaagaagaaatccggatcgtcaagcccgaag

SEQ ID NO: 44457 - DNA, 301 bp, Glycine max
  Peptide Sequence Number=SeqID_136142
atgacatcaaaatctggttcagaatccagtagatcctcatccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcttg

SEQ ID NO: 44458 - DNA, 216 bp, Glycine max
  Peptide Sequence Number=SeqID_136143
atgacaccggtaaaccgaaaggcaggaacaggagagcgcacgagggagccgccagggggaaacgcctggggggcggagcctatggaaaaacggctttgccgcggccctctcacttccctgttaagtatcttcctggcatcttccaggaaattccgccccgttagtaagccatttccgctcgccgcagttgaacgaccgagcgtagcgagtcagtga

SEQ ID NO: 44459 - DNA, 312 bp, Glycine max
  Peptide Sequence Number=SeqID_136144
atgagtgaaatagaggaggtgcaaaagaagatgaaggccatggaagagaaaatggccacaatgatggaagccatgatgggtatgaaaaaaatgatggaggttaatgcagctatagttgttgccgcaagtactgccatagaagttgacttgactcacccatctggcctcaatcaagtacatcctccagtcttggatatagtagggcagggaggcgaagcgttaggaagtacgggcggcccccattttgtgcaagttcagaacaagcattccttcccaccatacagcttgcctcccaactatacaccacccaat

SEQ ID NO: 44460 - DNA, 332 bp, Glycine max
  Peptide Sequence Number=SeqID_136145
atgaacccagatttcaaccaaccacgaggcgggtgctcgcgggaggtcagcatacaccccgcgcagcaacattgcaggcgtgccctcaggcctaatggcttcgggcgcaacttgcgttcaaagactcgatggttttttcacgggattctgcaattcacaccaagtatcgcatttcgggctacgttcttcatcgatgcagagccgagatatccgttgccgagagtcattgtatgtaaatgttgggtcgtgacgactcccgcgggacaccctcttccgggcccccgggagtcgcacttaacagattttgagttccttggcgcacaaagcgccgg

SEQ ID NO: 44461 - DNA, 402 bp, Glycine max
  Peptide Sequence Number=SeqID_136146
atgccgatctccccctgtggaaggatcgcccccacaaggcacctagtggacccggagaagttcgacagggccctagggtttccagctctggttacgggcctctgtcagtcctatagggtgcccgtccccccagcaaggtcacgccatcgtgagataggggtcgcacccgcaagacacccagtggacccgaagaagtccaatagggtcctggggtttctagctttgattgcgggcctttgtcagttctacggagtgcccgtcgcccccagcaaggtcatcaggcctcctattaaccgggctttcatcaagaagtactgcgccccaggaaggcgcagggtgagacaccagagcagcctagggatggccggcagcgggcaacagacgcaccgccaccacctctag

SEQ ID NO: 44462 - DNA, 324 bp, Glycine max
  Peptide Sequence Number=SeqID_136147
atggtccatgacatctttgtcaaggtgaaactggaagtaacatggatatcaacaatcctaaacgtgtctggcagtagacgaagcaatgatgtaacccgatccatcttttgccccaatttttgcaagatggttacttccatgcttcaacttgacttgatgacctgttttcctaaaagcatgagctctgaggttcaaccctatatccaagatggaaaatgcaccttagcgatcagcgcatggagcggaaacatgaaaacaaaaggaaagaatgcaatgagcaatgcaaccaatgaaaaggatgggatgtatgctaatgacgcatag

SEQ ID NO: 44463 - DNA, 449 bp, Glycine max
  Peptide Sequence Number=SeqID_136148
atgaggggccctctcgatgagtcaatctcttgctttcttataaaggtggacccttgggtactagtacctattgcctttagaggactacacgtccttgactttagaggattacacgtcctcgactttagaggattacacgtcctcgcctcagagggcttcacgtcctcgccttcaaagggctgcacgccctcgcctttagaggactgcacctcctcgccttcagagggctacacgtcctcgccttcagagggcttcacgtccttgccttcagaggactgcacgtcctcgcctttagagggcttcacgtcctcaccttcagaggactgcacatcctcgcctttagagggctacacgccctctccacaagagggttgcacgtcctcgccttcagagggatgcacgtcctcgccttcagaggactgcacgtcctcaccttcagagggcttcac

SEQ ID NO: 44464 - DNA, 303 bp, Glycine max
  Peptide Sequence Number=SeqID_136149
atgtcgcccccgtgtggcgacatggatgggggtgaaaaaacattagctctccctgaaaaggaggtgatccagccgcaccttccagtacggctaccttgttacgacttcactccagtcactagccctgccttcggcatccccctccttgcggttaaggtaacgacttcgggcatggccagctcccatagtgtgacgggcggtgtgtacaaggcccgggaacgaattcaccgccgtatggctgaccggcgattactagcgattccggcttcatgcaggcgagttgcagcctacaatccgaactga

SEQ ID NO: 44465 - DNA, 126 bp, Glycine max
  Peptide Sequence Number=SeqID_136150
atggcgcgcagcgtgtttgctccgtgcccctatttaagggacctacaagggagagaactaactaggcatttagcaataaccccccaagaggtatcatccccttcgaaaaacatattgcagcagtag

SEQ ID NO: 44466 - DNA, 387 bp, Glycine max
  Peptide Sequence Number=SeqID_136151
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgggcgctctcctgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaa

SEQ ID NO: 44467 - DNA, 258 bp, Glycine max
  Peptide Sequence Number=SeqID_136152
atgattaggaggggccaagacatttatagtagccaagatgaggctactacttcaccttcctctagtgaaagtgaagaagaaaaaggtgatcaaggggttcccacggaccctaagagaataaaggtcattcctgattggcccactccaccaagtgttgagggaaggagcccagagtatgaagaacctcgggatttgaggtcaaatcctttccaaggtagaagggatgatgcaatcctaccccctaagggtattggatag

SEQ ID NO: 44468 - DNA, 405 bp, Glycine max
  Peptide Sequence Number=SeqID_136153
gtcgactctagaggatcccctgcctggactgtgagggctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 44469 - DNA, 474 bp, Glycine max
  Peptide Sequence Number=SeqID_136154
atgttagttcaggaagaaacgaggcttaagaatcaaggaagtcactcaatccattatgtaagccaccgagggaatcaaggagctggaaaaagatttgtaaagaaacatgataaaggcaaaggaccattaaggatcaaggacggtcctgtgcaaatccagaagaaagcatcaaagaacaataattgtcatttttgtggaaaatctggacacttccagaaagattgcccaaagcgtaagtcttggttcgaaaagaaaggtgagctcaatgctcttggatttcttacaatccagaccataagcccaaatgagaagtttgttttcatggggaatagagtgaaagctccagtggaagcgatcgggacttatcgtttaaaactcgacactggacatcatttagatttattggaaactctttatggaaaaacaagcaaaacatacaaagaaaagagctacaagaagcactcagcttcttga

SEQ ID NO: 44470 - DNA, 249 bp, Glycine max
  Peptide Sequence Number=SeqID_136155
atggtgaaagttggaacctctttcgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaaacaccgccggacatcagcgctggcaaagtgtagcggtcaccctgcgcgtaaccaccacacccgccgccgcttaa

SEQ ID NO: 44471 - DNA, 567 bp, Glycine max
  Peptide Sequence Number=SeqID_136156
atgatgcagcgccgcgggctgggcgatgtggcgaatattcagggcgcgtttcgctccacgctcaccgatgatgcacagctggccagcgcgattcagcaggcatggtttgcagtgcatcagcgggaagggcgactggcgcgcgatcagagcctggatcatctgctcacactgctgtcccggcatctggaaaataaacccggcgtgcagctcagtgacgcccagcggcagatgcatctgctgcgtgactatctgcacgattttatggcgcaggacatcgggctggacgatctgtcgcgcttgtccggcatcgatcgtttccgcctgacgcgccagttcaagcaggcgtttggccagtcgccgcacgcttatctggttcggctgcggctgcgtagcgcccgcgcgctgctggcacagggcgttgagccagtgcaggtcgcagcgcaggtgggctttgccgaccaaagccaccttggccgctggttccagcgcgcttatcgtctgacacccgccgcctatcagcgccagtgcacaaacgttctataccgctctctgccggctatccgatga

SEQ ID NO: 44472 - DNA, 412 bp, Glycine max
  Peptide Sequence Number=SeqID_136157
ggcgagattggcattgtggtcgctaggtagaatgttgctaaatagcaacgtcatccatatccatgtaagagtggtcatgttggtgtgcatgatccgcactcgtctttttgcagcgacacgggtgaaatcttgccccgatatgcatagtagatgcgtgacagcctccctctctggatgtgctcgcacagttggtcgccctctaatatccggggtggcccaggaaccattaaaaggaaactactggccccttaaccggagcgcaagtctcggtgaagcatctaagggcaaaggaccttatattctcttaagtcctctgatggcgaggacatatagtcctctaaaggtgataggtactagtacccaagggtccacctttatgagaaagcaagagatcgactcatcgagagggacg

SEQ ID NO: 44473 - DNA, 430 bp, Glycine max
  Peptide Sequence Number=SeqID_136158
atggtggtttcgtgccttcgacggcctcgccgagagctgtctgttggggcgcctgtggatccactcagtgggagttgtgccctctacactccaccaaaagttgaaattcgtagtggaggggcacttggtcatcgtgtcaggcgaggaagacatcttggtggtcagcatttcctccgtggactccttctctggcagccttgtctgtccgatgcagcagtaatgatggcccgagttatgttggggaacggctataagcccactcaggcagacatgaaaagaagcatcgcgggaaggaagagcagtggtcaaagctcgcgttggagacaagaaagtgaaggaagcccgccctaccacataagtagaagctttataagcgtgggtctgggagacaaaggtcaagtggtcgcgatatacgaagatgatgttccga

SEQ ID NO: 44474 - DNA, 432 bp, Glycine max
  Peptide Sequence Number=SeqID_136159
atggtgaaagttggaacctcttacgtgccgatcaacgtctcattttcgccaaaagttggcccagggcttcccggtttcaacagggacaccaggatttatttattctgcgaagtgatcgtacgtcacagctgtccctcctgttcagctactgacggggtggtgcgtaacggcaaaagctccgccggacatcagcgctggcaagtagcggtcacgttgcgcgtaaccaccacacccgccgcgcttaatgcgccgctacagggcgcgtcccattccccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgccggccagtgaattgtaa

SEQ ID NO: 44475 - DNA, 300 bp, Glycine max
  Peptide Sequence Number=SeqID_136160
atgcatagatctcccactggcaatttatttcctctggacttagaaattgaagctacattgcgaaagaacagggccgagaggagaaggaaacttctgcaagacaaaatagttgcatccattcttgaggaagggactcatttctcttattcattatcacccgattcaccatcatcaagggaatccgccactcaatttcctgaaacaaccagcatggaagatgagcagcaccagaagatcacccttgaggattattcaagcacctcagtaccgcaattgtttactagcattgcacatcctaaa

SEQ ID NO: 44476 - DNA, 439 bp, Glycine max
  Peptide Sequence Number=SeqID_136161
aggcaatccatctgacttacaaccctttgatcctgagatagataggacatttcatagattagttaggcatcattttgtaccttttgagcatcctgagcattctgttattggtgagtctgagcattttgtggttggtaattttgaacatcctgattttgagcattatagttttgaacattctgattttgaacattctgagaacatggcacaacctccaccccatgagaggactctaagggaaatggctgcacttgatttcacctatgaaagcttgtgcatccaataccctgatgaggatgtcccatatgttcttaaaactggactgatccatttgcttccaaagtttcatagccttttaggtgaagacccggagtggcaaaggactagctatattaccttgctccaaggtccatcacaagctgggatgacctcaagagag

SEQ ID NO: 44477 - DNA, 139 bp, Glycine max
  Peptide Sequence Number=SeqID_136162
atggctccgaaaaagctttccgcaaagaggtctaggagagacgccgcggctaaaggaaccagtgccacccccgagtttgatagccaccgtttcgggagcaccgagcaccagcagcgcttgaaggctatcaaggatggcg

SEQ ID NO: 44478 - DNA, 180 bp, Glycine max
  Peptide Sequence Number=SeqID_136163
atgggtgattttggggaactcgtgctcattgcaaggatctttgtttgtttctactccaagcatttggtttgtggaactcgtgctcactgcaaggatttagtttatggaagtcgtgctcattgcaagggtctcattttgagtgaggtaattcagattgctgggtgtcctttgaatgcttaa

SEQ ID NO: 44479 - DNA, 204 bp, Glycine max
  Peptide Sequence Number=SeqID_136164
atggagaattggcgaacatcgctactcaataacttcgcggggctccagactcgatggtggaggacacatgaacagcacaaggcaatgaattcatgggtctccgaaaaaagtggagaatggagaattggggaacagcgctacgcaataacttcgcggtgctccagactcgaaggtggaggatgcatgaacagcgctaagcaataa

SEQ ID NO: 44480 - DNA, 582 bp, Glycine max
  Peptide Sequence Number=SeqID_136165
atgatgctggatcttgaaatcctcgcacatttcctacatcattttgttattcagattggtgccattatcagtaatgattttcctggggagtccgtatcgataaatcagttccctctttatgaatctgaccaccacactcctcgtgacattggtataggaagccacttcgacctatttggtgaaataatctatcgccacgagaatgaagcgatgaccgttcgaagccttgggttcgatggcccctatgacatctatcccccacatggaaaaaggccaaggggcggacatgacattcagaggatgtggcggaacattgacattgtctgcgaacgcttgacatttatggcatttcgttacatgggtgcagcaatcgctttccatagtgagccagtaataacctgctctaaggatcttcctggccatagcatgcccattggcatgtgtcccaaattaaccctcatggacttcctcaatcatgtagttcgcctctttggcatctacgcatcgcaggaaggtcatgtcatggtttcatttgtacaggacggtaccactcacaaagaaaccagtagccaatctccttaa

SEQ ID NO: 44481 - DNA, 375 bp, Glycine max
  Peptide Sequence Number=SeqID_136166
atgatgggttacacatcttcaagttttacagatttggtcttcgccagcaaaaagatcgaagtgggtctgaaaagaggcaaatttaatcatcctgcttggacgaatgagaaaactggggcaaatgaagagggtgaggatgagggagaaacccatgctgtgactactattcctgtacggccgagtttcccaccaacccaacaatgtcattactcagccaataacaaacctcctccttacccaccacccagttatccacaaaggccatccctaaatcaaccacaaagcccacctaccacacaaccaatgctaaacaccacctttggcacaaaccaaaaaaccaaccaagaaatgaattttgcagcgaaaagcctgtag

SEQ ID NO: 44482 - DNA, 72 bp, Glycine max
  Peptide Sequence Number=SeqID_136167
atggcccgaccaataggcaacccaagtccaaagccaaaggtagcaagataccttggatatgcatgtatatag

SEQ ID NO: 44483 - DNA, 450 bp, Glycine max
  Peptide Sequence Number=SeqID_136168
atgtacgaccagctgaacgatgcatctatcagccacaatcgacagcttggcaattacatcacactgctgcagtgctggatttatgagcactttccatcagtcaaggactccactgctgatcaggaatacgacgaggcttccccacgtgtgtgtaggtggattgcgacgaagaagaccgtgaagagcatacgtacaccggcgtacagggagcgcctggaccgactctggattccggatgtctactggatcccgtatggggagcaccgatcggtctgggacttccaagtcatatcatgctattctggtctcttgcgctgggggcctgttgctgtttattaccgaccagagaaggttgtgcggcagtttggatacacgcagaccattcctgctcctcctgtccattcatgggtgtcgtatgatgatatacacgacaggtggacgcactactag

SEQ ID NO: 44484 - DNA, 669 bp, Glycine max
  Peptide Sequence Number=SeqID_136169
atgcttggtgcggcgatagagaatgtcttccgccgtcttcgcccattcttttgccaccagatagcgcacttccgcttcatggaagttgccgccgaaatgacggccaagcccttcgaggttctgcgcgcctgcaaccacgtccttcgtgcgtgcgccatagagacgcccgtaatgatggacgagcgtgcgcggcatccacggataggtgtcgcgcagggaattggcgaaggtttcataatcggcattggcgatttcgccgccgggaagcggtgcgccatgcgtccagtcgccgcccattttcgggaaaatgtgcttgaggcgatgcatgccgcgttccgccagttcgcggaaggtggtgatcttgccgccgaagacgttgagcaacggcgcatcgttggtttcatcgaggtcgaagacgtagtcgcgggtgacggcggaaggattgcccttgccgtcgtcaaacagcgggcgcacgccggagaaggaatgcagcacgtcttcacgcctgagcttttccttgaaatagcggttcacggcggtcagcagatattcgatttccttctcatccgccgcaacatcttcggcgcgcccttcataggcgatgtcggtggtgccgatcagcgccttgtcgccctcataagggttgatgaagatcacgcgcttgtcgtg

SEQ ID NO: 44485 - DNA, 302 bp, Glycine max
  Peptide Sequence Number=SeqID_136170
gtgttttgatgataacaaaagatgatgacaaaaagctcaaagatcaatcaaagaacaactcaagtgatcaagatagaatcaagaacaattctagagttcaagatggaatcaagaagaattcaagactcaagaggaaagttaagagtcaagaatcaagattcaaggttcaaaatttcaagaatcaagatcaagattcaagactcaagattcaagaatcaagagaaggcctaatcaagataagcggatcgcttgatacaggctacgaatatttggatgacgccacttccagtgaaggaagataa

SEQ ID NO: 44486 - DNA, 559 bp, Glycine max
  Peptide Sequence Number=SeqID_136171
cgattgacgctttcctcgcctttcatcatggcaaggaaagcccggttatcgccattttggccgacatgtatgacacgttcgaccgaagatgcttgtgtgtccgctacaaggtcactgctcgtgcgccgagaaaggaaaggcgaattgggaccaactcttggctagcatggagggggcgtccgttaattggttccctcactggaaggaaggaagaaccgggattttgtcctcgtgtgaaggatttccaatgttcccttgatgggaacaagggtgaccccaacacaagggtacttcaaggagtttgcaaggcatgggatgcggtgcaaaggaaggacaaagagcttaggggaagtagtaatgggatcatcggcgactatcgtaagtggctgagagtctacacacgaggcttagattggctcccaaagctaagggctacgagagaggaagaggccgaagctccggaagagagtgaagaggtacaagccctaaaggtggagcttgaaagagcctgggcagtcaaagagaagttcaagtcaacggccatcaaagttcgaagaga

SEQ ID NO: 44487 - DNA, 87 bp, Glycine max
  Peptide Sequence Number=SeqID_136172
ggagcaggggcagctgatgaagatggggcctcagatcttctagccctggatttttcggtccctggaaaagtggctgttagtgcttag

SEQ ID NO: 44488 - DNA, 543 bp, Glycine max
  Peptide Sequence Number=SeqID_136173
gccgtaatatccagctgaacggtctggttataggtacattgagcaacttgactgaaatgcctcaaaatgttctttacgatgcccattggggatatatcaacggtgttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggggatgctgccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatctgctgcaaggcgattaagttgggtaacgcca

SEQ ID NO: 44489 - DNA, 336 bp, Glycine max
  Peptide Sequence Number=SeqID_136174
atggcgactccgcacgtattcctttcgtggaacacgcatcccgcaagtcacgcgtcgccctcccgcaaaagggtaggttgcgacaacaagtacaaggggactacttgccccaagaaccatctaagacgatgcaactacagaacatttgcaaaaaggggggcggatctttcaaagaacacgcccaaaaggtggagggatctggcggcccaggtgctacccccaatgatggaaagggagacgatgatcgtgatggtagacacattatcgatactttactatgaaaagatggtgggctacgcaccctcaaagctttgcggatttggtcttcgccagtga

SEQ ID NO: 44490 - DNA, 252 bp, Glycine max
  Peptide Sequence Number=SeqID_136175
atgaatgagaaaactagggcaaatgaagagggtgagaatgaaggagaaacctatgctgtgactgtcattcctacatggccaaacttcccaccagcccaacaatgtcattactcaaccaatatcaacccttctccttacccaccacccagttatccacaaaacccacctaccacacaaccaatgctaaacaccacctttagcacgaaccaaaacaccaaccaaggaaggaattttgcagcaaaaagcctgtag

SEQ ID NO: 44491 - DNA, 342 bp, Glycine max
  Peptide Sequence Number=SeqID_136176
atgtaccctctcttgttctcagttacaacaacccaagtagatgtaccctctacttgtaccacaaaggatgtaccctccaatgtgttaagacaaagttctcaggcggttagtcctttgaaactttgtgaaggggaaacaaaagatatctcaggcgaacaaggtttggaaaccagaaaacttagaaagcttttggcaaaggaagaagaagaagaagttcaaaaagatgttcaaaagttgtgtgaaaaagttattcaaaatgcaagtcaaggtcttgcttttatagactcttcatgtctggtcaagaaaaccattggaagagttataaccttgagaaaaacctga

SEQ ID NO: 44492 - DNA, 267 bp, Glycine max
  Peptide Sequence Number=SeqID_136177
atggtgaaagttggaacctcttacgtgccgatcaacgtctcattttcgccaaaagttggcccagggcttcccggtatcaacagggacaccaggatttatttattctgcgaagtgatcttccgtcaccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 44493 - DNA, 120 bp, Glycine max
  Peptide Sequence Number=SeqID_136178
atggacattgtacttgggcttctgatgcaatcctatcccgcaagggcattgggtagaagactccaagtagattgggctagagatccaagggaaggccctagggttctcatgagccttagg

SEQ ID NO: 44494 - DNA, 267 bp, Glycine max
  Peptide Sequence Number=SeqID_136179
atgaagccttgcttctacattgatgatgctccacagcctaaatcaaaggcttctgctaggtggattgtcgtcaagtgtaatagacaaaaaggaagtactgagtgcggctactatgtgatgcactggatgtccaccatcattttaggaacttttaggaataattggaaagcgtattttaacgatcctaaaccattggagccaaagagattaaaagcattgcggatccagtgggcacagttttatctccgagttaaaaatcaggcctag

SEQ ID NO: 44495 - DNA, 607 bp, Glycine max
  Peptide Sequence Number=SeqID_136180
agatgctatcggccaactcctgggatatcctttagtgctggaagagggccaggagtgcgagtatggccagaggaggaaccggtctgatgggttcgatgaggaggccatcgcccagttgctatgtataccggggcaagattttgcccggactgctgccgggagacgggtgcggatcatgcgcaccaacatgaccaccctgactcagatatggatgactttgctgctcagcaacatcctgcccactgatcataattccgacctccccctgccgaagtttatggcgcctaccaggcaccctctggacccagataagtccaacagggccctgggatttcccgccttgatcacgggactctgccagtcgttcggcgtccccgtcacacccagcaaggtgattcggccgcccatcacccgagcttttattgagaagtactccacgcagagacaggtccagggtgatgcaccacaggccgcgggcgtgccgccacctcatcaggctggcccagccggattgtttgatacagagcagtatttgcggcatttggttcgccaacaggcgaccaaccacgggcacatgtacagactcatggttgtctgtatcagatga

SEQ ID NO: 44496 - DNA, 294 bp, Glycine max
  Peptide Sequence Number=SeqID_136181
atggaagaacgaatgaagaacgtcgaaggaacggtcgaaactttgcgaaattcctcacggaaaacgttacggagttcgaaaataggggaaggctcttgcccctcgcccaggcgagctcagctcgcccaggcgaccacggttgctttccttaagaagcaacagccttctggaggaatcttctggagggcccaagtgggcctggttgactatttgacccccatttttactgaagatacaccccctctgcttttttttgtgatcttttttcgtaaagttacggaaacttacgattga

SEQ ID NO: 44497 - DNA, 201 bp, Glycine max
  Peptide Sequence Number=SeqID_136182
atgaccctttcatcatggcagaacaagctaaacaggaaaacaattggtgttaatgtagaagatgatgattcatacacggatacttatgttagtcctttgtccacacaaatgacttctaacgtcatcggagaagaagaagctgatgacgttcatgctaatcgtaatgatcatgatgaaggagaattaattaacatcgtctaa

SEQ ID NO: 44498 - DNA, 984 bp, Glycine max
  Peptide Sequence Number=SeqID_136183
atgcttgccgctagaagtcactgttcatgcacagataaaggaggtgcaaattgggaccaactcttagcaaacaaagaaggagcgtctatcaactggttccctcgacggaaagaaggaagaatcagagttcttatttcgtgcggaggatttccgaatgttcccttgatggggacgaggggttgcatcagttataatctcgttcttgctataaggcaacttggctaccctatgagagggccaccactagaggaagagatcgcgcctgtcatttcacgaggtttcaataagaccaacgtggagacacttcagaaggtccgcaaggcatgggaggtggtgcgaaagaaggacaaggaacttaggggcagtaacaatgggctcatcggtggctaccaggaagatgaagaggtgcaggcccttaggacagaactcgggcaagctcaaatagtcaaagaaaggttcaaatcagcagctctgaagatccaaaaggagaatgccgaactgagagatataaatacagctaccaccaaagccttggaacaagagaccaagagggcttgtagggaagagcacggccggaacaaattccaagggactctatggggcagcaacaacgagcttaagctccggagagaggaaagggaccaatcacaagtggacagtttgatcttgaaagatgagttaaagcaagtaccaagaagaactaaatcagccacggcccacgagcatagagtggcggacgagtatgcccaagtgtacgcggtaaagaaggctagaggtagggtgatcaactcgttacatcaagaggcaacaatatggatggaccgattcgctcttaccttgaacgggagtcaagaacttccccgattgctagccaaggccaaagcgatggcggacacctactccgcccccgaggagatccacggacttctcggttattgtcaacatatgatagatctaatggcccatataattagaaaccgctag

SEQ ID NO: 44499 - DNA, 479 bp, Glycine max
  Peptide Sequence Number=SeqID_136184
ggcttcccggtatcaacagggacaccaggaatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgataacaaaagatgatgacaaaggtgatgacaaaaagctcaaagatcaatcaaagaataactcaagtgaatcaagaacaattcaagagttcaagataagaatcaagaagaattcaagactcaagaagaaagtttag

SEQ ID NO: 44500 - DNA, 307 bp, Glycine max
  Peptide Sequence Number=SeqID_136185
aagtgctaaagttgatgtctcgctaagcgagctcaatgcgcttagcgagtgtcatccgctaagcaaggcatcaacatgcttagcggataggaggaatctggaagggaatctatcatgcaggcatgcgttcaacgcgtcatcagctcactcagcgagttatttgtcaccttccaggcttagcgcgagtttggcactgagcaaaaattcactgactcgtgctaagcgcgagaatggcgctaagcgcgacgtcaaggagcttccttgctatggaaggctaaatcctcagttggggattcttgctgagtaa

SEQ ID NO: 44501 - DNA, 300 bp, Glycine max
  Peptide Sequence Number=SeqID_136186
atggtgaaagttggaacctcttacggtgccgatcaacgttcttcgccaaaagttggcccattgggttccgcataccagccggaacataggggcaagtgtaaagccggggtgcaaacgctgacgctaccactcacacgccgcgttaatgcgccgctacagggcgcgtcccattcgccttcggtgcgcaactgttcgggaagggccgatcggtgcggcactttcgctattagacgccaacgctggcgaaggggatggctgcgtttgcgtaattgggtaacgcctttcagcggacgtgtataa

SEQ ID NO: 44502 - DNA, 165 bp, Glycine max
  Peptide Sequence Number=SeqID_136187
atgcaagaaaatgaactgtgttttctggaaaacgtgatgaactcgctaagcgagcttgatacgctaagcgagttcatcaaacttgtttaccgtgctaagcgagttcatcttttgaggatgaacactcatcctcttgctgaactacctgtggctaagcgaggatga

SEQ ID NO: 44503 - DNA, 420 bp, Glycine max
  Peptide Sequence Number=SeqID_136188
atgacattgctacttagcaacattctgcccagcgaccgcattgccaatctccccctgcaaaagtatcagttggtctgtgtcgtcccgacgtgggtaaggatcgcacccacaaagacactagtggacccgaaaaagtcaaacagggccctggggtttccagctctggttacgggcctctatcagtcctacagggtgcccgtacccccccggcaaggtcacgtcatcatagggatcgcgcctgcaagacacccagtggacccgaagaagtccaatagggtcttggagttgtcaagctctaattacgggtctctggcatcaggccccctactaatcgagctttcatcaagaagtactgcgcccccaggcaggcgcagggcgaaacaccacagcagcattgggatggccggtagcgggcaatag

SEQ ID NO: 44504 - DNA, 765 bp, Glycine max
  Peptide Sequence Number=SeqID_136189
atggttcaggcgccgatcttccacgttaacgcggacgatccggaagcggtcgccttcgtgacccgtctggcgctggacttccgtaacaccttcaaacgcgatgtgttcatcgacctgttctgctaccgccgtcacggccacaacgaagccgacgagccgagtgcaacccagccgttgatgtaccagaaaatcaaaaaacacccgaccccgcgcaaaatctacgctgacaagctggaaagcgaaaaagtggcgacgctggaagatgcgaccgagatggtcaacctctaccgcgacgcgctggatgcaggtgaatgcgtggtgaaagagctgcgtccgatgaacatgcactcctttacctggtcgccgtacctcaaccacgagtgggatgagagctacccgaacaaggtcgagatgaagcgcctgcaggagctggctaaacgcatcagcaccgtcccagacgctattgagatgcagtctcgcgtggcaaaaatttatgctgatcgccaggctatggccgcaggcgagaagctgttcgactggggcggcgcggaaacgctggcttacgcgacgctggttgacgaaggtattcctgttcgtctgtccggtgaagatgcgggccgtggcaccttcttccaccgtcacgcggtcgtgcataaccagtccaacggttcaacgtacaccccgctgcagcacgtgcacaacggtcagggccagttcaaggtctgggactccgtgctgtctgaagaagcggtgctggtcttctaa

SEQ ID NO: 44505 - DNA, 426 bp, Glycine max
  Peptide Sequence Number=SeqID_136190
atggaacccctccaaatgcaagccttccgcaagaataacggaaagatcttagagttgaccatagcagaggtgtccatagatgccattgcatcacttactcaatgctacgaccaggctatgcgctgcttctcatacggggaaaaaccagatttttcctcccggtgtctcccctctctgagcagaattgcaactgtggtcaaggattcagcaagaggtttggaccgcataaaacagactcggaacggcatagcgggcctcccacagaagtacctagaagacaaggcgaggggtatggccaatcaaggagactgggtcccgtttatggatgtgttagctttgctaatttttggggtcgtcctctttccaaacgtggatggtttgatagacctagcagcaatcgacgctttcctttgcctaccaccatag

SEQ ID NO: 44506 - DNA, 153 bp, Glycine max
  Peptide Sequence Number=SeqID_136191
atgaagaaacaacaatggaggagaagcttcaataatgatgcaatcctaccccccaatttggatagaagactccaagaaaattgggccaaagatgcagcagaggaccctagggttctcatgagccttagggtagattttgggcccatgggctaa

SEQ ID NO: 44507 - DNA, 560 bp, Glycine max
  Peptide Sequence Number=SeqID_136192
atgggggcaaatcaaactggcaaaaggttttatcaagtcaagattaagggcctagatatcaccagcattaaggagttgaggcggttgatgggacctctccaaatgcaagccttccgcaaggcgtacggaaaaatcttagatttgaccatagcagagatatccacaaaagccattgcatcactcacccaatactatgaccagcccttgagatgcttcacgaaactgtatcttttctctgggttgcttccctccttgagcaaaattgcaattgtggtcagggattcgacgagaggattggaccgcgtaaagcaaactcgaaacgacatagtgggcctaccacggaagtacttagaaggcaaggcgagggatatggcgaatcaagaagagtgggtcccgtttatggatgtattggcattgctaatctttagggttgtcctctttccaaacgtggatggtttggtggacctagccacaattgatgctttccttgcatatcaccatagcaaagagagcccggtggtagctttcttggcggacttacttgacacgtttgaccgaag

SEQ ID NO: 44508 - DNA, 256 bp, Glycine max
  Peptide Sequence Number=SeqID_136193
caaatgagactttttcgcagactcagccgaaagatgttgacatcttcagggaaggtgctgatgacaattctcggccggaaaatgctgacatctccgggaaaggtgcagtcttacggatagcaaatgagactttttcgcagtctcgtccggaagacgctgacatcttcgggaaagggcgtctccgcgtgccaacggactcacaggtcacgatagcaaaaggtggggcggtcgacaaaagcgaggcttttgctcctac

SEQ ID NO: 44509 - DNA, 417 bp, Glycine max
  Peptide Sequence Number=SeqID_136194
atgatatcaaggtacgttttaaatgaaattgttgctgagtataagcgtgtagcttatgcaggcaaaaatccttcacgttgtggatgtgtcatgaggagtacacatggtcttccatgtgtatatcaagggttatgtgagacacaagtgaccataattgaggagatggaaaccatatcgaaatgctttgagcagctcgatgtttgcggtaaagtacatttgaagtcaaagctgcgagaaattgtttatcctgatatgaactctatgtgtcctcctccagaaaaggattctattgaaaacattattgatatcaaaacggatggtaattgtggttatcgagcaatagctacgttattgggtatgggtgaaaaatcatggtcattgatgtgcaaccatatacatgaagaattgacaagctga

SEQ ID NO: 44510 - DNA, 186 bp, Glycine max
  Peptide Sequence Number=SeqID_136195
atgctggaaagttttaaacaacaacaagaaatgtcagttctagaattgtacatagaaaaggatgtgacagagtctttagacgaagatgatagtgttgatgatatatctgatacagacaatgaagtccccgagatgattccaccagtaagaattgttcacccagcagaaggtataatttcctcttaa

SEQ ID NO: 44511 - DNA, 859 bp, Glycine max
  Peptide Sequence Number=SeqID_136196
cagtgtgcgcctgcgggcgcaaagcgaaagcaatggcgacacccgcctgcttttagacgtagcgctggaaaagggctggaaaacctactggcgttcgccgggcgaaggcggcatcgcgccagctatcgcctggcacacgccgctggaggtgaactggcgctggccgacgccgcaacgctttgacgtcgcgggtatttccactcaggggtatcacggcgacgtcagcttcccgatgaccctgcgcggcaaaataccgccgacgctcagcggcgtactgacgctctctacctgcagcaatgtctgcattctcactgactaccccttttcgctggatatgacggctccggcgggggagcgttttaattacgatttcacccgcgcgatgggcacgctgcccctgcgcgacggtctcacctcggcgcttagcgccagctacgtcagcggaaagctgacggtaaccgcccgccgcgatgccggctggcagcagccagcgctgtttatcgacagcatggaggatgtcgatttcggcaagccgagctttaccagccgcggcgatacattgaccgccaccgtaccggtcaccgatagctggggcgaagcggcgccggatctgagcggcaaaacgctgtcgctggtgctggctgatagcggccaggcgcaggaaagccatatcgccatcgccgccggcagcgccgcgccggggctggcgttaggctgggtgctgctgatggcgctggccggcgggcttatcctcaacgtcatgccgtgcgtgctgccggtgctggcgatgaaactcggctcgctggtgcaaaccgaacgtcgcgaacgcggcgcggtgcggcggcagttcctcgcctcg

SEQ ID NO: 44512 - DNA, 378 bp, Glycine max
  Peptide Sequence Number=SeqID_136197
atgccggacacgcgaaaatgcactacgcccttcggccgaggtcacgggggtgcgacggagatgcaggcaaatggcagaggtcacggcgaggtcacggtagatcgaaatctcagagaaacagggaagcgagagctcgagcgcgagtggtggctcaagaacaacgtcattgacattcaaaatttcaacgatggtgttttcaaaagcaccgtcttaacttacctgctgcgcaacctacaaagacaggcaccccggtcaacgttgttgaatgtgtcacgcgccatgcacatggcacataaaatggtaacatatttacaaaattgccactactactcctactacgacgggtatggcgggaacgatgtggatagcgtgtcgtaa

SEQ ID NO: 44513 - DNA, 725 bp, Glycine max
  Peptide Sequence Number=SeqID_136198
cgaaacccgtgagccttgccctcgctcgcccgcaaaagggcacgttgcgaaagtgaagatagacgctgacagcctcaacacatttctagagactccagtagtcctagaggagggggagacattacccacctactctaggtactacaggttacccacagaccatagaaagattgaggttgctttttgcatagcagggatggagttcattttgaatgctaagggccatccagggaggattctcaagaaggatttgactaccttggcccaggtgtggagtgttctctcttactctaacctggcccctacatctcacacatcagatcttactgtggatagagccaggttgatctttggcctggtctctcatatggacatgaacatcggtgctcttatctcaggacagatgacttccattacccagtctaactgttgtagattttggtttcctgctttgatcaccgccttatgtcgagcccgaagggttgtctctgacagcctcacatttgagcgcttgagcccggccattaacttggcctacatcaggaagtactgttggaacattgattatttaacagttgctttccaggggactaggagggcaagggcgaggctagctgatattccatcttcttctgcagctccagcatctacttctgcagctccttcagttccagctcatgttgactcgcaacattttgaagccatgcttcaaagtatcaatcagg

SEQ ID NO: 44514 - DNA, 334 bp, Glycine max
  Peptide Sequence Number=SeqID_136199
atttcaagctctcttagagcacaaaatttcgtgctcttctctccctctcccttcattcatctccttcttcctccaagctcttatccatggcctcctatggtgtggcatctcttttctctcttccttctccattccgctgccattcatcttccaagaagcaaaggaatccattgatgaagaagatcctaggcctacaagctccaatggaggttacatcaagacacctaggattgaactagctttccaaatagaaagaagttccccgacaacggcgccaaaaacatggtcgagtccgacaagtgcaccggatagcacaagtagtataaaacattaa

SEQ ID NO: 44515 - DNA, 798 bp, Glycine max
  Peptide Sequence Number=SeqID_136200
atggctcccgatgaactagagcaactgactcaacaaatcaaggaccagctggaggagtcgatcacaaaaaaagtaactcgacaactgatgttatccttcagccagatgcagtcccagtttcagtcacagatgcaatcacagggacttgcactgcctctggagcctaaggttggtcctttagctgctcgtgtcagcacaaaggagagttgtgttgatccctcagtgaccgatccaaacacgggtgacttggacaaatgcgggttgtacatctcaaaaaatcctccccgcctggttgccctaggaagagtttatgagggatccacaaccgttcacaacatccctttgttgcatgatcaagtgaaggtcggtgttgaggaggttaaagatgcagatgctcccattcttgtacccactgacaaggttaacttagtggggcagacacttaacaccttccttgcttggccaacacttctggtgaagcgtttatcagaacaggttatgtgggatgctatagtgttcggggtgtttaatcaagacttccccttgtacataaagcacgaagatctgtctgaaatagcacacggtggtcaatgtctcagcatctctattatacagttgtggattctgcatctgactgagacaagtatgcgagcaaggaattccgatgtgtgtggattccccaagccacagtccatccagagatctgggcaatcgcaatttgaatcagaaagttacatgaagaactggatgcagaattcaaaacgcgatgtctacctaggagcctacctgaatgggtaa

SEQ ID NO: 44516 - DNA, 222 bp, Glycine max
  Peptide Sequence Number=SeqID_136201
atgatatatgttgttaaaaatgtgaggatccccaagtatttggacttggaatggttctctcagcaagtgttcaactttcctaatcttttggaagcacagggattgtcaaagatggccttggatcttcttcatcaatggagtcatttgcttcttgaagatcaatggcaggggaatggagcaggaggaaaggtgattggagatgtcactttaaggagaagatga

SEQ ID NO: 44517 - DNA, 315 bp, Glycine max
  Peptide Sequence Number=SeqID_136202
atgtggatggatcggtttgctcttactttgaatgggagtcaagagcttccccgtttgctggcaaaggccaaagctatggtggacacctactccgcccccgaggagcaaatggcttccatgatggatgccatgcttggaatgaaacaactaatggagagtaacgcggccaccgccgccactgttagttcagctgccaaagcagacccgactctcccaactgccgcgcacccccctttttcaaacgtggtggaacgagagaaaagcacacaggggcacgtcagcaacccccatccgggttataaccgaggaggttga

SEQ ID NO: 44518 - DNA, 266 bp, Glycine max
  Peptide Sequence Number=SeqID_136203
atggcaagcaatccttcaagagcacagaagaaagcaaaaacttccaagacgaagcaagctcaagcattgtcaaatctggtgtggatgaaaggaaccttttgtccaaagctagtcaaggttttctacacctatgcatctgctgaccttgaaggtaacctcttctctactgtaaatggagtagaaatggtcatttatgttgttgggtggaaggaagtagccgatctagatatgggtggagtccgcaagtttgatgaaacggatgatgg

SEQ ID NO: 44519 - DNA, 725 bp, Glycine max
  Peptide Sequence Number=SeqID_136204
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtgctattgatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44520 - DNA, 842 bp, Glycine max
  Peptide Sequence Number=SeqID_136205
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctcggcatcaaccaaactgacttgcatggacgtagttgttgctgatgaggtttggatgcaatctataggcgacatggagccatttcccaagaatgaagtcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44521 - DNA, 567 bp, Glycine max
  Peptide Sequence Number=SeqID_136206
atgacagttgatttattagaagatatgaattctgaatctccacaagcatctgattctaattctttctctgacgatgaaaattgcgaatccaatactaatgaagctgcaatcgatactgaaggctattcagacttgggtgatcaggccatgcaatgtacacattgcaatgcaaaaatgtggtatgatgaaagaatttcaaaagatagaaatacaacaagtccaaaattcagcttatgttgtggagatgagaaagttgagcttccgttattacaaagtccaccgaaatatcttgaacgacttctgtttgatggtaaagaaagtgatagtaaaaattatcagtgcaacatacggacatacaacatgatgtttgcctttacgtctgctggtattaagctagacaaatcaattaatgaaagtagaggacctcctacaattagaattcagggtcaaccatgccatcgaataggcagcttattaccaatgcctggaaagcaaccaaaattttcacaattgtatatctttgatacgcagaatgaagttgaaaatagaattaatacaatgaggtag

SEQ ID NO: 44522 - DNA, 177 bp, Glycine max
  Peptide Sequence Number=SeqID_136207
atggatcatggatatacttacggagttgagacacatgaaagatattgtgaagagcgttgtgtcttgacgtccttcagtacaaggttccttaaagcaattcacctagtcatcctgctccccgaacacaaagttcaagatcatcacaggatccaaacacaaacaacacacggggagtga

SEQ ID NO: 44523 - DNA, 180 bp, Glycine max
  Peptide Sequence Number=SeqID_136208
atgagccaaagaggctcccgccatgccacatcagtaggagcttcatccgacgacgagtcccacgaaggttctaatgctggggacccggccgtcaatttcgagcaagaagcaagtcggacggaggatgaagaggacgaggatgtagggcttcacccaaagatggagaggataatcgcttag

SEQ ID NO: 44524 - DNA, 610 bp, Glycine max
  Peptide Sequence Number=SeqID_136209
tcaaggtgcaccttttgagggcaccattgttgatgactggaaatttgattattctagtcatgatgctcgtcgtatggtatgcaatgaccaggctgaaatgaccgcctctaaggaggatttgattctgatgtgggctttccttaccggtcgtcaaatcgactgggcccacttggtttggtaccgaatgcataaggcattacgggccaatgcacctctcccttaccctcaattgataactttgtttctgcgtcattttcaaattccgcttgatgatgaaccatttgttcaagtcaagcactcttttgcaattggtgctggtgcagtgacttcctttggataccataagaatcggaatggtcaatggctgaagaaagacgcactccctcctcaagatgagcgtactccttcaccttttcctcagcgagatgattcagcacttatgaatgaagtcctttccgaattacgaggtcttcgttcttatgttggtgaatgtttcgactcattggatacacgttttgtcggaatggatattcgcctcatacagcttgaagaggatgtgtgttacatttgtcagagttttgatcttccaccaccacctccaccttcttag

SEQ ID NO: 44525 - DNA, 588 bp, Glycine max
  Peptide Sequence Number=SeqID_136210
atggtcgaaagggagatgatagacaccttgccagtgttttactatgagaagttggtaggctacatgccttccagcttcgcggacttggtattcgccgaggaaagaatcgaagtagggttgaagagagggaagttcgattacgtctcctccacaagtaccaatgctaggagaatcagagcaactggggaaaaaaggaaggaaggagatacccatgccgtcacttcgacgcccgcatgggtcaagcccccgcagacctctcatggtacccatcaatacgcgcaacatcatccaagcttctcagctcgcgctgggaactcctccaattcagcacccgtacagcctagagcgcccacccccatccagagggaggccccccaagctccggctccaaccacgactcgcccggtcggcaatgctcactttggtgccggttccaacgcgatgaggaactttcccccgaggccaattccagaattcaccccgatcctaatggcgtacgaagacctcttttcatccctcatcgccaaccaaatggtcgtaataactcctgggaagatctaccagcatcctttcccaaaatggtattga

SEQ ID NO: 44526 - DNA, 219 bp, Glycine max
  Peptide Sequence Number=SeqID_136211
atggaagcttgcttgtggggcttctatggaggctggatctttgagcttcacggaagacaaaggagaagaggtgagaggaggcgccatccactagggaataagccatggaagaaggagcttcaccaccaagatgagccttggatgagaagcttggagaggatgcttcaatggaggaaaagaaacagggagagaaagagaacggggggagcacgaaattga

SEQ ID NO: 44527 - DNA, 159 bp, Glycine max
  Peptide Sequence Number=SeqID_136212
atgggggtgcaaatagcaaccaggcccacttgggccctccagaagattcctccagaagccgaggcgcttccgaaacgtttccgtaaggaatttcgcgaaggtttcgaccgttcttcgacgttcttcattcgttcttcatcgttcttcgatcttcaacgg

SEQ ID NO: 44528 - DNA, 515 bp, Glycine max
  Peptide Sequence Number=SeqID_136213
gactgatagaggcccgtaaccagagctggaaaccccagggccctgttggacttttccaggtccactgggtgtcttgtggggggagattggcattgcggtcgctgggcagaatgttgctaagtagcaatgtcatctatatctgtgtaagagtggtcatgttggtgcgcatggtctgcacttgtctctttgcagcggtacgggtgaaatcttgccccggtatgcataatagccatctgacagcctccctctctggtcgtgctcgcacagttggccctcttccaatatcaggggccctctcaaggcgaggacgtgtagtcctcttcaaggtgagggcgtgcagccctctgttggcgaggacgtgtagtcctctcaaggtgagggcgtgcagccctctgttggcgaggacgtgtagtcctctaaaggtgagggcgtgtagccctatgaagctgaggacatgcagtcctctgaagatgaggacgtatagtcctcggagccgagggcgtgtagccctctaa

SEQ ID NO: 44529 - DNA, 524 bp, Glycine max
  Peptide Sequence Number=SeqID_136214
tgatagatattgatgtttctgagcatcaaattgccaaggaaatcactgccaaacgagtccagcattggccaaagaaagggaagctttcagcagggaagctaagtgtgaagtatgcaattctacacaggattggtgctgaaaactgggtacccaccaatcatacttccactgttgccacagaatcatttgctgtcaaattacccattgccttccctactgggacacatgtcccagacagtgtctcgacatcagggaaagctgcttcaggtgctgtgtccaaggataccttgattgctgaactcaaggacacatgcaaggtgctggaagcaaccatcaaagccaacacagagaagaagatggagctagaacggctgatcacaaggctctcagaaagtggcattgatgatgaagaagcagctgaagaagaggaagaagcagccgaggaagaagaagaagctgctgaggaagaggaagacgcagcagaagagacagaatcagatgatgattctgaagccaccccatga

SEQ ID NO: 44530 - DNA, 761 bp, Glycine max
  Peptide Sequence Number=SeqID_136215
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttatctgtagttgactggggacatggtacaagaagagaaggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44531 - DNA, 150 bp, Glycine max
  Peptide Sequence Number=SeqID_136216
atggataagagcttgaaggtaggagaagatgagtggagggagaagaagagaaggagcatgaaattttgtgcctcaattgagctatggttgagcccactaatccaagatcaagtccaagattcaccactaagtgtgcttagctgtcatgag

SEQ ID NO: 44532 - DNA, 176 bp, Glycine max
  Peptide Sequence Number=SeqID_136217
cgccagtcttctttctaagtctaagggttaaaggcggtgtgcttaacgagttcacactcgctcaacccctctgtacagctaatccttcttccaaattcttctacgcacttagccggagaatggtgcacttagcggatgactcgcccagcgcgtggcctggcttagcgagttcataa

SEQ ID NO: 44533 - DNA, 843 bp, Glycine max
  Peptide Sequence Number=SeqID_136218
atgcgtatttttataacgggtgcgacgggctttatcggctcacgcgttgtatcggccctgctggctcgcggccatcaggtgaccggtcttgtacgttcagaagaagcagctcagcagttaaacgataagggcgcgacagcccagcgcggtacgctggaagatccccatgcgtggattgccggcattgaccaatgtgatgcggtgatccacaccgctttcgatcatgatttcagccgttttgtcgaaaattgcgaaaaagaccgccgcgttattcgcgcgattggctctgtattgcagggcagtcagcgtccgctgctcatcacatctggtaccggaatgggtgatgacggcagcggccagcccgctcttgagcagaatttcaacccggcacaccctaacccacgcgtcgcctcggactggaaggttcacaacaccgaacgtcagggattaatcagctattacatcgctcttgccagggagaaaggcgcggcagcttatatcggcggaggtgaaaacgcctggtgcgcggcacacgttgatgacgtcgcggggctgtacgtaaaagtgcttgagcaaggcgaacgcggcaaacgatatcatgcggtagcagaggaaagcattgcctcacggctgattgctgaaaccgtggcagcagggctgggtattcctgccgtttcgctgaaacccgatcaggccgcggagcatttcggctggttcgccgctttcgccaggctggatctgcgtgccagcggtgcctggacgcgtcagcagctcaactggcagcccaaaggaccgggtcttatcgctgatttaagcagagcgaattattcaacccagtcgtag

SEQ ID NO: 44534 - DNA, 570 bp, Glycine max
  Peptide Sequence Number=SeqID_136219
atgaatcaccattcatctaatgttaatggcaagggtactagtcataaggaccctctatctagaatcttagatgagttgagttccctcaagttatggaaagaaaaactagaaagaaaagaaaaaggaaaagagaggagcctaagtgaagaacttcgtgactattatgaaggaaggcataggtcacatattagacctcactctcataggagagaaaaggaaagaaagcctcaagaggctaacattaacctcccatacttccatgggaaggacaatgtagaggcttacttagattgggaaataagtgtagagcaacaacttaaaaggaagtctccttcaaaatcttatggctctcactcttatccaaagaaagaccaaggtcaaggcatcttaggggtgacaccttataagcccaaagatgataagggcaagacaatagaaaacctagatgaggctactacttcaccttcctttagtgaaagtgaagaagcaaaagggaaaaatctagtgaagaaatctacccccaggaaaaaggacaacctttattggttaagaaggagtgtaaggaggtaa

SEQ ID NO: 44535 - DNA, 189 bp, Glycine max
  Peptide Sequence Number=SeqID_136220
atgtcgatctccccctgcggaaatatcagttggtctgtgtcgttccgacatagggatcgcgcccacaagacacctagtgaacccggaggagcccaacaaggccctgaggtttccagctctagttacgggcctctgtcagtcctacagggtgcccgtcccccccagcaaggtcattccatcatgacatag

SEQ ID NO: 44536 - DNA, 327 bp, Glycine max
  Peptide Sequence Number=SeqID_136221
atgctagccatcgtcagcaggtaccaagaagaactaaatctagccacgacccacgatcatggagtggcggacgagtatgcccaagtgtacgcggaaaagaaggctagaggaagggtgatcgactcgttacatcaagaggcaacaatgtggatggaccgatttgctcttaccttgaacgggagtcaagaacttccccgattgctagccaaggccaaagcgatggcggacacctactccgcccccgaggagatccacggacttctcaggaaaaacaccataactaaacgcgccccaaggcatccctatcgcaccagatccaaatcttga

SEQ ID NO: 44537 - DNA, 288 bp, Glycine max
  Peptide Sequence Number=SeqID_136222
atggtgaaagttggaacctctcacgtgccgatcaacgtctcattttcgccaaaagttggcccagggcttcccggtatcaacagggacaccaggatttatttattctgcgaagtgatcttccgtcacagctgtccctcctgttcaggtactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 44538 - DNA, 282 bp, Glycine max
  Peptide Sequence Number=SeqID_136223
atgaaatggatggataggttcgctctcgctctgaatgggagtcaagagcttccaagattgttagccagagccaaggcaatggccgacgtgtacttagctcctgatgaagttcatgggctttttgattactgtgaacacatggtcgacaaaagcggggctcttgctcctacgtaccctccatcgaagaggaaatcagacctacttagttctttcttaaggggcgaatcaagcgattctttttacttggaaggtggtcatttaaggcgttggaccttaaaatga

SEQ ID NO: 44539 - DNA, 231 bp, Glycine max
  Peptide Sequence Number=SeqID_136224
atgcctcaaaatgttctttacgatgccattgggatatatcaacggtggtcaccaggacttatttttgcgaatatccgtcactcagggctgccgctttccagttcgggaacctgtcaggctgcgcaactgcttaatgaacggccaacgcgcgggcgatcgggcgggcctttcgctattcccagggcgctaagggcggagtgtgcatactggcgttactatgttggccgataa

SEQ ID NO: 44540 - DNA, 273 bp, Glycine max
  Peptide Sequence Number=SeqID_136225
atgggcaaacaagcccatagatgcacggagactaacatcatcttctgtaccttttgtcgtcctgaccctttgaagtcaggtgacatgcggggttaccttatagttacccgcacctttggtcaaccagtggcaaacaagcccgttgatgcacggagactaacatcgtctgctgcaccttttgtcatcctgacccgtgaagtcaggggcaaacgagcccgtttacgcccggagacgaaaatcgtcttctgcaccttttgtcgtcctgacccgtga

SEQ ID NO: 44541 - DNA, 409 bp, Glycine max
  Peptide Sequence Number=SeqID_136226
atggcgtcaatacctgctagggcattcgttcaccatcttaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 44542 - DNA, 1170 bp, Glycine max
  Peptide Sequence Number=SeqID_136227
atgatctggcgctggttctggcgcgagtggcgttcgccctcgctgctgattgtctggctggcgctgacgctggcggtggcctgcgtgctggcgctgggctccatcagcgatcgcatggagaaagggctgagccagcagagccgtgactttatggccggcgaccgcacgctgcgcagcagtaaaccggcaccggatgcgtggctggacaaagcgcgcgaagaggggctggcggttagccggcagctcagctttatgaccatgacctttgcgcaggagacaccgcagctggccgatgtcaaagcggtcgatgatgcgtacccgatgttcggcaccctgcagacggatccgcccggtttgcgtccggtggccggaacggtgctggccgcaccgcgtctgctggcgctgcttaacctgaaggtcggtgaccgcattgacgtgggcgataccacgctgcgcattgccggcgaagtgattcaggagccggacggcggatttaatccgtttcagacggcgccacgtttgctgatgaaccttgctgacgtggagaaaaccggcgcgatccagcccggtagccggctgagctggcgctataagttctccggcgaggcggcaccgctggcgcgctatgatcgctggattcagccgcaattgcaggccggcgagcgctggatcagcgtggagaattccgaggatgcgctgggccgctcaatgcagcgtgcgcagcagttcctgttgctctcggcgctgttaaccctgctgctggcgattgccgcagtggcggtcgccatgagtcattactgccgcagccgttacgatctggtggcggtgctgaaaacgctgggcgccacgcgtaaatcgctgcagcggctgattatcggtcagtggctggccgtgctgctgctggcggccatcgccggcagtgcgctggggcagggcattgaagtcgcgctgctgataatgcttaaaccggtgctgcccgccgctttaccggctgccagcgtctggccgtggctgtgggcgattggcgcgctggtggtgatctcgctgctggtcgggttgcgtccgtaccgtctgctgatggccacacagccgctgcgcgtgctgcgtcgtgatgcggtagccacgctatggccgctgcgtatttatctgccggtgatggcgctggtggtg

SEQ ID NO: 44543 - DNA, 271 bp, Glycine max
  Peptide Sequence Number=SeqID_136228
agggccctccaatgtgtttggcatgggtataccaccaactgcttgcccttcagtggcatatccgaggcaaggctcaaagtccactagattgtggttgtcggctctcaatgagtatggaagcggagttattgacatcctctttgggaatgtatgccacattgggtggtgtacagttgggaggcaggccatatggcaggaaggcgtgcttgttttgaatttgcacatcatgggggccgtccctacttcccaaatctttgcctaccatatttga

SEQ ID NO: 44544 - DNA, 222 bp, Glycine max
  Peptide Sequence Number=SeqID_136229
atggtagccataacccctgccagggttcctcaacctccatttttccgaggatacgactcaaacacaacatgtgcatatcatggaggagatccgggacattccattgagcactgtatgaccttgaagcgtaaggttccctgctacaagttcatgatgaaagacaaggttgatacctcaaagccttacacttgggcaatgaggggcaccgagcatgagccttga

SEQ ID NO: 44545 - DNA, 249 bp, Glycine max
  Peptide Sequence Number=SeqID_136230
atgaatttggtccctgagctcatcccttttcgaattcagtctgatacaccatctagagaaagaaaagagaagagagcttggaagaacctaaaaacaagaaactcttcatggcaatggctggaggttaaaatgtttagtctaacaaaacctcccgcagctaatttggggacggggactcgactccccaccctgcaaggtccccgtatccccgtatatagaattctacttatatatcctcataacttataa

SEQ ID NO: 44546 - DNA, 762 bp, Glycine max
  Peptide Sequence Number=SeqID_136231
atggacctcatcacggctgctggactgctgaagactgtcaccaagttgggagattgctatgagagtctagtcagggaattcattgtcaacattccctctgacataacaaacagaaagagtgatgagtatcaaagagtgtttgtcagaggaaaatgtgttagattctcccctgctgtgatcaacaaatacctgggcagaccaacagatggagtggtggacattactgtttctgagcatcaaattgccaaggaaatcactgccaaacaagtccagcattggccaaagaaagggaagctgtctgcagggaagctaagtgtgaaatatgcaaatcctgcacaggattggagctgcaaactgggtacccaccaatcatacttccactgttgccacagagagaatcttcctctatccctgcattacaaactgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagctgaagaagaagaagaagctgctgaggaagaggaagatgcagcagaagagacagaatcagatgatgattctgaagccaccccatga

SEQ ID NO: 44547 - DNA, 387 bp, Glycine max
  Peptide Sequence Number=SeqID_136232
ggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgagtcgtatcacatattcagctgagccgtcgcttttttctcctgccacagaagcacgttcactggaacaccctggcacagtgccaacatgtaatgcctatacactccgccctttcgccagcgtaatagcaaagcccgcctcgatcgcccttggcctcattaatgcagttggcacgacaggtttccctgacatggaaatgggagcagccctgtag

SEQ ID NO: 44548 - DNA, 659 bp, Glycine max
  Peptide Sequence Number=SeqID_136233
atggagtggtggatattgctgtctctgagcatcaaattgccaaggaaatcactgccaaacaggtgcagcattggccaaagaaagggaagctttctgcagggaagctaagtgtgaagtatgcaatcctgcataggattggcgctgcaaactgggtacccaccaatcatacctccactgttgccacagaatcttttgctgtcaaattacccattgccttccctactgtattgtgtggcattatgttgagtcaacatccaaatattttaaacaacattgactctgtgatgaagagagaatctcctctatccctgcattacaaactgtttgaggggacacatgtcccagacattgtctcgacatcagggaaagctgctgcttcaagtgctgtgtccaaagatgatttgattgctgaactcaaggacacatgcaaggtgctggaagcaaccatcaaagccaacacagagaagaaaatggagctggaacggctgatcagaagactctcagaaagtggcattgatgatggtgaagcagctgaggaagaagaagaagcagctgaggaagaagaagaagcagctgaagaagaggaagaagcagctgaggaagaggaagatgcagcagaagatcctgaatcagatgatgattctgaagccaccccatga

SEQ ID NO: 44549 - DNA, 304 bp, Glycine max
  Peptide Sequence Number=SeqID_136234
aaggaaaataagtatcgttacgaaattcgtaaagtttcgtaaggttacggaaaaagaattaccaaaaaagaaatcaggcccacttgggccttccagattcttccaccagaaggctgctgcttctggaggaagcaaccttgctcgcctgggcgagctaggtggcaagctcctcccctattttgctataaatagggggaggagtgaagagggaaggggttcagccttcttggcacttcttattctctcgaaattgctgaggaaaattgtttccatgaagaaaatccaagccgaggcgcttccgtaa

SEQ ID NO: 44550 - DNA, 189 bp, Glycine max
  Peptide Sequence Number=SeqID_136235
atgtcatcaagctcaccgcctctagatgacaaaagggcacagaatgaccataatttgtctctgcgtgccatcggactcaattgtctccgaatggtgaaaagggtcagtatgatagagattgtggggcggccgacaaaagcgaggctcttgctcctacgtatcctcaatgaggaactcagacctacgtag

SEQ ID NO: 44551 - DNA, 339 bp, Glycine max
  Peptide Sequence Number=SeqID_136236
atgccttcctacaagagctgtcagtggaacaataaattgtctaccacagacagccggcaccttaggggagctcggtggcggctcgcccaccaaaggtgtcaagaggccgctatgaagttacagagagtatgttttagtgacgcctcagagacatccctagtcatgttggatttaatagaggctctggatgagactcaggctggtcaacccagaactcagatcttccccagtaataagagtcctgggaggaatttgagcggtagcaagcatggacaaacgatgccagatttcgctacggcgaccgagaacccggaccccgggttgttggggcacagctaa

SEQ ID NO: 44552 - DNA, 156 bp, Glycine max
  Peptide Sequence Number=SeqID_136237
atggccctaggcctacctttgatcctattatggattgccatcatttggaaggcaatggctccaaagaagcttctctctaagagggcaaggaaggaggccattggagaaggatccaatgcagccccacaagcggatatggaatttgacggacactga

SEQ ID NO: 44553 - DNA, 714 bp, Glycine max
  Peptide Sequence Number=SeqID_136238
atgtttagaggaacaagcctagtttgtgttctgaagagaaaaggatcatcctccaccaccgctgctactggccatcgccgccacggaccatctgaagcacccacaacaccaattcatccttccttatcatctccaagatcatctactctattttcttcagatgatcaacgtctacggtacaactctcaattttcttctaggatcatcttagaccctaagtacctagacacaaatttctttgatgatgagacatttgactattatcaagtgtttcaaaactctggattggttgattttatgtccttaaaattgccttactatcttgaactcgttaaagtcttttgcaacaatttaaaaattcaggatggtaatatttcttctgtggtgcatggtatttctatgatcattgatcaatctctgttattttcgttaactaaattacccagtcaaggtgcaccttttgagggcaccattgttgatgactggaagtttgattattctagtcatgatgctcgccgtatggtttgtaatgaccaggctgaaatgaccggtagattcctagccggatcattaacctttgattgccacatcatgcactatattattgttagaattttgcttccccgttcttcaaatttggctcaagcctctgaggaggacttgattttgatgtgggctttccttatcggttgtcagatcgactgggctcacttg

SEQ ID NO: 44554 - DNA, 396 bp, Glycine max
  Peptide Sequence Number=SeqID_136239
atgattgatgctaccagtggtggagctcttggtgatatgactcttgttaaggctaggaatctgattgagaagatggcttccaactcccaacaattcagtgcaagaaatgatgctattgtccttagaggagtccatgatgtggccacggattcatcttcatttgttgaaaataagaagcttgagggaaaacttgatgccttggtcaacctacaatctggagtcaatgacaaaagatacagtccaggttggaggaatcatccaaatctgagatgggcaaatcctccacaacaacaacaacagcaacaacaacagcctgtccctcccttccaaaatgctgttggtccaagcaggccatatgttcctcctccaatgcagcagcaacagcaacaacaatga

SEQ ID NO: 44555 - DNA, 330 bp, Glycine max
  Peptide Sequence Number=SeqID_136240
atgtatactggttcggcaacaacccgtgtctacatccagtccccaaacgacctgcggtccttgagatttcttgtcaaccttataaaaatacttttacaagcaaagatccacaagggattggatgtaccctccactagaactgatccacaagagatgtaccctctcttgttctcagtcgcaacaacccaagtagatgtaccctctacttgtaccacaaaggatgtaccctccaatgtgttaagacaaagttctcaggcggttagtcctttgaaatcttttgtttatgggaaagggaagaatcaaaagaattctcagactgtgtcgttttga

SEQ ID NO: 44556 - DNA, 525 bp, Glycine max
  Peptide Sequence Number=SeqID_136241
atgcccttgtggggtaggattgcatcagataggccagatcatgaggttatgtgggatgctaccgtgttcggggtgtttaatgaagacttacccttgtacataaagcatgaaaatctgtctgaaatagcacatggtggtcaatgtctcagcatctttgtcatacagttgtggattttcaataggcatctgactgagacaagtatgcgagcgatgaattccaatgtgtatggattcctcgagccacagtccatccagagatctgggcaatcgcaatttgaatcagaaagttacaagaagaattggatgcagaattcaaaacaggatgtctacctaggagcctacctgaatggtgcacactggcaaatggccatcattttgcctaaggaaaatcttgttgtctggttttgttccttgcataataggccagacaactaccttaaaggaataattaacagtgctttgaaaggacttgacgatactttacaacttaaatccaaggctggtgctaggtggattgttgttaaa

SEQ ID NO: 44557 - DNA, 448 bp, Glycine max
  Peptide Sequence Number=SeqID_136242
atgaaatacgatacttccgagctttgcgacatctaccaggaagatgtcaatgtcgtggaaccgctgttttccaactttggagggcggtcgtcgtttggtggacagatcattacggtaaaatgtttcgaggataacgggttgctctacgatctgctcgagcagaatggccgtggtcatattctccttatcgacggcggcggttccgtgcgacgcgcgttaattgacgccgacctggcgcgtctggcggtacagaacgaatgggaagggctggtggtctatggcgcggtgcgccaggttgacgacctggaagatttagatatcggtatccaggcgttagccgccattcctgtggccgctgctggggaaggtatcggcgaaagcgacgtgcgcgtcaatttcggcggcgtcaccttcttctccggcgatcatctgtatgccgacaataccg

SEQ ID NO: 44558 - DNA, 252 bp, Glycine max
  Peptide Sequence Number=SeqID_136243
atgaaagattgcagaaatacaagtagtggggatgtctcttccacctctaggacctcacaatcactcacaaactcatctcaagctcttaggacggcttcctcttccagctttggtctctacagatcttcacacaacaaattctctcaaactctccggaacttggacctttctctctctaaaactctccaattatgcagaagcttcaataaaaggccaaactcccctcaaaaatctgattttaggcttaaatag

SEQ ID NO: 44559 - DNA, 420 bp, Glycine max
  Peptide Sequence Number=SeqID_136244
atggctaaaccaagcagccccgcaaacttggcatcagccatcatttgtttctttgcctcaaagaagttcccccatagactaaaagcatcaccgggaaggttgcaaggcaaaacccttcaccacacccttccgtcatggtccattttcccagtctttcgcgttgtaaaacgacggccagtgaattgtaatacgactcactatagggcgaattggagctccaccgcggtggcggccgctctagaactagtggatcccccgggctgcaggaattcgatccccatcacgatgaaatttcaaagattacccggacctgtcggccaaggctatagactcgttgaatacatcagtgtagcgcgcgtgcggcccagaacatctaagggcatcacagacctgttattgcctcaaacttccgtggcctaa

SEQ ID NO: 44560 - DNA, 699 bp, Glycine max
  Peptide Sequence Number=SeqID_136245
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgatttcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 44561 - DNA, 301 bp, Glycine max
  Peptide Sequence Number=SeqID_136246
cattttcgaggggatgcttaggagctttaattcatccaaggtcattgtacttgatggtgcccacgttcatatgttgtatgttgtgtatgtccatggggggtacattgaccttgtcggacgtccctcgtgtgggaaactaaagtggttaaagaatctaagcatttttgaggggatgcttaggagttttaattcatccatggtcattgtacttgatgggaactccttaaggccccaggttgatcacctaagggggaggggaagttacggtgcacgactaggtggcctcgacaaatactgcatg

SEQ ID NO: 44562 - DNA, 189 bp, Glycine max
  Peptide Sequence Number=SeqID_136247
atgctgacatctctggaaagggcgcagatgactacattggcctctgctcgtcaatcacacttggggtcactgaatgacaaggtgcggataaccgtaaggtgtctccgcgggctaccagctcttggatcatgggcttttgctcctacgtatcctcaaatgaggaactcagacctacgtagttctggataa

SEQ ID NO: 44563 - DNA, 543 bp, Glycine max
  Peptide Sequence Number=SeqID_136248
atggtttctcgtaagagaaaagccacagcttcagtatctcaggctggttatgatagatcaagatttatatcacaggaggcatgggaccgttactcagataatgttcttgccagaaacattctgccagaaagaaatgtcaagttgtatataactgagtttgacgattttagaagagaattgattggaagaaactggcataaacagctgaccaacttgattgagggaagcattgatgtggcaattgtgaaggaattctatgcaaatctatatgaccctaaggacaagtctcccaagcaagttagggttcgagggcacctgataaaatttgatgttgattccctcaacgctattttggagactccaatggtcttagagaaagaggagagcatacccgcctactccaagtttgttagactgaggcctgatcctcaagagcttgcagcccggctatgtatccctgggaagggatttgtacttaatgccgagtgtctgccatggaagctcttgatgaaagatcttaccactctggctcaaacctggagt

SEQ ID NO: 44564 - DNA, 192 bp, Glycine max
  Peptide Sequence Number=SeqID_136249
atggaggcttgggggctgctgctctcgtggttcccgggttgctcgcccaggcgagctaacctgccatttttttttgggggaaacataaccatgccccccctctttacagcaacattctctgcttgtccagcaccgggaagggatgacgatcggtcggtcgtgaccctatcctccatttgcgtccattcctaa

SEQ ID NO: 44565 - DNA, 573 bp, Glycine max
  Peptide Sequence Number=SeqID_136250
atggcgcgacgcgtttccggtaagacaatcgccgtctccgatccggcgacggacgaaatcatcggcgcgattgcgcatgccgagaaggaagacctcgatcttggcgctcgccgccgccgagcggggtttcaagggcggccgacatatgcgcgagcgcaaggacaagatcgcctacatcatgacccgcgaacaggggcaagccgcctggcgcagtccgccactgaaatcatgggcgcggccgacaccatcgactggttcgcagaagaggcgcgccgcacctatgggcaggtcatcccggcgcgggcaaccggtgtctcacagcttgccatcaagctgccggtcggacccgttgcagcgtttacgccatggaacttcccgatcaaccagatcgtccgcaagctttccgccgcgcttgcaaccggctgctccatcatcgtcaaggcgccggaagagacgccggcgtcgcctgccgaactcatccgcgcctttgttgatgccggcgttccggcgggcgtcgtcggcctcgtttatggcgtaccgtcagagatttcggaatatctcattccgcatccg

SEQ ID NO: 44566 - DNA, 372 bp, Glycine max
  Peptide Sequence Number=SeqID_136251
atggcttttgtatccatgattgaacctaaaaatataaaagaagccataatagatgataattggatcattgccaatgcaagaagaactaacaatttgaaagaacaagtgctggaaattgtagaaaaactgaaaatttctgtatgcaaaatggtttttagaaataaattagatgaacacggtataacttattcagaaataaagcaagatacacaaaatgaagaaagaaatctgaaaagaaaaagagatgatgaagacaaggatgatcaagatgacacaacacaagaaaatgataatcttcccaaagaatggaaaacttcaagaaatcatcctcttgacaacatcatcggtgatatctcaaagggtaacaactag

SEQ ID NO: 44567 - DNA, 324 bp, Glycine max
  Peptide Sequence Number=SeqID_136252
atgatggtggcccgggtgatgttggggcacgactacgagcccgaaatgggtttgggcaaggataacggtggcagggccgacctagaaaggaagaacaaaggccaaggcccgcggtcagaacaacaagccaaagaggttccaccgtgccacatcagtagaagcttcgtgagtgcaggtttaaagcacgaaggacaagtggccgcaatatgcgatgaagactccctgaggaggtcgaatttgatacagctatgccctctcggcttccagctagggaactggcgggtggaggaatgccctgaagtttacacaagaagcataatgtaa

SEQ ID NO: 44568 - DNA, 360 bp, Glycine max
  Peptide Sequence Number=SeqID_136253
atgaattttgcagcgagaaagcctgtagaattcaccccaattccagtgtcttatgctgacttgctcccatgcctacttgataattcaatggtagccataaccccaaccaaggttcatcaacctccatttctccgagaatacgactcgaacgcaacgtgtgcttgtcatggagaagcctcggggcattccattgagcattgtagggctctgaagcgtaaggtgcaaggattttcaactttcaccggaagtgggtgcaagccattggtctgtttgctcaagcgacctgtgctcctgagtttggacttccaagaccgttcaatcagagattactcgtcttgcgcattggtggggctgccgtaa

SEQ ID NO: 44569 - DNA, 117 bp, Glycine max
  misc_feature (111)..(111): n is a, c, g, or t
  Peptide Sequence Number=SeqID_136254
atgtggaccaccacgggggaggagcttgccacccagctcgcccaggcgagcaaggttgcttcctctagaagcaatagccttctggagcaagaatctggaaggcccaagtgngcctga

SEQ ID NO: 44570 - DNA, 216 bp, Glycine max
  Peptide Sequence Number=SeqID_136255
atgaggacacatagccctctaaaggcgagggtgtgcagccctctgatggcgaggacatacagtcctctaaagattgactgtccttttgaaaaaggtaataatccatgcaaccctatcctatcttttgcaaatctctccgggaactccctcagagtgtatgttttgtttgatttagtcacttgtccattttggagcgacgacaatggagccgtttga

SEQ ID NO: 44571 - DNA, 576 bp, Glycine max
  Peptide Sequence Number=SeqID_136256
atgagaggtgcgtcatcggaggaaaccatcatgcctttcatcacacgagggtttaacaaagcgaatatgaagatacttcagaagatccgtaaggcatggaataaagtgggaaaaaaagataaagagcttagaagaagaagcaatagtgtcataggcgactatcataaatggcttaaatctagaacgcaagggatagcttggcacaaaaagctaaagggtttgaatggagaagaggcaggagtgcccgaggagagtgaagaggtgcaagacttgaaggctgagctcggaaagacaaaagtagagaaggagaagctgaaggtggtagtcactagagttaggaaagaatgtgataagctgaaggatgtcaacatgtccacgactgaagcgctagagcagaaaatgaagaaagccagaaaggaagagtggagtagaaacaagtttcgaggggctttgttaggcagcagtaatgagctcaaagttagtaaggccgagaaagacaaatcaaggatggagaacatgatgttaaaggataagttaaggaattttcaaaggtcaaagggaagtttgaaagaatag

SEQ ID NO: 44572 - DNA, 345 bp, Glycine max
  Peptide Sequence Number=SeqID_136257
atgttgctaagtagcaatgtcatctatatctgtgtaagagtggtcatgttggtgcgcatggtccgcacttgtctctttgcagtggtacgggtgaaatcttgccccggtatgcatagtagctgtgtgatagcctccctctctggttgtgcttgcacagttggtcgccctccaatgatcagggggtggcccaggaaccgtcaaaaggaaactacaagccccttaaccgggaggcgagggcgtgtaccctctgaagttcaggacgtgtcgcctttcaaggcgagggagtgtagtcctatgatggcaagggcgtgcaatcctctgaaggtgagggcatgccccctttga

SEQ ID NO: 44573 - DNA, 842 bp, Glycine max
  Peptide Sequence Number=SeqID_136258
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcctcagcctcccaagtctcgaactcctgaccgcaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44574 - DNA, 456 bp, Glycine max
  Peptide Sequence Number=SeqID_136259
atgagggtgctgataagtaactcttttaaagttattcttaggcaagcaattcttgtgattgatggtgtgattcaaacaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 44575 - DNA, 585 bp, Glycine max
  Peptide Sequence Number=SeqID_136260
atggcgcaatatgtgatgtccatgctccgcgtgagcaaaatcgtgccgcccaaacggcaaatcatcaaaaatatttcattgtcttttttcccaggtgcgaagattggtttacttggcttgaacggttcaggtaagtccaccgtactccgcatcatggccggtgctgacaaagaatacgagggcgaagtacagtggcagcccaatttgtccataggctacttgccgcaagagccgcagctggatccggataagactgtgcgtcaggaagtggaagctggcttgggcgccattatggaagccaagcaaaaactggaagaaatttacgcggcttatgctgaacccgatgccgactttgacaagctggccgaagagcaggccaagtacgagaatattcttgccgccagcggcagcgatgtcgaacaacaactggaaatcgccgctgatgcgctgcgcctgccgccatgggatgccatgataggcccattatcaggcggtgaaaaacgccgtgtcgccttgtgtaagttgctattgtccaagcccgattatgctgttgctggacgaaccgaccaaccacctggatgctga

SEQ ID NO: 44576 - DNA, 677 bp, Glycine max
  Peptide Sequence Number=SeqID_136261
tctcccttaccttcagagggctacacgtcctcgccgtcagaggactacacgtcctcgctgttagaggactacacgtcctcaccttcagagggctacacgccctcgccttcagaggactacacgccctcgccttcagagaacaacacgccctcgccttcagaggactacacgccctcgccttcagagggctacacgccctcgccttcagaggactacacagtctcactttcagaggactacacgtcctccccttcagagggctacacgccctcacctttaaaggactacacgtcctcgccttcagagggctacatgccctcgccttcagagcactacacgtcctcaacttcagaggactacacgtccttaaatttagagggttgcacgcccttgccttcagaggactacagagggctacacgccctcgccttcagaggactacacgtcctcgcctttcagaggactacacgtcctcgccttcagagggctacacgtcctcgccttcagaggactacacgtcctcgcctttagagggctacacgccctcgccctttagaggactacacgccctcgcccttcagaggactacacgtccttgccttcagagggactacacgtcctcaccttcagagggctacatgtccttgccttcagaggactacacgtcctcaccttga

SEQ ID NO: 44577 - DNA, 120 bp, Glycine max
  Peptide Sequence Number=SeqID_136262
atgcccagaacaccacaacaaaatggtgtatcagaaagggttcctagtaagacagttccaaagacaacttttgaactgtggacaaatatgacacctagtataaggcacttgcatgtttga

SEQ ID NO: 44578 - DNA, 219 bp, Glycine max
  Peptide Sequence Number=SeqID_136263
atggcgaccgagaaagtgaccgtttacggtctgccggtggtggccgcgcgtaaggtcaactacagccagatcgatccggcgctgtgccgcgagctgtttatccgccatgcgctggtggagggcgactggcagacgcgtcacgcgttcttccgtgaaaacctcaaactgcgcgccgaagtggaagagctggagcataaatcccgccgccgcgacattctg

SEQ ID NO: 44579 - DNA, 302 bp, Glycine max
  Peptide Sequence Number=SeqID_136264
gcaacaacaaaagaacacaaaaacatcaggaatatcaacattcttgtcagtatgagccacaactttctcagcagtccatccagtcagaaaagtcaaaaccatcgtctatgttgcaagatggtgaatcaagaggagcagcagcttcatcagttgagtcatcggggatgattatcagaggtggtgccggaggagacaatgtctcaagttccggagaagcaggtggatctactacaggaggttatggttctgctgatgtcagctcagtcctagctggtacaggtccgggaggaacaaccttatga

SEQ ID NO: 44580 - DNA, 135 bp, Glycine max
  Peptide Sequence Number=SeqID_136265
atggactcgggaaggttccaagttagtgtaccaagtagcagctaccccagaattaatgaagcattgggcttgaatctagaattgggcttgggcttgaatccagcattgggcttggacttgaagagggtagactaa

SEQ ID NO: 44581 - DNA, 342 bp, Glycine max
  Peptide Sequence Number=SeqID_136266
gcagaggaaggactacccaaaaaggttagaatggtcgaggtagatcaaagtcaagaggaaaaggcaccaaagaagaacaagactcacaaaaacaagaagcgcgatgatgatgaatccccaaatgcagaaattgatgaatttgatgatgaatttgcaactcagatagtcctgctgattcatggattatggactcagatgaaaaatctcttgacattgtcagaagaagtgatattgacatcaagacctccagggcattacaccacttttggaaatggagcttggaaggtgatggaagcttgcttgtggagcttctatggaggctggatctttgtgcttcaatga

SEQ ID NO: 44582 - DNA, 249 bp, Glycine max
  Peptide Sequence Number=SeqID_136267
ggctgcccttcgccttcggtgccaactgtcgggaagacctgatcggtgcgggcctcttgctattaaacgccaacgctggcgaaagggggatgtgctgcaagttgcgattaagttgggaattgatatccgcttcactcagcaggtcactggactcgctacagctcggtcgttcgactgcggcgagcggaaatggcttacgaacggggcggagatttcctggaagatgccaggaagatacttaacagggaa

SEQ ID NO: 44583 - DNA, 669 bp, Glycine max
  Peptide Sequence Number=SeqID_136268
atgacgaaatacgcccagaagatcagcatcagcagcggcatgccgcgcaccacgttgaccagcgtcttgctggccacgcgcagccagccaaatggactgacccgcgccagcgcgatcgccagcgccagcggcagcgacagcgccaggccgcacaacgccaggatcagcgtcagcgccagcccgcccagcgggccattggggtattggccgaccagcagcgtcggccagtattgcgacagaagatcaagcaccgtggcctccctggttcaagcggtagcgcgcatagatgcgcgagccgatcagcatgatcaggaaggatcccagcaggtacatgatggtcgcggcgccaaacgtggcgaaggttcgataggtttcgttctcgatctcgcgcgcctggtaggtcagctccatcacgccgatggccatggccacgctggtgttcttgaacagcagcaaggcgcgccccaccagcggcggaatggaaatccgcaccgcctgcggcacgatcacgaagcgcatgcattgcaggtagctggcgcccagcgcccgcgccgcctcgaactgcgtgccgggaatggcgcgcagcccgctgcggatgtcctcggcgatataggcggccgaccccagcgccagcgcgatcgccgccagcgacatctcggcgttgtgctg

SEQ ID NO: 44584 - DNA, 757 bp, Glycine max
  Peptide Sequence Number=SeqID_136269
ggcttcccggtatcaacagggacaccaggatttattttattctgcgaagtgatcttccgtcacagtggcttctgtttctatcagctgtccctcctgtttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagatgggaattcgatctggatgtactgctgcattctcagtgatattcgtaactatcttcctagagtcctgttcattcggaggaagagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44585 - DNA, 792 bp, Glycine max
  Peptide Sequence Number=SeqID_136270
atgactcctgctgaagacagaaatttaattgagaagatggcttccaactcccagcagtttatcgccagaaatgatgccatattcattagaggaatgcatgaggtagctacaaacccatctgcatcatctgaaactaagaagcttgaaggcaaaccggatgcattggttaacttggtaacccagcatgccttgaatcagaaatttgtatctgtcgcaagggtttgtgctgaagcttatgctgcaaatatttacaatagagctcctcaacctcagaagcaaaatcaaccacagcagaacaattatgacctctccagcaacagatacaaccctggatggaggaatcaccctaatctcagatggtccagccctcagcaacaacaacagcagcctgctccttccttccaaaatgctgctggcccaagcagaccatacattcctccaccaatccaacaacagcaacaaccccagaaacagccaacaattgaggccccttcacaaccttccctcgaagaacttgtgaggcaaatgactatgcaaaacatgcagtttcaacaagagaccagagcttccattcagagcttgactaatcagatgggacaattagctacacaattgaatcaacaacagtcccagaattctgacaagctaccttctcaagctgtccaaaatcccaaaaatgtcagtgccatttcattgaggtcgggaaagcagtgtcaaggacctcaacccgtagcaccttcctcatctgcaaatgaacctgccgaacttcactctactccagaaaaagggtga

SEQ ID NO: 44586 - DNA, 471 bp, Glycine max
  Peptide Sequence Number=SeqID_136271
atggttaaggagaagtgtaaggaggtaaatgtctcctccaagaggttagctaagaagaaaagtcattttgcaacaaagacaaaagttaaagaaacttcccctcttagacaacctccacatctcctcctttgtaaaatgacacttgttagcactgccacacctcttaggcttgaggttattcctcaagtgaagaagtttttggatgagggtttggttcgtaagaacttaaatccttatgctttgttggtgcccaaaataggtattattaggcaccaaatccctaaaataagtgatatgatgaatgtgttgagcgttgcaacccctttttgtaaaatcactcatgcacccaacatcttcatgattcatgtacataaggactcattaggtagtgatcaaggagttcccacagaccctaagagaataaaggtcattcctgattggcccactccaccaagtataagggaaatctag

SEQ ID NO: 44587 - DNA, 324 bp, Glycine max
  Peptide Sequence Number=SeqID_136272
atggtgagcatgagtaaaggagagaagaggataggtgaagaaaaacaacagttggtgactgagccagcaattgacccagtggtggaacctttgagtgagactgaggaagaagtggaagtagaagatgatcagcagaaggagataccactaattgttgcaggttgtgttatatgtggcagagcacatgattctggctgctgcattcccacagaagatacaacacatgaagtgaactatatggggaaccagccaagaccatactttaatgcaggtgggtattctggatttcaacatggccaacaatataatcagcaacagggatag

SEQ ID NO: 44588 - DNA, 782 bp, Glycine max
  Peptide Sequence Number=SeqID_136273
atgcttgtaggggcccatgacgacgtgcaccttgcggcaccctgccagcgcggccggcacgcccagcaggtgcaccaggcggttgatgcccatggtggcgcccgagccggagaagatcacggcatgctcgtcgcccgcgccgcagcagcggccgaccacggcgcgcgcctcgcgccgcaggcgcgtgatgaaaccgccgcagaacgaggcctcggtgtgcgaattggcgtagtacggcagcacgtgctcgagcacgaagcgctcgacctgcatgagcgcgcggccggaagccacgtaatcggcatagaccagcggcttgaggccgaacgggccttcgatgacggcgtccttgccgatcaggccgtcggccaaactggcgatgatgtcggggggattgcagggattgctggaactggcgcaacggccctgtggcggccggggtcgcttgggtggacatggtgcggattcgatgaaacggctggcaggaaagttagcgaaatatcatacgatggaaggaaatttgaaacctcacctaaattttccttaaaatcgtcaaaattcgatcgcttgaacgaatatatggaaaaaatagacaagtttgatctgaatatcatttcctgcctgcaacgcgagggttcgctgtcgcagcgcgagctggccgatcgggtggggttgtcgcagaacgcgtgctggcggcggttgcagcggctgaacgcctgcggcatcatccgcggcacccgcgccggaggtgaacctggcggactcggggctggacctgacgg

SEQ ID NO: 44589 - DNA, 366 bp, Glycine max
  Peptide Sequence Number=SeqID_136274
atgggaggagttgtatacaatttacaacagttttttacacaaaagtttgctaagaaggaaagtcattttgtaataaagacaaacattacagaaacttcccttcttagacaacctccacatcttctcctttgtaaaaggacacttgttagcactgccatacctcttgagcttgatgttattcctcaagtaaaggagttgttggatgaggatttggtttgtaaaagcttaaatccttgtgctttgttggtgtccaaaataggtattgagggaagaagccctgagtttcaagaacctttggatttgaggtcaaatccttttcaagggggaggggatgatgtaatcataccccccaagggcattggataa

SEQ ID NO: 44590 - DNA, 216 bp, Glycine max
  Peptide Sequence Number=SeqID_136275
atgccgtcacacatgcgttgtatgtgggtctcgtctttagtcgtgggaagtcgaaagatccatatcgtcttcttaactgcacacaaggggcactgcgcccccaaatgcgcagttcatcgagtcaagttgaagtatggaagtaaccatcttgcaaaaattggggcaaaagatggatcgtgttacatcattgcttcgtctactgtcaaacacgtttag

SEQ ID NO: 44591 - DNA, 582 bp, Glycine max
  Peptide Sequence Number=SeqID_136276
atggggacaaatcaaaccggcaagaggttttaccaagtcaaggttaaaggcctagataccaccagcatcaaggaattagggcggttgatggaacctctccaaatgcaagccttccgcaagacttacggaaagatcttagatttgaccatagtagaggtatccatagaggccattgcgtcactcacccaatactacgaccagcctttgagatgcttcacaattgcaactgtggtcaaggattcagcaagaggtttggaccgtgtaaaacaaactcaaaacggcatagtgggcctaccacggaagtacctagaagacaaggctagggatatggcaaatcaagaagattgggtcccgtttatggatgtgttagcattgctaatctttggggtcgtcctctttccaaacgtagatggtttggtggacctagccacaatcgacgcgttccttgcataccgccatagcaaggaaagtctggtggtagctgtcttggcagatttatttgacacatttgaccgaagcaagacacgaggcatccatgtccgctccaaagccatcgctcgtgtactgaaaagagaagaatag

SEQ ID NO: 44592 - DNA, 135 bp, Glycine max
  Peptide Sequence Number=SeqID_136277
atgtggatgaaaaataacatggttgagaggaagaccccactggaacaacaaatgacatcaaaagctgaaggaggagatggttgtgcgtggtggtttggttgggtaggcctcaatctcaatcaaaacaacgcttga

SEQ ID NO: 44593 - DNA, 216 bp, Glycine max
  Peptide Sequence Number=SeqID_136278
atgagaaggatcttgagggagggagagagagagagagattgggaatgcaacagaagaaagagttcttacctgagattaatgaatgaattaaaagcgccgaaagttatgagggagggttcttggttggttgttcctgcaccctttggtcgggtcaaagttgagtttagaaaggacacaagaagggagcagcaacagcaacaaaaggcacaacaatga

SEQ ID NO: 44594 - DNA, 572 bp, Glycine max
  Peptide Sequence Number=SeqID_136279
acgatgtcgtaagggttagtgttgagcaagttattaacagtgatgttgaggtcccattcccaacatcagagattaagtgtgtcaggcagacccttcacacattcattgcatggacaacaccacttgttaaaaaaatctttattgagcatgagggcagtagtccaactaaagacactaaagctgttgaagcggtcaacgatgttgttgtagatgaccccttgcgcgagttgattaagagcctagttgacatttatgagaagcctgtagagttagtatgggatgttactaaatttggaattccaaatgcaactgcatcattgttcataacgtgtgctgatgtgaatgaaataatatcaggcgtacagtgtttgaacatagctatactacaattgtggaccatgtatatggaccaattgagtcaaagcaatggtctaggatcggtgtatggattccttgagccgcaggctatactgaatgcaaacgataaacgtggacaatgtcaagaatacattgaaaaatggcttaaggaatcgaaccgagatgtctatctaggcgcttatttgaatcagtaa

SEQ ID NO: 44595 - DNA, 339 bp, Glycine max
  Peptide Sequence Number=SeqID_136280
atggcttatgggatgagcgggaaaagtgagatcagtgaaggaggtgcaaatgattcagtggctagtgtgggagatgtgatatttgtcaagcttcgcgatagctcatggtggcctgcacaggttgttgatgaaaatagtgttaataagagtgttaaaccaagcaaactgaccaaacaattgccaagagacatccttgttaggcattatggaagctatacatgtcaagagcatctcactaacaaggtagaggatattattgttattgagagagacgaatggaaatgggtggattatcaacttgttatgatgtttggaagaaagctcaatatattactatag

SEQ ID NO: 44596 - DNA, 165 bp, Glycine max
  Peptide Sequence Number=SeqID_136281
atgaaggaaactgtgcagggtcatacagggctcaatggaatgctccagaactcccccatgataagcacatgtcacattcaagttgtatcttcagggaaatggaggttgaggaatctttgttgggcttatggctaccattgcattattgagcagataagggagtaa

SEQ ID NO: 44597 - DNA, 885 bp, Glycine max
  Peptide Sequence Number=SeqID_136282
atgacattagcaaggagaaatgggcctagttttgtcggagccgtagagacccctcgtgggaggatgtgcggaaaaaggcacatgccatccagaagcaaaatactgccccccatgtgttgtctcgtagggacaaagaaaaaattagaggaagctactcaattcagaagcattaaggtcgtgattgaccctccatcttccatcagacggcacgtgaagtggaagatggcccgcgccaaaaaaactggccagatgacgtctgaggcagcaaaggaaattgctgagaagattgaacaggcgtcacagggttcctttgtcccccatggacgtcataatgtcctgactgctgccattgggcgaccagaacaccctggtcatgtgcatgttgctagagccggtgtaaccatcaagcaatactttggatcggctccatggacctccctcacttcttcctccatggctattgaagaactagagcatctgactcaacaaattagggaccggctgaaggaatcgatcacaaaaaaaggacttgcactacctccggagcctgaggttggtccctcaactgctcatgtcagcacaaagaagagttatgttggtccctcaaggaatgatccagacacgggtgactcagacaaatgcgggttgtacattaaagaaaatcctccccgcctgggttccctaggaagagtttatgagggatccacaactgttcacagcatccctttgttgcatgatcaagtgaaggttggtgttgaggaggttaaagatgcagatgctcctgttcctgtacccactaacgaggttaacttagtggggcagacacttaacacatttcttgtttggccaacccgcaactcagtgtactggagatgcgcttattaa

SEQ ID NO: 44598 - DNA, 213 bp, Glycine max
  Peptide Sequence Number=SeqID_136283
atgacaattacactagaggatgtagcactgcagcatggcataagggtggacggtaggccaatcactagtgcaacctactatgattgggaagaaatgtgtgaacaatatttgggtgttgttctgccaaaaggagaagcaatagtaagctctaccattaagcttaagtggttgcaagatgatatgccgctgcttcctgtggaaccaacacaatag

SEQ ID NO: 44599 - DNA, 645 bp, Glycine max
  Peptide Sequence Number=SeqID_136284
atgggcggttgtgcgtcattgttgcaatcttgggcatggtatcgcatgaccatcattgcaacaagagttaattggacaccatcgtattcattggttacgagatggaatggcggtggattaagctttacttgtacaccacatggagatgttatcggttatagaatgagattagaccacatgacaattgaacagaatgacatctgcctcagacaagacataccagatcccccaagaaacatggagaaacttcataagatcgacatgcgaggtcgaactgacacaaattgggttgaaaaacatgcaaagtggataagattatgttccacccacatacacacccatccccccatgaaggattacatttttccaagtctttcaaacatggactacactccactaattgtccaactagatgatttcgtgagcaatgtttttggaactgattgtggcatgccagcatcatctcatgaatacatgcatagcctacagaacaaggtggaactaagtttcaatttgatgtttagccaagatgttgaagagaataatccatcattgcatgatataccagataaatgcctgtgtcaaaatccaggacgtaatgggagacaccctccatgtggaacaagacaccattatggggattaa

SEQ ID NO: 44600 - DNA, 243 bp, Glycine max
  Peptide Sequence Number=SeqID_136285
atgaacccaaggaacgttggtcccttgggttcagtgttcaaccaagaagaccttctcttgaaaacagtcaccaagagtaggtcccttgaaaagctttttgggttggacctgaatcaggaaggtgaggccctaacggattctaggccttggggtaaagacactcggtttgagtgctcctttaagcctatgttgatcccatatggttggagcattctctcaaaacagagtgaccctgactggtaa

SEQ ID NO: 44601 - DNA, 243 bp, Glycine max
  Peptide Sequence Number=SeqID_136286
atgacttccaagattattttgatgatgccaaagaatcaagagttaagcaagttccaaagattcaagattcaagaacaatcaagcttcaagaatcaagattcaagaacaatcaagtttcaagaatcaagattcaagaacaagatcaagattcaagactcaagattcaagattcaagagaagaaatcgagaagcaacagtcaagacttcacaagggaagtattttttcaaaaaatccaaacatag

SEQ ID NO: 44602 - DNA, 321 bp, Glycine max
  Peptide Sequence Number=SeqID_136287
atggctccaagaaagctttcatcaaagaggtccatgaaggacaccaccggagaaggctccagcgctgccccacaggctgacacagacttcgacagacatcgatttcggagcgtagagcatcaacagtgctttgaggccatcaagggatggtcattcctcagagagaggcgggtacaactgagagattatgagttccctgactttcaggaggagatagccagcaggcgctgggcaccacttgtgacacccatggctaaattcgacccggagatagtcatggagttttataccaatgcttggcctaccgaggaaggagtctga

SEQ ID NO: 44603 - DNA, 138 bp, Glycine max
  Peptide Sequence Number=SeqID_136288
atgataacaaattatagaaagagagacggcggtgacagaggtggtgttggcggcgatgacaaccctggtgggtggaataatgtcagcgaaggtggtggaatggtgatggtgacggtaatagtgatgacaatgttttaa

SEQ ID NO: 44604 - DNA, 843 bp, Glycine max
  Peptide Sequence Number=SeqID_136289
atggagacgcttgcgggaacaacaaggagaagacgtagaagagttgttcttttggcttgttgggccgtgtcgcgtgtgtctacttggtgggccgtgtccaatcgcgtgtgtcctattgttcaaccatgtccagtgacggcggaggcaacggacaccgcatcgcaccggagtcgtatccgcatgcgtgtctggtgcgagtccgacgcgggacacgccaatgatgtggtgggatttgatcttgtagatgatgaaagtaaacccgaaaggcgtccaactaagcacatgcctactccatctgagtggacaaatgaattcaatccagcatactcttattacctttattactactatgctaacttgtatacactcaacaagctgcgtgaatctaaaggaatgaccacaataaagttgcggcctcactgtggagaggcaggtgatagtgatcatttggctgctgccttcctcctatgccataacatttctcatgggattaatctgcataaaactccagttttgcagtacttgtattatcttgcacagctaggtctaaatgtgtctctctctaccgatgatcctttgcaaattcatttgacaaaagagccactgctcgaagaatataatgttgcagcaaaggtatggaagctctctgcatgtgacctgtgtgagatagctagaaattctgtctaccaatctggattttcacaccaagcaaagtcacactggcttggggataaatatttgttgagaggttccgaaggaattgatattcacaagacaaatgttcccaatttgaggatttctttccgatatgaggtgaaaaaacttaagacaaatcatatataa

SEQ ID NO: 44605 - DNA, 480 bp, Glycine max
  Peptide Sequence Number=SeqID_136290
atggtggataggttccacgtggatcctagaggtgtgagggtgcaaagacaagatgcggatctatggaggtggagggagagacaaaagctatggaggatcaaggttccaccaaaaatcaacatcttcatttggagattactcagaaacagacttcctactacagataataagagaaaaagaaatctgctaacagtatggagtcactattacgcatggttggacctcaattcggttctgctgcagcatttcaggcaacatttcttgttggactacaaccaggagagacaatattgtattcaggggagcctcgttccaggattttttgtttcatacatggacctggatgagaaacattgggaattcttttggttattcatatgtgcagcggtgttagaacaccagagcttgtgtagtggagtagaattaggggtgggaatagaccaggccggcctacagaggcctacgacctggcctatataa

SEQ ID NO: 44606 - DNA, 1098 bp, Glycine max
  Peptide Sequence Number=SeqID_136291
atggtggaagcacttgtttgtacacaagattggataaaaaaaacaccatcaccactaccttcaaatgaaaatgatgaatttttggagtttgaaagaattgaagaagctacattttttgttaacattaagttacattgcttcctcttgtttctaaaggaatttgtcaagcttgaatcttcgtggggagatatcacctgccattggtgtcttgatcctatttgggatgctgttagagaagaagccaagttagagaaccacatgataatcaaattgagcttcattgttgcagcttcgattgctgcactcaagattttgcagacaaaaactagctcttccaccaagagaaatggaagtgatgggtcacacttggaacaagagtttgaagagagggaaaatagcactgttaatgctaatcataatgaagagaaggagattaaatttgaaatgccacagaatctgccaacaagagaatttaaggacttggagctgttaatagatggtgagaaaatgcacaatgttactaaaaaggaggggtctccttggtcagtcactaacgacaaaagcagattttgcagagccagcacgtcgagcttcctagacgtaatcttccaaatacgtgggcctcctgctctctcttttgggcctgttggttccatgattggtattgctatcatattgcagaatttggtacaaaattacaagcagagagaagtaaaccttgaaaggaagcttcttaaattgaatagtctgagggaagagcaatcaaccattgctcaaatgcaaaaacaattagaggaaaagacagaaactgtggagattcttaataagaccattggttccttgcggtcagagaggattgataagtatgaaactggagatggatttggccattttggtcttctttcaccggcttttggtatggagctacttcgaacacaagatgacccagaaactaagatagagacaaaacaaaaagacagagggtgctttgatttacaagagaggccctatcctccaccatcagccatgacactgctacaccttccaccaaaacgaagtctgggaagccatttaaaactcgcgttcaaccgcctctaa

SEQ ID NO: 44607 - DNA, 999 bp, Glycine max
  Peptide Sequence Number=SeqID_136292
atgggtgtggctaatttgattacaaatataaatcaaacacaaataaatgggtttggcatgattttaggaaaaattagcaacattacaaatataaatcaagttgtaacattagtagaacagtcacaagagttcccacaaaagcaaggtggcagagaaaattatgatcaatatggaagaacaatatggaagttgcattgctgtgcaagttcagcaggtgacctcaaacgtatttgtgagactgatctaggacttgcttcacaatgttgcttaactaagcatgtcttcaaaatgagcaagcagtaccttgcaaatgttgctttgaaaattaatgtcaaagttggagggagaaacactgtactggttgatgcgctctctcgacgcattcccttggttgtggcttcgcaagactatcctgaaattacaaagcaggaactcatccaggatcttttcaaacaatggcaagatccagttagaggaagagtgactggtggaatgatcaagtactctccttccctttttctcatatggatggtgttagtgagggtcaattttaacaggttctactatttgagcttgatgctattcgaaaggcatgtgcatccctggaacccaactatcacgataagagttctgttgacaggagtggcaacatattgcctggtactgttgttgactccaaaatctgcaatcccaccgaatttgacttttatctctgcagccatgttggaatacagggtacaagccgtcctgctcactagtattgttattcaacatttagcatcggtgcttacgtcaccactgatgttaaatgcacattttttacctcgttttttaaataacactgacttagaatgtctaatttctacatcggtggtcaggatagtaccgatgtggaaaacgttgtctttctacaacgatggtttagggaccgacgctgaaatttttaactttcaacatcggttgaccaccgatgtagaatgtggttttccactgatgtag

SEQ ID NO: 44608 - DNA, 468 bp, Glycine max
  Peptide Sequence Number=SeqID_136293
atggtgttcgggtacatgcaacagccaacggataacaacacaaatatagagaaagagagagaatgtgtaaaaagtttaaaggcatttgaacaaagtggaaccacactaaacacggacaaatcagaggcgagggacccaaggcacatcaacccttcaaaggcagtgaggcaacgcggcactatgcaacaatggaggcgcttgtgggaacagcaaggagaagacgtagaagagctgttctttttggcttgttgggctgcgtcgcgcgtgtctacttggtgggccgcgtccaaccgcgcgtgtcctactattcaaccgtgtccggtgatggcggaggcaacgggcaccgcgtcgcaccggagtcatatctgcatgcgtgtctggtgcgagtctgacgcaggacacgccggtgatgtgccgtgtccgtgcttcttagggctcgctcacaattttttaagaggctttatgtga

SEQ ID NO: 44609 - DNA, 435 bp, Glycine max
  Peptide Sequence Number=SeqID_136294
atggagcagataaagaatatggcagccagtgatcatgtcattctctgtgatcaagcctacacgcctacaaagaaaagccttcttgagctcacttctcaagatgctatgttggctcaaaacaagctcctggccaacaccttagagaccctcacaacaactctaagtaatctccctcaacagctgcatgcagtgcaacctcctccatctttagtcatgcacattgggagatgcaacatctatggtggcactcacgagtcaagttcatgcatggtccaagacaacacatccaatgaagttaactacatgggtagtcagaatcatcaaggaggaccaccaggattctatcagagagtttatgcaaaggaccgaatcacatcagaagagtaccgatgcagcaatcaggaatctggaggtacagatgggccaactagctaa

SEQ ID NO: 44610 - DNA, 477 bp, Glycine max
  Peptide Sequence Number=SeqID_136295
atgtacaaagataagtgggctcatacttatcccatgggcccgaaatctaccctaaggctcatgagaaccctagggtcttctcttgcatctctggtcatgggatcaccgcctagctcccctccatattcagatggtcattcacaggttgcgtctaagagaatggttatcatcgatcctgcaactgggagaggatcagtcccacataaagaaaagttccacaaatatccaggggtagtagctcgagaaaagattccaattgtacatagcaattggatagatgtaccggaatctctaaaggagctaggacaagataaagaggatccttccgtaaaatatggtatagatccacaaacttgggaggaatttgctgcaactcggaagacacctaattggcaggacttgttagaagaacagatgacacaaggatcctttgttccccaaggtcgtgacaacatactgaacaccgccattgggtga

SEQ ID NO: 44611 - DNA, 288 bp, Glycine max
  Peptide Sequence Number=SeqID_136296
atggaggggaggcggtggagggagaagtacgatggcgaggagatgaaagggtggtggcaaagggaggaagggaggagggagaaagacaagctagggtcgcaagaggtaggagtggatggtgcgagggtttggttgtttaatggttggggaaagcaacaaattcgttcttggttgcgagcgcaagggacgagtaaaatggaaaaaagggttgttggagtcagagagatcaccagaaaagttagaggtaacaagaatgaagttgagggagcaaacggaggagagttgtag

SEQ ID NO: 44612 - DNA, 696 bp, Glycine max
  Peptide Sequence Number=SeqID_136297
atggcgtcagcatcatctttttcattcattcctcaagaaaccgacgatgtgttcataagctttagaggcgaggatactcgccacactttcactgctcatcttcttgccgcattctacaggctaaaaataagaacctacgttgactacaaacttgggagaggggatgaaatatcaccaactctcataagggctattgaggagtccaaggtttcggtgattgttttgtccaaaaactatgccacgtcgaagtggtgcttggaagagctcgtgaaaattatggaatgcagaagaacaaagggtcaaatcgcgataccggtcttctatcatgtagatccatcagatgtgcggaaccagacaggaagttatgcagatgcttttgcgaatcatgagcaacgattcaaagacaacgtgcagaaggtggaactgtggagagctagtttgagagaagtaacgaacctctctggatgggattgcttggtcaacaggacgggtaatatgagggacatggaagacttgatcacaacactgcaccaacttggggagctgaaattggagaaggccatgccaacagatgattcaagcgtttggaatgaccttatggccacctacgagcgtgtattgcagcttaaacaggacaagttaatgcgagcatttaataccaaagacattgttgatagtttattagatgatagttga

SEQ ID NO: 44613 - DNA, 450 bp, Glycine max
  Peptide Sequence Number=SeqID_136298
atggcgagatccctttttaaagggacccaacagcagattgtttgcaagaagcaagtactcagttatgatgagagctccaaaattatcccactcagacatgagttatccccaaccggtttctgcgagcaggccaccaaacctcacttaagggagaattacctagatggtaatccaaacacaaagatctatggtccaaggctcattaaggagcaaggaacccttaagctggaagaagaagtgtttgaccactatttggcaagaacattttggcgcctacaatgcggtcatgtgactatttttgctaaagggcagaagaagaagaaaggaaaaggtggaaagaagagaaaatttgatcctaaggacatatgcaattactctaaagaactgggtcattggaagcaagactgtccaaagaaagcaaagaaatattttgttgttactcttgtttag

SEQ ID NO: 44614 - DNA, 447 bp, Glycine max
  Peptide Sequence Number=SeqID_136299
atggagaggtatgaatgtcttgagctaaagctatcttcccatggaaggaagatgactaagttcgggaggcctgctccagagattgaaggctttgtggcggccattggactaagtcctttgatcatctgttccctagatacgagcgatcggggattaatgtctgcttttgtggaacactggcataaggaaactaacagtttccatttgcctgtcggagaggtgactatcaccttggatgacgtcgcgtcgttgctacatctgcttgttgtaggggcgttccacaacttcgagctacttcatgtcgacgacgctgtcaatatgttggtggaattactcgaggtcagcgctgcagaggagagagctgagacgattcaatgtcatggctcttatgttcgactatcatggttgcgcgacgtgtatcagatgaagatcgaggcatgtgactag

SEQ ID NO: 44615 - DNA, 321 bp, Glycine max
  Peptide Sequence Number=SeqID_136300
atgacccctactcatgatgccctactatattacaacaggaggtggaacatgccacgccaacacgactttgtcagttactcattcacaggaaaaaatccaaaaaagtttgacattccttccggatgtatcatcgatgaactgaaggatttgatcaagcaagttgcacctcaagggattcccctttatggtattcatgaatcacaaatgctatgtacggagtgggctttgcctgagaatgataatgtgtactccacaacaacgctactagcagtaaaggacattggtctcgtacaaacttgttacataacgacaacaaattga

SEQ ID NO: 44616 - DNA, 447 bp, Glycine max
  Peptide Sequence Number=SeqID_136301
atgttgaatcaatttcatccttgcatacaggattctattgaaaacattattggtgtcaaagcaaatgaactgactagctggtccgaagagtacatcaacctggttggtggcatagagagatttgaggaattgaagcgttctctacttgttgacgacttatctaaggttaccatggacaagtgggtgaatattacggatatgggatacgtcattgcttcacgatacaacgtcatcattgtttctctttcacaaaaacaaagcatgatattttttcctcttagaagtcagccgccgccagattcttctgtgcatcgtgtaatatgcactggtcatgtgtatggaaatcattttgtacaggcaaagcccactccgtacatagctagaatgcagcgttacacaagtttttctaggctgaaaatcgaatttgttgatttaggtgaaccatga

SEQ ID NO: 44617 - DNA, 660 bp, Glycine max
  Peptide Sequence Number=SeqID_136302
atggttagaactagatgtcttggtcggactttaggccgagcaataggaaaagtgttggggaggagagacgagagtgacgatgatgcccccagcagcgaaggcctactgcatcagctcgaccctcctacggctgcggaggaattgatcgacgaccagacagaagcacctgttgaaaaaggtgttactgatgttgggggttttccaggcggatcccatgacacgtcagttctcacagattttgaaaatcacattgctttgagagtgtggaatggaaaggaatgtcctaagttaaagttatcttcccatggaaggaagatgactaagttcgagagacctgctccagagattgaaggtcttgtggcggccagtggactaagtcctttgatcgcttgttccttagatacgggcaatcggggactaatgtatgcttttatggaacactggcataagaaaactaaaagtttccatttgtccgtcgaagaggtgactatcaccttggatgatgttgcgtcgttgctacattttcctattgtagaggcattccataacttcaagctacttcatgtcgatgacgctgtcgaaatgttggtggaattgctcgaggtcagcgctgcagaggtgagagctgagacgattcagtgtcatggctcttatgtttga

SEQ ID NO: 44618 - DNA, 267 bp, Glycine max
  Peptide Sequence Number=SeqID_136303
atggctcgcatagctctaaacaacaaatcagtggagtatgaattcattgaggaaaggttggagtccaaaagtcagcttctccttcaatccaaccccatttacaagaaaatccctgttctcattcacagggacaaaacccatagtgagtttttcatcattgtgcagtatgtggatgatgtttggtcctctgcctctcccattgtcccctctaatccttatgaccacgccgttgcttgtttctgggctgctgcttatattgatgaaaag

SEQ ID NO: 44619 - DNA, 1989 bp, Glycine max
  Peptide Sequence Number=SeqID_136304
atgaagagggtgaagaagctatacccatttttggtcctacccaacaggcctaaacctcttcaaattttcatggctgtgatgttcctctacttgctcttcaccaccttcgaaatcgaaacctctcttggtttcagaacgaggtttgtgtcagtgtcctcattgttggggaatgaagatcaacaccaacgtacccattccagcaaagcctcaaactttccctcacaaggggtgttccaaggctcactgcatcgaaaagccttgcagggtttgcagaaagtttccaccttgagtttcatcgaggctttgaatgacaccactgtggaagaaaacatgttttctgaactccacaaggctgctaggcatgcttgggttgaagggaagaggctctgggaacaagttgagagtgtgaaagaaaccatgaatgtggcaaggttcaaggctgagaacctttctgattcgtgtcagcattcaatttcattatctgggtctgaattgaggaagcagaataaaggggtcatggtgatggtgcttccttgtggtttgacattggggtctcacgtgactgttgtggggaccccacgttgggctcactgggaggacgatcctaagatatctgtggtgaaggaagaggagggaaaggtaatggtgtcgcagttcatgatggagcttcagggtttgaagagtgtggacaaggaagagcctcctaggatactgcatttcaatcccaggttgaagggggattatagtgggaggcctgtgattgagcagaacacttgttacaggatgcagtggggttctgctctcaggtgtgagggatggaagtcccgagctgacgaggatacagttgatggacaggtgaaatgtgaaaagtggattcgtgatgatgatagccatgcagaagaggcaaaggcaacatggtggttaaccagactgattgggcgaactaagaaggttactatagattggccatacccttttgtagaggctagattgtttgttctcaccgtgagtgctggcatggaaggctaccatgttagtgtggatggaaggcatgtgacatcttttccctatcgcacgggattttctcttgaggattcaactggtctatccataaaaggggatgttgatgtgcactctatatatgcagcttccttacccacatcacatccaagttttgctccacagatgcatcttgaattgcttcctcaatggaaagctccacctcttgtacacgtgaatgtggagcttttcattggaatactttctgctggcaaccattttgctgagcggatggcagtaaggaaatcatggatgcaacataaactaatcaaatcttcaaatgtcgtatctcggttctttgttgccttgcatggaaggaaagatttaaatatggagataaagaaagaagcagattattttggcgatattattatagtcccctacatggatcattatgaccttgttgtgttgaagacgatagctatcactgaatatgggattcgctcagtggctgccaagtatatcatgaagtgtgatgatgacacgtttgtcagaatagagtctatcatcagcgaagcaagaaaagtaggaagtggtagaagtctctatataggaaatatgaattaccaccataggcccctacgttctggcaaatgggcagtaacatatgaggaatggtcagaggaagagtatcctacctatgctaatggtccaggctatacaatctctgcagacattgcccagttcattgtatccaacttcgaggagcacagattaaaattatttaaaatggaggatgttagcatgggaatgtgggtagagcaattcaacagttcaaggccagttgagtatgtgcacagcttcaagttctgccaatttgggtgcattgaagattactacactgcacattaccaatctccaagacaaatgacctgtatgtgggacaagttgcaacaaaagggaaagcccctatgttgcaacatgagataa

SEQ ID NO: 44620 - DNA, 525 bp, Glycine max
  Peptide Sequence Number=SeqID_136305
atggaggaccaccaccgtgagaaagttctgccaaatccgataagaacatttggcgcctatcgtggggcaagtgaaaacttctccttcgacccttacagccaaccaagaaagaccaccatgggggtaggcatccaccatacttggaatgcctaccatagggaccctcgaaaatgggagtctggcaaccgtggtggacctcccgcgtcagctcaactaccacctggatggaagacaatgaacatagacctttatgacaaactctcagacctagatgagcacgtggacgcatttgtggcacatatgaacttgttcacaaatgatgatgcctttatgtgccgagtgttcctgactaacttgaaaggtgcagtgcttcactgcccagacgtcactttgacatcgatgatattctcaaacaacatatgcaaaaagcctcctacaacgttggatgagctaagagcaagggctcactctgggaaaatccaacagtggcaagaaggctcaagagaaatgccaactattatgtga

SEQ ID NO: 44621 - DNA, 519 bp, Glycine max
  Peptide Sequence Number=SeqID_136306
atgaatggaataagattggagttttcaaatgcttggaagcattcaaaattctcatttgagaagaactccatatctatgaattttgggtctacattggaacaagatgaaaagaggtttgtgtaccatatacgttgttcctctgatgagaacaatgatccagagggaatggagggaggaatttgtgtttcctgtgacccagaaacaaaagaaactcatttcagtttgacttatggtactgacgctatgattccagtggagattcaagaagaagcttgtaagagaatagcaactcggaagcatgagtcgaaattgaataaaaagggatttagagttggcgatcttgtatggagaatgagaggagaagcacagaaggaccatgctagaggaaaaattactccaaactgggaaggaccctttagaatcactgcaaaaatgcaaaatagagcataccgacttaaaaagcttgttggaaaggaaattccgaggacctggaaagcaacacacttgaacgatatgtaa

SEQ ID NO: 44622 - DNA, 1053 bp, Glycine max
  Peptide Sequence Number=SeqID_136307
atgtcaagcatcatattcataagtcatgaccaacaaagtagtaagaaacttaacaattccaaaacacaaatttttcatggcttctgcttccaatcctcctcctccccctcctccaccaaggaacggtggcactccggtgtaactttaactggcgcaactacaaaagagttttcgcactggatcttggagaagctgacaaactccaactaccttctaaggtgtcaacaggttgaatctgtgatcaaaggccatcgtcttcatcatcttctcactaatcctcaaattccgctcgatacaccactcttgccgattgtgatattggaaatacctcaccttagttcttaccttgggggcaacaagatcagctcctacacttgtggctacaatccaccatttccggcgaagttcttccaagactcgttggttgcaaatcgtcctaacatctttgggacaagcttcatttgcattttcagtccattaatatgtttcagatccgaaaatgtcaacatagtacttgatggtttgcctgatgaatttgagtctcttattactttcgttagtggaaagtttgaatctctctctgttgatgaggttgcaaccctacttttggctcatgagactcgattatcttgcaagaaagctcttactttgattaatcttactaaagctgataaatctagttttagcctaattcttctcaacaagtgttttctggcaactctacttctgcaaatctgcaagcttaagttgctcagggccagtctagctcctcatcaaactctggatcgaattacaacaactataatggtggaaatcggttctttaactctggttgtggtggtggccgtggcagaggttgctactccaatgtgcagtgtcagatttgccataaaaatggacatgaggcttctttctgctattacaggcatgatgatgattatgttcccactcaaccaatggattaccccaaccaataccccaattactctcaatctctgccttcacccaaaatcccaatccctctcccaatcaggatcaaaatcagaaccctaa

SEQ ID NO: 44623 - DNA, 177 bp, Glycine max
  Peptide Sequence Number=SeqID_136308
atggtgttcaacattttgaacctcatgtgtaaaggcttgattatttatatgaatggcaatggaatggagaaggaagagagagaggagacgccacttcaaggagaagatgagtctagaaaaagctcaccaccatatgaggccatggataagagcttgaaggaagaagaagatgaatga

SEQ ID NO: 44624 - DNA, 1509 bp, Glycine max
  Peptide Sequence Number=SeqID_136309
atggggtcggaccaaatgccctcatttaaaaagaggttctatcatgtcaaagtcaagaacctagaactagccagcttgcgagaactaggacagcggatggatcaagttcgacgtcaagccttcagcaaggcgtatgggaaaatctgggatttggtcatggtagaagtgtccgttgaagccatcgcatccctcgctcaatattacgaccaatcgctcaaatatggggtagtggacttagcagcgatcaacgcctttctcgcttatcatcacagtaaggaaagcccgatcatcgctattttggccgatgcatatcatacgttcgacctgagatgcgagaagagcagtgcaagaattatctgttgtaggcctgtctgtcctctacaaggtatggtaggagcgtttattagctggttccctcgatggaaagaaggaggggtaggagtgttatgctcgtgtgaaggattcccaaacatccccttgatgggaacgaggggttgtattaattataatttcatgttggccataagacacctaggctaccctgtgagaggtgtgccatcggaggagatcatcgcaccttttgtcgtgcgaggtttcatcgaacctaatgcgaagatacttcaaagaatccgtaaagtgtggagtacagtggaaaggaaagataaggagcttaggggaagtagcaatggcgtcatcggtggctatcacaagtggttgaagtctaggacgcaagggataacttggttcccaatgctaaaatgcctaagtgggaaagaacctgaagtccccgaggaaagcgaagaagtgcaagctttgaaagtggagctcgaaaaaatgacagtggtcaaggagaagctaaagacgacagtcactagggtcaagaaagagtgtgataagctgagagatgtcaacatgactacgatcgaagcgttagagcaggaaagaaaaatggccgagagggacgagtcaaggatggaaaacatggtgttagaggataagttgaaggcttgtcaaagggcgaagagaagtttgacgaaacagctgagcagaacggaagagaatatgttgacaattattgatcaatataagaagaaggtgaacctatctgctagtcatgggcagaggctggaggatgaacatgcgaaggtatcggctctacaaattgaaaaggaagcaagagagagggtgatagaatcattgcacagggaagctatgaaatggatgaataggtttgctctcactctgaacgggagtcaagagcttccaaggttgttagccagagccaaggcaatggctgacacgtactcagctcccaatgaagttcatggtcttttcgattactgccatcacatgttgtcgcattactcattgcattttgtttttagaagtcattgtcatcatcaaaaagtaaccatagtaaccaaaaagaacgaacacgttttacgacacccttaccgaacacgagccaaggctagaattatgagcgaggtagaggaagttaaggaatag

SEQ ID NO: 44625 - DNA, 234 bp, Glycine max
  Peptide Sequence Number=SeqID_136310
atggacctacctgaagagaatcttgacttgcccattgctcttaggaaagtttctcttcctaaaaatctttgtaaagcacttgatcatccaggatggcgacaagccgtgattgatgaaatgaaggctttggagcataatggtacttgggagctggttcttctacccccaggcaaagaaacctgttggctgtcgatgggtatatgctataaaagttggggccaatggacagattga

SEQ ID NO: 44626 - DNA, 867 bp, Glycine max
  Peptide Sequence Number=SeqID_136311
atgctgggcgtgtggggttgtattgggaaaaatccaaatcccacatcggctaaaaataaagccaagttagagtatataagtgagggacaacccttaccccttgaactagcttttggggttgagttaggcctaaacttaaattctaagaatctaagacactacattgctatcttcgtaaacaaaaaatatttttacttacatcttgattcatcagaggagggctcagcacagttcaaccccaaaaacagatttttggtttttctcctaactatgtttaccctaatcacactatactcgactatcattcccatttcactttatgtgtccatagagatgataaaatttattcagtcaactcaatttatcaacaaggacttgtgcatgtaccataatgaaaccaatacacctgcattggccagaacttcaaatctgaatgaagaacttgggcaggtggaatacattttctctgacaaaactgggactctgacaagaaatttgatggagttctttaagtgttcaattggaggagaggtctatggaaatggtgtgactgaaattgagagaggattagcagagcgtaatggaatgaagattgaggaaaatagatctcccaatgcagtgcacgagaggggttttaattttgatgatgctaggattatgagaggagcttggaggaatgaaccgaatcctgatgtctgcaaggaattcttcagatgccttgctatatgccatactgtactgcctgagggtgatgagtcccctgaaaagatcagatatcaagctgcatcaccagatgaggctgctttggttattgctgcaaaacactttggtttctttttctacaggttcaatgttcaaacttcttga

SEQ ID NO: 44627 - DNA, 297 bp, Glycine max
  Peptide Sequence Number=SeqID_136312
atgctaacaacccataaagaagagcaactccaggaagctaaaacagaaattgaagacaaagtgaaaaggatattgaaacttattaaagaggacagccgtgaagaggatggtaccctagtagaacattctaagaaggaaccacttattgaactgattgaagatttccacaatcaataccaatcactgtatgcacaatatgatcatctaacgggcaagttaaggaaaaagattaagggacatggacaaaagaaacagggaaaagaaggttcaccaccatttccagttgttcattcataa

SEQ ID NO: 44628 - DNA, 1701 bp, Glycine max
  Peptide Sequence Number=SeqID_136313
atgactaatgcaaactgtccacaagagtcattgcattcagtctcaaacgggaatctaagattatggaaatctatccactattgctttaagtctgaaggaccatctatgaagtcactttgtgaaagtcacaatgacatatggacccttatgactgcccttgagcttcctataatatatgtgcgagagccaaaggtcaggaagatgaagacaatctctggacattgtgtttcggtaatagacatattagttttgaaagcagctaaaattctcacaaattttatctctgctgacaatggtgcttctcatgtcatcaatgcatatatccaccgagcttctgcatctttcaacgagctcaagcaactccacaaggagcttggatcatctcactctcataagaagcacaaaaggcacagaacagagaatggtaatgacagtgggaaggtagtgggaaattctattcaaagtgttgatattaacaaggagctcaaccctgggcatgtgaaatttgatcagttcaaaaggcaacaaagtggtagtgggaatgctgatcaagatgatgaaaattttagtcaacaacttgatggttttattgggtatgaaactgaaaatgtggatgggggtgaaatgcataagaaaaagaaaaagaagaagcaggaagttgagtccttgcacgacatagatagcaccgttaaatttggagtgagggaagctgatggaaagctacctaatggatcccaaaatgaaagtgagtcaaccagagaacatggaaatgaaggcaacatcaacgcaaggatggaagagggaaggaaacagaaaagtggaaagaagcacaaagtaagtactagtagtttatccagttataagggtgaggctgacaatggaaaagatctagaacaacaaaaagagatggaaaaaacatcatgcaatggcttcgagggtgaaaatggagggcttggtagttcccaagatttacaaatcaagaagaaaaagaatcacaatttagactctgcctcttcaaagcagtatcttcaggcatgttccctacttgatgattggagacagcatgttagttctaggaaccctagaattgagaaatgtagttctatgttagataatcttgtgggctcactagatcttcctaaggttaaaaattctaccaaaggaaaggttttgatgcaagcaatgtatggagttaaggtgaagactgtatttatttgcagggtgtttactgcaacattctctggctcgtcaaagaagttatcaaacttgaatgtggccgacatacattcatgggctccagattttagaaggttgcagaatcttgtaaatgaggaaagtagagtaagattttctggtggtaaatttactgtattgaatgagttggaagcggttgatgcctctgtgaagatattatatcctactatccaggctggtgtagataccattgagatagaatggcttgtgaagactgttgaggaattacatgcgggtgctgagaagctttcacaaggaaatgatctttttgcaaagggagtagatgggttttttgaagccgttatgactagtcgcgatactttgctcagctctatgaggtttgataaaactgtaaatgatcattccccaggccgtaacagacacatgcagcacaagctggatttcaatctcaaatttaggggaggagtattgacagatactcattag

SEQ ID NO: 44629 - DNA, 285 bp, Glycine max
  Peptide Sequence Number=SeqID_136314
atgcagataaacatatgcggcatattttggccttcatatttgagtgacaactgtcagaccctaatttcatctgagtatgatgttttatcattcacctatgatgttttgatcattgctagtcgaattacggtgtttggcaccgattacagcgcgaagccagggatcactctgagttttgatcaaggaaacaaaaagatacaagggaaagggggcaaaagggtcattttgtggatttttttggacccaagctcgcccaggctagcatttggctcacctagaccatga

SEQ ID NO: 44630 - DNA, 1902 bp, Glycine max
  Peptide Sequence Number=SeqID_136315
atggcttctccatctgcctcccctcctcctcctccttctcctccttttgctccttcggacgcatcggctttgccgtctgccgtgaagcggacacgcaaagcctcacgtctacgatcgttgtctactagaccacctggtgctgagagaccagtggtccatgtagatcctgctaccggcaaggctgacggcccccataagaagaaattaaggacatatttggggattgtggcacgtgataaggtggacgtcacctacgagaattggaagaaggtccctactgctcagaagggcctgacttgggaggatattcaggcggaatttgatatcccagaggcttctgacaatagaatgaaatggaagttacttcagaccgacggtgtggaggacactgtctgtgagaaatacggcattagcaaggaaaaatgggcccaattttgccagactcgcagagacccttcttgggagaacattgccccccacgttccgtctcgtgggggttatgactatttggagcagaagctcctagctgagaagaccaagaagaagctgcaggaagctacacagtcaggaagcgttgatggcgtcatcgaccctccatccctggtcaaacgccacgtgaagtggaagatggcctgcacgaagaaaacaggggagatgacaactgaggccgcaaaggaaatcgctgagaagatcataaagcaccctggacgtgtctgtgctgctggagtcgttgtcaagatcaagcagtactttggatcgactccacggacgccccgcaactcttcctccctgcctcctgaagaattgcagcagctgactcaacaaatcagggaccaactaggccagatgcagtcccagatgcaatctcagggacttgcactgcgtttcgagcctctggttggtccctctggtcctcgagtaagcacaaaggggagttgtgttgatccctcaagaaactatcctgagacgggtgactcagataggtgcggcttgtacatcgaagcagatcctgcccgcctggttgccctggggagagtttatgagggatccactattgttcataactctccttttttgcgtggccaagtaaaggtgggtgtggaggaggttacagatgcagatgctccaattcctgtacccactgatgaggtttccttagtggggcaggcacttcacaccttccttgcttggccgacacatctggtcaagtctttatcacagcaggaaaaaccacctccaaagcctgatccggaagttgatgatccactttatctgatgacattgaccatcccaaagcttttcttgaggccttatcaggttacatgggatgccaccgtgttcggggtctttaatccaaatttcccactctacataaagcacaaagacctctttgaaatcgcacacggtggtcaatgtctcagcatttcaatgttacaattgtggattctgcatctcactgatacaagtatacgagcggggaattctgatatctatggattcctcgagccacagccagacaactaccttaagggaattattaacagtgctttaaaaggtcttgatgatgctccacagcctaaatcaaaggctcctgctaggtggattgtcgtcaagtgtaatagacaaaaaggaagtactgagtgcggctactatgtcatgcactggatgtccaccatcattttaggaacttttaggaataactgggaagcggaactactctgtaaaaggtacgatggctacaatcatcatcccgttgcggcgagtgagttccacgcgacgacgagcgactcagactcttcctctgttatcgatctgaaccataatgaaggtgaggttaaggggaacggttctagaatctttgatctggaccttaaccatcctcctccacatgagatcgcttga

SEQ ID NO: 44631 - DNA, 351 bp, Glycine max
  Peptide Sequence Number=SeqID_136316
atggaactcatgagactaaatcaacataaagaaaatgacaagaaaaagaaaggaatcacacttaaagcttcatcttcaattcaagaaggaagtgataaagaagatttgaatgaaatagaggaagatgatgatttcagacatctgagagttaattgcccaagtttcaagaaaagaatagaaagatctgaaaagaaaaccttcaatgataagaaagcaaagaaagcttacatcacttgggaatacaatgatatggatacattcgaagactcagaaaatgaagtcgtgaatctaactctgatggccaaaaattatgaaagcgatgaagaggtttctttgaagaagagttggtaa

SEQ ID NO: 44632 - DNA, 528 bp, Glycine max
  Peptide Sequence Number=SeqID_136317
gtgtacggagagtttgtgaagaccctggacaatgatcttctggccctggtggatggcgactggcgacgggcaacaggtggtggaggaagcggtgctggaggcggggcatttggtgctgcggctctggcttgggcacgacgaggccttaggaagggtgtcaaaaatgaccccttgagcgtcacacaacgctgtgatcaacactgggaaccccaactgcgaggtgttggaatgggagatctatgtgatttggcccgaaatgaagctgcccaagttaaagtaagaaagtacgctccgtgtctgagcgagcatggtgagatccttctacaacagcttccatggggccccatcgatgttcaagatgaatccgcctccggggacgatgggggtgtcaaggaagtcattaatggtctccgcatcgaactagatgacatgcccccacaccttgcagtacttttgagcaccgccctctgggtcatagatgttggagtagaattctttgaccaaggtgacatcgatctgcttctctag

SEQ ID NO: 44633 - DNA, 294 bp, Glycine max
  Peptide Sequence Number=SeqID_136318
atgggtcgcgagtttgccgaggccccaagcatgggcaagttttatccggtgtcgagggtggtaaccttgacaggtgcaaaagttgcaagtttttcaagcaggtcaagccctcagcctgggcatgccccccaggatggacacactctttgttttgcaagcaaattcagacgtgttagcggaatggagaaggaagagagagaggagacgccacttcaaggagaagatgagtctagaagaagctcaccaccatacgaggccatggataagagcttggaggaaaaagaagatgaatga

SEQ ID NO: 44634 - DNA, 729 bp, Glycine max
  Peptide Sequence Number=SeqID_136319
atggagctacttgaggtctctggtgaggaggctagagctgagaccgtacgggcgcatggggcatacttacgactttcgtggcttcgagaagtctatcagagtagatgtcatgctcgacggtggattgtagtagcccgtgcttacctcctccacttggcgggttgcactcttttttctaacaagagtgcaacaaatgttcatgtggttcatctagagggttttcgagacctgggtcagactggggtctatgcttggggagctgcggcgctggtgcacatgtatgaccagctaaatgaagcttgcaagacccctacacgacaaatggttaggtacttgactttattacaatgctggatatatgagcactttcccaatgtgcatcagtgtgtcaccgatgatgcgtatgctgagatgaccccacgtgcctcccagtggctgactacgaaggctcacatgagagggatcacaagagcgccgtaccaggaacgtttagatgctttgacgatcacggacggtcagctgagatggggtcctattgtggtctttgttcgaccagagagggtggtacgacaattcgggtacattcagacgatccctccaccgcctgttagtgcttcactatcatatgaggagatagatgataggtggatgcatttcttggaccatgtagcacctgcgactgagatttgtgttgtccctggacaggtatcagcagactacatggattga

SEQ ID NO: 44635 - DNA, 471 bp, Glycine max
  Peptide Sequence Number=SeqID_136320
atgaccccacgtgcctcccagtggctgactacgaaggctcacatgagagggatcacaagagcgccgtaccaggaacgtttagatgctttgacgatcacggacggtcagctgagatggggtcctattgtggtctttgttcgaccagagagggtggtacgacaattcgggtacattcagacgatccctccaccgcctgttagtgcttcactatcatatgaggagatagatgataggtggatgcatttcttggaccatgtagcacctgcgactgagatttgtgttgtccctggacagaatggttgtgaaggttgtgaagcgatcgcagaaagattggagcgtgtgcttaacctcaggatggtcactgaaggcatagagttacatgagatcatgcaagattgcctcaggatcgctaggggtgacgcctcagatggaagtcttagggcacgacgtagatgccgaatagatcattga

SEQ ID NO: 44636 - DNA, 562 bp, Glycine max
  Peptide Sequence Number=SeqID_136321
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcaccgtgggttgaagggttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 44637 - DNA, 453 bp, Glycine max
  Peptide Sequence Number=SeqID_136322
atggcgtggatcttaacccgctatcgcttcccgggccgtacgctgcttgacgcactgatggatctgccgtttgcgctgccaacggcggttgctggcttaaccctcgcgtcgctcttctccgtgaacgggttgtacgtagcgatggcctttaccagtattccgtttgtggtgcgtaccgtgcagccggtgctggaagagttggggccggaatatgaagaagcggcggaaacgctcggcgccacgcgctggcagagtttccgcaaggtggttctgccggagctctccccggcgctgatggcgggtattgcgctgtcgtttacccgcagcctcggtgagttcggcgcagtgatttttatcgccgggaacatcgcctggaaaacggaagtgacctcgctgatgattttcatccgtctgcaggagtttgattatccggcggcgagtgcgattgcttcg

SEQ ID NO: 44638 - DNA, 555 bp, Glycine max
  Peptide Sequence Number=SeqID_136323
gaatggccccaaggaagcttgcctcaaagaggtccaggaaggacaaggcagccgaaggaactagttccgctccggagtatgacagtcaccgctttaggagcgctgtacaccagcagcgctttcaaggccatcaagggatggtcgtttctccgggagcgacgcgtccagctcagggacgacgaatatactgatttccaggaggaaatagggcgccggcggtgggcatcactggttactcccatggccaagtttgatccagaaatagtccttgagttttatgccaatgcttggccaacagaggagggcgtgttcgaagaggaccaggaatacaagtatgcccagacgaggcacgattgtgatcggctcgatgaggttccccttgggaaggtgctaattatgccggggcaggattttatccggactgcgccagggaagcgagtgcgaatcatgcgcaccaacatgaccaccctgacccagatatggatgatgttgctcctcagcaatatcctgccccccgatcataattccgaccttcccatgccgaagtgtcagctg

SEQ ID NO: 44639 - DNA, 444 bp, Glycine max
  Peptide Sequence Number=SeqID_136324
gcttttcgtcttacagatagcaaaaaggtttatatggataaccactcgagtatctccgcccgtcagcgtgtctcaaaactcaatatgacagatcttgtaagcgcggaagatgacatagcaaaaaagaatgtttatacggacaaccactcggggatttccgcccgtcagcgtgagtcaaaagtcagtatgacagatcttgtaagcgcggaagatgatgcttttcgtcttacagatagcaaaaaggtttatacggataaccactcgggtatctccgcccgtcagcgtgactcaaaagtcagtatgacagatcttgtgagcgcggaagatgacgcttttcgtcttacagatagcaaaaaggtttatacggataaccactcgggtatctccgcccgtcagcgtgactcaaaagtcagtatgacagatcttgtgagcgcggaagatgac

SEQ ID NO: 44640 - DNA, 477 bp, Glycine max
  Peptide Sequence Number=SeqID_136325
atgcttcagagtattcatcaggggaaaattttattactgcagagcttgcatgtggtagctcctccagggtccattctgtcggcagagcagttcattgagaaggtatcctggcctagaaccttaccttttgctgtgagagagggtgaggtccccagtgctcaggtacctcaacaggtacagggtgcgtcttctgaggctaccatccctggagcttttgatttttctggtgcaggagtagagatgaggcctaatgaggatgttctttctgagccaattgtagcagctcctcctacaccagtacatgagagacaagcagatcctcctacacccatcatggagatgctagaagaccctaccacgccagtcctgagattgtcatccactccttcagctaccccagttttacatctgacagatgaggaggatatgcaggaccaggacacacaaggcacacaggaccagtcgcaggaattctaa

SEQ ID NO: 44641 - DNA, 474 bp, Glycine max
  Peptide Sequence Number=SeqID_136326
atgatagaccagggtcgactagaagtcggcattgaaggaaaagaagagccgcatatatgcatgcaatctacggaggggagcggtagttgcgaagccaaacccttggtgatatacttcactaaaagtgcagcctcgcaaaaacccgggcaccccttaatggccaaacctgttcctttcccgtatcaaaatagtcacgcggtcccgtggagatatacacctccggggaagaaggaagaagaagtcactgacgtcagctcgctgtcagctaaagtaacaaatatcacggggctgagcggtgtgacccgtagtggtcgtgtgttcgcacctccggatctaccagtccaacctgccgacgtcaaaggaaaaggaaatgtggtggaggaacaagatggcgaagcaccccacgcttcgaataaagatattccagcaaaggggtcttggagaaaaaggatggtagaaaggaggtgtcgctag

SEQ ID NO: 44642 - DNA, 668 bp, Glycine max
  Peptide Sequence Number=SeqID_136327
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccccgtctagtttccatctccctgtgggagagctgacgatcaccctggatgacgtctcttcacttctacatctgtctgtgaggctgccagggctgagaaagggtagtgttgtggatcgtacgtacgcctgcaatgggtacgtgatatctacgagcgtcgatgccaggcaggcccttcgtgacctcagtcagaccgggaggtacgcctggggagtagctgctctggtacgaccaactgaacgatgcctctatcagcagcagccaacagcttggcggttagatcacactgctgcag

SEQ ID NO: 44643 - DNA, 54 bp, Glycine max
  Peptide Sequence Number=SeqID_136328
atggccaaccagcaggcgaccaagtccaaagccaaaggtagagagataccttag

SEQ ID NO: 44644 - DNA, 438 bp, Glycine max
  Peptide Sequence Number=SeqID_136329
gtgaacccgatgcccccatctgatataaacccaaatgaatcatccaacctcagatatggtgggcaaagatttgggaagtacggacggccctatgatgtgcaaattcaaaacgagcacaccttcccgccatatggcttgcctccaaactatacaccacccaatgtggcgtacactcctaatgaagatgtcaataacttcgctcccatactcattgagagccgacaacctcatcataggataaggtcagggccattgaacggaggcaaagcattcatgcctttgctaactagaagagttgttcctatacccaatatcgtccccctcccaaacaaagaacacgctttacggcgcccttaccaaactcgtgctagagctagagtaatgggtgaagtagaggaggtgcaagagcagatgaaggccgacatggaggccatgtaa

SEQ ID NO: 44645 - DNA, 252 bp, Glycine max
  Peptide Sequence Number=SeqID_136330
atggactcaggaaggttccaagttagtgtaccaggtgacagctaccctactaagactttcatggaagaaatgtaccagcagttgctcatttttgcgtatgcccccatcttccggcaatgcatctttagatggttcttggggcaagtagtccccttgtatttgtcagagtctgacaccttgaacttgggaggggttacgatattgggtactaggaataagagtagttcaggcttagcgcaacaggcgcactaa

SEQ ID NO: 44646 - DNA, 438 bp, Glycine max
  Peptide Sequence Number=SeqID_136331
atgacggagaggtacgcctggggagtggctgctctggtgcatatgtacgaccagctgaacgatgcatctatgagccacagccgacagcttggtggttacatcacactgctacagatttacgagtactttccgtcactcacggactccactgctgatcaggactacgacgaggattctccgcgtgcgtgtaggtggattacgacgaagaagaccgtgaagagcattcatcatgctattccggtctcttgcgctgggggtctgttgttgtttattaccgaccagagagggtcgggactcgtgcggcagtttggatacacgcagatcattcctgctcctcctgtcgattcatgggtcttgtatgatgatataaacgacaggttgatacactactcggatcatatcgttccagcaggtgaggtgtgcgttgtgccaggttag

SEQ ID NO: 44647 - DNA, 315 bp, Glycine max
  Peptide Sequence Number=SeqID_136332
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgcgtcccattcgccattcaggctgcgcaactgttgggaagggcgatcggtgcgggcctcttcgctattacgccagctggcgaaagggggatgtgctgcaaaggcgattaagttgggtaacgccaagggttttcccaagtcacggacgttgtaa

SEQ ID NO: 44648 - DNA, 387 bp, Glycine max
  Peptide Sequence Number=SeqID_136333
atgctggtggacttattgatggtctctgcagaggctgctagggctgagacagggcagtgttgtggaccgtacgcctttcgtgacctcagtcagaccgggaggtacacctggggagtggctactctggtgcatatgtacgaccagctcaacgatgccagccgacagcttggtggttacatcacactactgcagtgctggatttacgagcactttccctcaatcgcggagtccactactgatcaggactacggtgaggattccccgcatgcgtgtagatggattgcgacgaagaagactgtgaagagcatacatacaccggcatacagggagcggctagaccgactccagattctggatgtctgttggatcccatatggggagcactga

SEQ ID NO: 44649 - DNA, 429 bp, Glycine max
  Peptide Sequence Number=SeqID_136334
atgcactactcggatcatatagttccagcaggtgaggtgtgcattgtgtcaggtcagtgtgctagtgactacatggactggttcttccgcatctcgcatcctttcagaacaccaggccacgcatcagatcctctgcctgatggtcatgccccgcagccacgagtcgtccctcaggccccgcagatggatatccctcacgtgccggagccaggagcattgtcgacatctatagacgagcctagacatgcagtggaagtttgtgatgagattgttgagaggttggagcgccatctgagtctaggggtggtcacgccaggttcatcgacacatgaggtgattgaagaatgcctcaggatggccaggaatgtgacacaggaccatctagtatatgttaggtctagacgcaggcggcgcacggatcaggcatag

SEQ ID NO: 44650 - DNA, 174 bp, Glycine max
  Peptide Sequence Number=SeqID_136335
atgacagaaattgtctgcgcggaagatgacataaatctccgcctgtcaacgggcttgtttgccgcgattgacaaaggtatgacagaaattgtctgtgcggaagatgacgtaaatctccgcgtatcaacgggcttgttggccgtgattgacaaagggtgcaaaagacaacgttag

SEQ ID NO: 44651 - DNA, 187 bp, Glycine max
  Peptide Sequence Number=SeqID_136336
atgtttagcccttctggcattgagaaatctctcgaaattagtgagaaaaattgtttccgtaaaaaaaatccaagccgaggtgcttccgtaacgctttcgagacatttccgtaagcaatttcgtggagattcttcaccattcttcatcgttcttcgttcgttcttcgtcgttcttcggtcttcaactg

SEQ ID NO: 44652 - DNA, 340 bp, Glycine max
  Peptide Sequence Number=SeqID_136337
atggaggccatgatgagcatgaaaaagataatggaagccagtgtggttgctgttgccactaccagcgctattgctaagtacgaatggccccatgatgtgaaaattcaaaacgagcacgccttcccgccatatggcttgcctcccaactatacaccacccaatgtggcatacactcccaatgaggatgtcaataactccactcccatactcgttgagagccgacaacctcatcatgtacatgtctctcaacccatgggggagacacatgaaattccccacctcaatctagccgactttgagcctttccttggatatgccattgaagggcaagcagttggtg

SEQ ID NO: 44653 - DNA, 120 bp, Glycine max
  Peptide Sequence Number=SeqID_136338
atgcataaggaagaactacgtaggtctgatttcctctccaaagaaggggtgttgtcctttgagacaaacgtgagaggtgctaataccttcctcaagcataaatacaactcccggacttaa

SEQ ID NO: 44654 - DNA, 817 bp, Glycine max
  Peptide Sequence Number=SeqID_136339
tgcaaccaatgtccatgttgtctacttggaggcccttcgtgacctcagtatgacagagaggtacgcttggggagtggctgctttggttcatatgtacgaccagctgaacgatgcatccatgagccacagtcgacagcttggcggttacatcacactgttcactttccctcggttgtggagtccaccgctgatcaggactacgacgaggcttctccgcgtgcgtgcagggagcgcctggaccgactccggattccgtatgtctgttggatcccgtatgggggagcatcgggaggtccaggacttccacgtcagatcatgctattctggtctcttgcgctgggggcctgttgctgtttattaccgaccggagagggtcgtgtggcagtttggttacacacagaccattcctgctcctcctgtcgattcatgggtctcgtatgatgatatacacgataggtggatgcactatgaggatcatatcgtacctgcaggtgaggtgtgcgttgtgccaggggcgtgttccagtgactacatcgactggttctttcgcatctcccatcctttcatgacaccaggccacgcattagatcctctgcctcatggtcacgccccgcagccccgagtcgtccctcaggccccgcagacggatatccctcgcgtgccggagtcaggagcatcgtcgacatctgcggaggagcccagacatgcagtggaagtttgtgatgacattgctgagaggttgaagcgtcatttgagtctaggggtggtcacgcttggctcatcgacgcatgaggtgatcgaagaaccaggagtgtga

SEQ ID NO: 44655 - DNA, 228 bp, Glycine max
  Peptide Sequence Number=SeqID_136340
atgaagacagcaaacacaattgcggatgatgtagaagcaaagcttcatgatgaatcaagattgattcaaagatgttttgattataacaaagatgatgacaaaggtgatgacaaaaagctcaaaggtcaatcaaagaatgagttcaagatgttcaagatagattcaagaacacttcaagattcaagaggaaagttgaagaacacttcaagactcaagaggaaaagttga

SEQ ID NO: 44656 - DNA, 387 bp, Glycine max
  Peptide Sequence Number=SeqID_136341
atgggtgccaagtacctcgaagcggtcaagcaaaggttgcacgccaccaaacaatggtcctcagacgaaattagggaaccgattgggaaaataacaaaaaaatcgtattttcccctcaccggagactccgtacttgataacggaggacgcatgaacagcgctagacaatcaattcatggggctccgaataagatggtggaggatgcacgaacaacactaggcaatcaattcgcaatcaattcgtggggctccggactcgatggtggaggatgcatgaatggcaatcaattcatggggctccgaacaagatttgatggtggaggatgcacgaacaacgctaggcaatcaattcgtggggctccggacttgatggtggaggatgcatga

SEQ ID NO: 44657 - DNA, 345 bp, Glycine max
  Peptide Sequence Number=SeqID_136342
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtacgccagggttttcccagtcacgacgtgtaa

SEQ ID NO: 44658 - DNA, 409 bp, Glycine max
  Peptide Sequence Number=SeqID_136343
atggctcaaaagaaactttccacaaagaggtctagaagagacgccacgagagaaggatccagtgctgcctcagagtttgatagtcatcgtttccggagtgccgagcaccagcagcacttcgaggccatcaggggatggtcattccacagggagaggcatgtccagctcagggaggatgagtacacggacttccaggaggagatagctcgcaggcatttgacaccactagtgactcccatggcaaagttcgaccctaagatagtcctagagttctaccctaatgcctggcccacagaggagggagttcgggacatacgctcatgggtgaggggtcaatggattcccttcgacacagatgccctcagccagttcctgggtgacttgctgattttggaagaaggccagcagt

SEQ ID NO: 44659 - DNA, 375 bp, Glycine max
  Peptide Sequence Number=SeqID_136344
atggaagacgcacccgtgagccccgcgtcgccctcccgccgaagggtggcctggccaagagcccagccttcttcttctggagggggtggggcctccgtagcccaggagcgtgcttctgaggagccaacaacagcagcaaagggggaggatgagctcacccctcctgagccttcttattttgatgcaggtatacacatggctcaggaggagaatgcttctacaaatcagatcccaaagccatcctcaacacccatagctgatgatgccacaccatcttcaccagcacctgagttagagcagcctatctctcaggattcaccagctgctcaggtgttggaccttaatgagcatgcacaggagcaaccacaagaatag

SEQ ID NO: 44660 - DNA, 438 bp, Glycine max
  Peptide Sequence Number=SeqID_136345
atgggaaatcaacagcgacaagggtatactcaaggaggattttcaggctttcagcagggtccctataatcaacaaggacagtggaggacacaccctgacaaccagttcaacaaagaccagagtgggccttcaaacaggccaatccaacaaggacctaacatatttcaaaggactactaagatggaggagaccttgactcagtttatgaaggtaacaatgtcaaatcataaaagcattgagtcatcactgaagaaccttgaggtccaggtgggacaactggccaagcagatagctgacaagtcatccaacagtttcgtggcaaatacaaatcagaatcccaaggaggaatgcaaagctgtgatgacaaggagtaaaaggtttatggaggctgaggatgaggataatgttgtgcataagaagaaaaatgctgacaaataa

SEQ ID NO: 44661 - DNA, 288 bp, Glycine max
  Peptide Sequence Number=SeqID_136346
atgactacacgtcctcgccttcagagggctgcacgccctcgccttcaaagggctgcacgccctcgccttcagagggctgcacgccctcgccttcagaggactacacgccctcgccttcagagggctacatgtcctcgccttcagaggggtacacgtcctcacctacagagggctgcacgccatcaccttcagaagactacatgtccttgccttaagagggctgcacgccctcgccttcagaggactacatgccctcaccttcagagggatccacgcccttgcctttag

SEQ ID NO: 44662 - DNA, 504 bp, Glycine max
  Peptide Sequence Number=SeqID_136347
atgactctcattcgtgcagagtctttaaaaggctttggtggctggtcagagtggtgtatttgtgaggataccgaactaggcctgcgtttactcgagaacaatatggagttgcgctacattgatgagacttttggccgtggcctgacgccagcaaacttcaaggcgcttaagtcacagcgtaaccgctgggcgtttggcgccatgcagattctcaaacaccatatgccaaaactattgggcaagtcatcgctcaacttcagccagcgctaccactttttaactggctggtttggctggtttggcgaggccttgcaactgctgttcaccattggctctattggctggaccattgccatgctggcattccccaagtatttcagtttgccagtggtggtcatgattgtgcctatcctgtgtttcctggcgatcaaagccatcttgggaccagtgctataccgcaagaccatgcattgtagctggatggatatctttgcgcgtcgctag

SEQ ID NO: 44663 - DNA, 779 bp, Glycine max
  Peptide Sequence Number=SeqID_136348
agttgcttgaggtgtctgctgaggaggctagagccgagacaacacgatcacgcggggcatatgtacggctaggatgggtccgagacatctacgagatgagatgtcaggcacggcgatgggttgtagcagctcatgcttatctactgcacctggcttttcacgagctgggtcagagtggtggttatgcctggggagttgtcgcgctggttcatatgtatgaccagtttgatgaagcttctaggaccacgacacgtcagattggggggtacctgactttattacagtgctggatctatgagcactttccgagtgtgcatcagtgtgtcacagatgatgtgtacgaggagacgtccccacgtgcttcccggtggttgacgatgaaggcgcatatgaagggaattacaggagcgtcgtaccgggcacgttgtgatactttgacggtcacaaatgtgtgttggttgccttacagtgagcatcgaggggttagggagtttaagctgatttcatcgttccagggtcagctgagatggggtcctatggtggtcacagttcaaccggagagggtgctacgacagtttggttacattcagagcatcccttcgtcgcctgttagcgcttcgttgtcatatgatgatatagatgacaggtggatgcattccgcggaccatgtactagctgtgggtgagctttgtgtagtccctgggcaagtatctacggattacatggagcggtttttcccagatatctcacccattcatgataccaacccaggcaggtga

SEQ ID NO: 44664 - DNA, 237 bp, Glycine max
  Peptide Sequence Number=SeqID_136349
aaagatgcacttcctccacaagatgagtgtactcctcctcctcctcctcctcagcgagatgattcagctcttatgactgaagttctttctgagttacgggctcttcgcacttatgttggtgaacgttttgattctttggataatcgctttgcaagaatggatatccgtctcacacagcttgaagaagatgtgggatatattcgtcagagcttcgatcttccatcaccaccttcttag

SEQ ID NO: 44665 - DNA, 494 bp, Glycine max
  Peptide Sequence Number=SeqID_136350
atgctgggaaccggtacacagataatgtcttggggagaaacatcttgcctgagaggaaggtagagctctatcacactgagctagatgattttaagactgaattggagaggcgtaatttccataaacgcctcaccaatttggttgatgggagcatagacttggctttggtgaaggagttctatgcaaacttatacagctctgagggcccttcaccaaagcaatccagagtcagaggccatttagtgaagattgatgctgacagtctcaacacattcctagagacacctgtggtattggcagagggccgagggttcatcttgaacactgagggccatcctgggaagattctcaggaaggatttgactactctaactagggtgtggagtgttctctcatactccaacctggcccccacatcacatacctccgatctgacagtggacaaagctaggctgatctttggcctagtctctcgcatggtcatgaacatatga

SEQ ID NO: 44666 - DNA, 376 bp, Glycine max
  Peptide Sequence Number=SeqID_136351
atggtgaaagttggaacctcttacgtgccgatcaacgtctcatttttcgccaaaagtatttattcggcgcaaagttcatcgggtgatgctgccaactttactgatctaatgtatgatggtgtttatgaggtgctccaatggcttctgtttctatcagctgtccctcctgttcagctactgacgggatggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacccca

SEQ ID NO: 44667 - DNA, 81 bp, Glycine max
  Peptide Sequence Number=SeqID_136352
atggttcatgatatcttttggtgtcaccctgatgcagtgaagttagtcaacacatggttgaatatgctcactcgtctttaa

SEQ ID NO: 44668 - DNA, 728 bp, Glycine max
  Peptide Sequence Number=SeqID_136353
gcgaatgggccctgttcatagacattctcgcactattgatcttcggaggagtcctctttccgaatgtggatgggttggctaccctatgagaggggcaccactaaaggaagagctcgcacctattattgcacgaggtttcaataagaccaacgtggaggcacttcagaaggtccgcaaggcgtgggagactgtgcaaaagaaggacaaagaattcagaggcagtaacaacgggcccatcgacggctaccgtaagtggaccgctaaaagggaagaagttcaggcaccggaggaagacgaagaggagaatgccgaactgagggatgtaaatatagctaccaccaaggccttggaacaagagaccaagagggctcgtagggaagagcacggccggaacaagttccgaggggctctgtggggtagtaacagggagcgtaagctcctgagggaggaaagagaccaatcgcgggtagacagtttgatcttgaaggatgagttgaaggcttgctcgaggtccaaaagaatggcggacgagtatgcccaagtgtacgcggaaaaggaggctagaggaagggtgatcgactcattacaccaagaggcaacaatgtggatggaccgatttgctcttaccttgaatgggagtcaagaacgtccccgattactagccaaggctaaagtgatggcagacacctactccgcccccgaggagatccacggacttctcagctatt

SEQ ID NO: 44669 - DNA, 909 bp, Glycine max
  Peptide Sequence Number=SeqID_136354
atgaaaagagaaaaacatgactcctatagtagtcataactcttgcaagagcctaagtgaagaacttcgtgactattatgaaggaagaaataagccacatcttaaacctcactcccataggagagaaaatgaaagaaagcctcaagaggctaacattaacctcccatacttccatgggaaggacaataaagaccaaggtcaaggcatcttaggggtgacttcttctaagcccaaagatgataaggggaagacaatagaaaagcaaccccttaaggctagtatgcaggagaagactagctccatgaagtgctttaaatgtattggaagaggacacattacttctcaatgccccaccaagaaaaccatgattatgaggggccaagacatttatagtagccaagatgaggctactacttcaccttcctctagtgaaagtgaagaagcaaaagaggaagaatctagtgaagaaatctacccccaagaagaaggacaacctttaatggttaaggaggaatgtaaggagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtgatgtgatgaatgctttgggtggtgcaacactcttttgtaaaatcactcgtgcacccaacatcttcatgatttgtgtacatagggactcattaggtaggaataatcaacatgaaaatacagaaaaaggtgttgaggaaaaaagcccagagtttcaagaacctcgggatttgaggtcaaatccttttcaagggggagggaatgatgcaatcctaccccgcaagggcattggatag

SEQ ID NO: 44670 - DNA, 423 bp, Glycine max
  Peptide Sequence Number=SeqID_136355
atgggctcaaaaatctaccctaaggttcatgagaaccctaaggccttctttatcaactctagcccaatcctcttggagcctcttgctcatagctctggtaactggtcctttcctagggaggattgcatcaccataatgtcgatctccccctgcggaaggatcacgcccacaagacacccagcagacccggagaagtccaacagggtcctggggtttccagctctaatcacaggcctctgtcagttctatggagtgcccgtcgctcccaacaaggtcatcaggccccctactaatcgagctttcatcaagaagtactgcgtcccccaggcaggcgcatggcgagacaccataacagcctggggatggccggcaacgggcaataaacgcaccgccactagctctagagcccctcagccccaatag

SEQ ID NO: 44671 - DNA, 195 bp, Glycine max
  Peptide Sequence Number=SeqID_136356
atgggcaaatattatacgcaaggcgacaagttgctgatgccgctggcgattcagtggctgctgccagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 44672 - DNA, 264 bp, Glycine max
  Peptide Sequence Number=SeqID_136357
atgcccgtttgcgggcgagcgaggcgagggtcacgggtgcgctttccaagggaggaaagatgcgtggagtcgccaccaacatttatttgtggaaaacgtcagaaaaaccgaaggaaaccggtcaaaaagaaaattccaagtttggaagttgtatttgcgtttgaggaaggtattagcacctctcacgtcgacaaaagcggggctcttgctcctacgtaccctccatcgaagaggaaatcagacctacgtagttcttctttaagg

SEQ ID NO: 44673 - DNA, 519 bp, Glycine max
  Peptide Sequence Number=SeqID_136358
atgaagcacttcactgacaccctcatcagtgccaacataggaacaaaagctggtaccgggccccccctcgaggtcgacggtatcgataagcttgatacagcccgctggaagagagcgtggccgggctggtcagcgccaaactgcgtaactccggccagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 44674 - DNA, 234 bp, Glycine max
  Peptide Sequence Number=SeqID_136359
gcccgtgaccaacaagtcatcacgcgtttggctcaagatgttaaagaagcactactaggaggtaacctagaattggctacgaagaagctccccgcgaagcaatccaggaaaggcaccatcgaagaggattccaatgtggccccacaagccgacacaggctttgacaaataccagattccagagcgtggatcatcaatagcgtttcgaggccatcaaaggatggtcattccttag

SEQ ID NO: 44675 - DNA, 455 bp, Glycine max
  Peptide Sequence Number=SeqID_136360
tggggattgtggcacgtgataaggtggacatcacctacgagaactggacggaggtccctactgctcagaaggacctgatttgggaggatattcaggcggaatttgatatcccagaggcttctgacaccgatcaggacggtgtcgaggacactgtttgtgacaaatacgacatcagcaaggaaaagtgggcccagttttgccagactcatagagacccttcttgggaggatgtgcgcatcaaggcacaggccatcaagaagcagaatattgccccccacaagctcctggctgagaagaccaagaagaagatgcaggaagctgcacagtccggaaacgttgatggcgtcatcgaccctccatccccagtcagacgccacgtgaagtggaagatggcccgcacgaagaagacaggggagatgacgactaaggccgcaaaggaaatcgctgagaagatt

SEQ ID NO: 44676 - DNA, 657 bp, Glycine max
  Peptide Sequence Number=SeqID_136361
atgaccatgattacgccaagctcgaaattaaccctcactaaagggaacaaaagctggctcgggcaggtcggcttgagtttcgtcggtttgcagccagtcgggttgggcgttgtcggcaggcgcgggggcttgctgcgggcgcagggattcgggttgggcgagttcgtgggcgccgccttctacaggcgcggcgttgggggatttggcgttgttgaggcggtgcgtaatcatgccgccgaagacgatgatgttgagtgccacgagggcggcgaaaagccattatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 44677 - DNA, 219 bp, Glycine max
  Peptide Sequence Number=SeqID_136362
atggctggtacattcttccttttgaaacaacaaattagtttagagattatgagcgtcattattttggggacgccacaccggggaccattgttgatggcatgcaacctttgcttgaccgcttcgaggtacttggcacccattgttgcacaatacgtgaagttccgtaacgtatcggaagtcaaaagagagcattgtggcacgatccgtgaagttccgtaa

SEQ ID NO: 44678 - DNA, 210 bp, Glycine max
  Peptide Sequence Number=SeqID_136363
atgaagatgaaagcaaacaaaacaagaaatgaattgaaattctcggattcgaacacttaccggttgaaaaatgaagaacggacgaagaatgatgaagaacgcaggaaaatcttcacagatttactcacggaaatgtctcggaagcattacggaagcacttcgactcgattcttcttcacgaaaacctgtttttttacccaaaatagctga

SEQ ID NO: 44679 - DNA, 384 bp, Glycine max
  misc_feature (373)..(373): n is a, c, g, or t
  Peptide Sequence Number=SeqID_136364
atgtgtcattgggcaaacagacagcaatcggcgcgcccgtcctacaagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccancccgtcagtag

SEQ ID NO: 44680 - DNA, 261 bp, Glycine max
  Peptide Sequence Number=SeqID_136365
atgacgaaagacaacagttggtacctcaaagccttacactggggcaatgaaagatttcctacatctcgtgtccaatcttgttggatgaccggccctctcgatgggccgacctcttgttttctcaataaaggtggacccttgggtactagtacctatcttcttcagagggctacatgtcctcaccatcagaggactacacgtcctcaccttcagagagccgcaagccctcgccttcagaggactacacgtattcaactttag

SEQ ID NO: 44681 - DNA, 900 bp, Glycine max
  Peptide Sequence Number=SeqID_136366
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggcaatcatccaaaagcaagggaataggagttatcactatgggctgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttacccggtgtcattccgctgttatggccgcgtttgtctcattccacgcctgacactcagttccgg

SEQ ID NO: 44682 - DNA, 135 bp, Glycine max
  Peptide Sequence Number=SeqID_136367
atgtgtcaggagaaattggtacaagaagccgtggatacacttcttgataatggaatccgcggacaaccgatgagggacggtcataataaggtccatcactttcattacatagatgtggattgccccgcgaaatag

SEQ ID NO: 44683 - DNA, 387 bp, Glycine max
  Peptide Sequence Number=SeqID_136368
atgactagaagcagattggccaccatgaatgaacgtgagaaaggaataggtgcagagaaacaacagctgaagaaggagacaacagtaaatttgactgaacaagaaataagtgagaaggaagaaaaagaaaaagaacaagaaaaagaaaaagaaaaaatgagaaaaatgaaaaagaaaaagagagaaaagaagaaaagcaagagtgagtatgctagagagaaaaagagagaagcatctccagctgaagggaaagaagtaccatatcctttggtaccttctaggaagaataaggagaagacatctagcttgatttctggatattttcaagaagctaaaaattaccatgccctttggagaagctctacagcagatgccgctctatgctaa

SEQ ID NO: 44684 - DNA, 408 bp, Glycine max
  Peptide Sequence Number=SeqID_136369
atgaaggccgacacagaggccttgaaagagcaaatggccacaatgagcataaaggagataatggaggtcaatgcggctgcaatagccgctactagcaccattgctgaggtggacctgacccccccatatggcctcaaccaaataaatcatccaacctcaaatatggttggtctggaaggcaaagagttgggaggtacgggcggccctcatttagtgcaaaaaacaagcatgccttcccaccatatggcttgcctcccaactatacgccacccaatgtggcgtacactcctaatgagaatgtcaataactccactcctatactcattgagagccaacaacctcaatctgatcatgcacatgtctcttgacccatgggggagacacatgaaatgccccaccacaatctag

SEQ ID NO: 44685 - DNA, 351 bp, Glycine max
  Peptide Sequence Number=SeqID_136370
ggacaccaggatttatttattctgcgaagtgatcttccgtcacagtggcttctgtttctatcacctgtccctcctgttcagctactgacggggtggtgcgtaacggcaaaagcaccgccggacatcagcgctggcaagtgtagcgggcgcgtcccattagccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatacaagatcatatcctttccagggacatggaaggaggccattatccttag

SEQ ID NO: 44686 - DNA, 306 bp, Glycine max
  Peptide Sequence Number=SeqID_136371
atgcagtatttggataatggcctccttccatgtccctggaaaggatatgatcttgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggctaa

SEQ ID NO: 44687 - DNA, 186 bp, Glycine max
  Peptide Sequence Number=SeqID_136372
atgcttgcagaactgccaacgaagagagctgttgaagaagaacccgtcgtcgagaagaaggcatcgttgaagatggcttgcaaaaccatcaacgaggaagaagaaccactgtggagaagaaaagaaaatgggtttgagcttcgtaagcatggagaagaagagaagcaaatgggttttgtgaaataa

SEQ ID NO: 44688 - DNA, 447 bp, Glycine max
  Peptide Sequence Number=SeqID_136373
atggtgtgtgagttggtaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttcccactggcggctccctcgtgcgctctccttgttcctgcctttcggtttaccg

SEQ ID NO: 44689 - DNA, 480 bp, Glycine max
  Peptide Sequence Number=SeqID_136374
tccaacagggattcgaacaattcaacaagctctataatagcaaggaatcacgtattccggcagacttaaagtacttttccaattttgccttgtcatggatcttttcatggcaatacagatacggaaaaactgaaaacaacaagcaatatccaccgttacagagacacacctttgtaaaatggtggtcacaattcgatacttcaaaggctgctccagatcaagtcaagaactggttccagagcaatcctgagttccttaaacctgctgatccggagacatctttgtttctaaatcagaagtcgcaactggcagcattcttagaaagctcaaaatctaaagagagtcttgctcagaatctcaaagaagttctccaactacttcaacaggaagtggaagaagaaccttccaagaaggaagctgaatcatccgagactaatgatgaccaagaagatgatccattctaccagaatgaagatgact

SEQ ID NO: 44690 - DNA, 887 bp, Glycine max
  Peptide Sequence Number=SeqID_136375
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtcaagtcaaacttactgaatatggcgagaaatttttgcaatttgctaaaacagaatggcaaaactggcaacaatttaaacaacagctcaaggatgaatcaaatgaactctgcgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44691 - DNA, 489 bp, Glycine max
  Peptide Sequence Number=SeqID_136376
atgccacccaccaggcaccctctagacccggataagtctaacagggccctggggtttccggcattgatcacgggcctctgtcagtcattcggggttcccgtcactcctagtaaggtgatccgaccaccgatcacccgagccttcattgagaagtattgcacgcctaggcaggctaatcccgctggttcattaggcatggagcgttatctacaacacttggttcgccaacaggcggccaaccaccggtggcaggtgcagatacatgagtgtctctaccagctcagccttagtcagcaggggcagggtttcgctcattttgcatgccctactccagagcagtttagggatgaggtcgcatggcccggagattggcccgaggcccaggcaggggaagcgcctacaggagctcccgacgatgcagaggaggcccgtatggatgaggagatgacggacttgctcggtttcttgggaggaagcggagccacttga

SEQ ID NO: 44692 - DNA, 295 bp, Glycine max
  Peptide Sequence Number=SeqID_136377
gaacgaggataagggctacgtgggagtacgtgagctcagttggaggtgggcaataggggatggtggtggtacctggagatatgtcgcgggggtcaggagaccttggggacgtcaggcgagctcctggcagtcaaccaataaaagaacaaagaccacaaagcagggaggcttgtgtggtggctggctagcaatgagtcttgatgagatttgggatatggcctctggtaatcgattaccaaggcttgaaaacgagatcaggaagctaggagggcttctggtaatcgattaccaaggg

SEQ ID NO: 44693 - DNA, 449 bp, Glycine max
  Peptide Sequence Number=SeqID_136378
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaaagataccaggcgtttcccccctggcggctccctcgtgcgctctcctgttcctgcctttcggtttaccggtgtcattccgctgttatggccgcgtttgtctcattccacgcctgacactcagttccgg

SEQ ID NO: 44694 - DNA, 376 bp, Glycine max
  Peptide Sequence Number=SeqID_136379
atggcagaatcgttgaagaagagaaagggaacgtcctccaccaccgttgctgctagccatcgccgccacggaccttctgaagcacccacaacaccaattcatccttccttatcatatccaagatcatctactctattttctttagatgatcaacgtctacggtacaactctcaattttcttctaggatcatcttagaccctaagtacctagacacaaatttctttaatgatgagacatttgactattatcaagtgtttcaaaactctggattggttgattttatgtctttaaaattgccttactaccctgaacttgttaaattcttttatagcaatttaaaaattcaggatgatattatttcctctgaggtgcatg

SEQ ID NO: 44695 - DNA, 255 bp, Glycine max
  Peptide Sequence Number=SeqID_136380
atgacccacaccaagaaaactgggcagatgacgtctgaggtagcaaaggaaattgctgagaagattatgaatggcgaatggagaaggaagagagagaggagacgccacttcaaagagaagatgagtctagaagaagctcaccaccataggaggccatggataagagcttggaggaagaaggagatgagtgaagggataggaagagaagagcacaaaattttgtgctctaaaagagctatgaaatctgaagtttaa

SEQ ID NO: 44696 - DNA, 450 bp, Glycine max
  Peptide Sequence Number=SeqID_136381
atgggtaaagtagaggaggtgcaagagcagatgaaggccgacatggaggccatgaaagaacaaatggccacaatgatggaggccacaatgagcatgaagaagataatggaagccaatgcggttgcagttgccactaccagcgttgttgctaaggtgaacccaatgcccccatctggcccacatggtaaaaaccctcatgctatggcgaaaatgggaaagttggatcatctagaggaaaggctcagggtcgttgaaggaggtagggattatgcctttactgaacctagaagagttgttcctagtacccaaatatggtcattcccaagttcaaggtgccggactctgacaagtacaaggggaatacttgctcccaagaaccatctaaagatgtattgtcggaagatgggggcatacgcaaaagatgagaagctgccgatacatttttcttaa

SEQ ID NO: 44697 - DNA, 839 bp, Glycine max
  Peptide Sequence Number=SeqID_136382
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaattcgatcagttcgcgtgtgcctgctatcaaggagcgcattacgcagtggttcggtcgctcgctttcgttcacgcttaaccaggacgaggctattgtgcgtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44698 - DNA, 96 bp, Glycine max
  Peptide Sequence Number=SeqID_136383
atgccatatgtcttccagaaatcctcatacgcttgttcgactcgatcaagccaaggcagtgatgcttggtctggccggcgtcccaccaaagcgtaa

SEQ ID NO: 44699 - DNA, 773 bp, Glycine max
  Peptide Sequence Number=SeqID_136384
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagctgtgaaggcaagcatgccaaggccgattgttgatagtgcgagtgtcattatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44700 - DNA, 171 bp, Glycine max
  Peptide Sequence Number=SeqID_136385
atgtgggtgcaagccattggtttgtttgctcaagcgacctgtgctcctgagtttggaattccaagacctttcaataagagattactcgtcttgcacattgagagaagtgagttatcaagaataggatcttggacaaatggcctcagttaccttaagaaaaaggggggttga

SEQ ID NO: 44701 - DNA, 411 bp, Glycine max
  Peptide Sequence Number=SeqID_136386
gttggtcgaccgcgattgacgacgggcgcaggagacgacggtatctccgcccgtcagcgtgactcaaaagtctgtatgacagatcttgtaagcgcggaagatgacgcttttcgtcttacagatagcaaaaaggtttatacagataaccactcgggtatctccgcccgtcagcgtgactcaaaagtcagtatgacagaacttgtgaaagtggccaacaaaagcgaggctcttgctcctacgtatcctccaatgaggaactcagacctacgtagtgcggataaccgtatggtgtctccgcgggctaccagattcttgggtcatggtaacaaaagcggtgtggtcgacaaaagcgaagctcttgctcctacgtatcctcaaatgaggaactcagacctacgtagttctggataa

SEQ ID NO: 44702 - DNA, 474 bp, Glycine max
  Peptide Sequence Number=SeqID_136387
atgcaatcacagggacttgcactacctcttgagcctaaggttggtcctttagttgctcatgttagcacaaagaagagtcatgttgaccccttagggaatgacccagacacgggtgactcagagaaatacaggttgtacatcaaagaaaatcctccccacctggtttccctaggaagactttatgaggggtcgacaatcgttcacaacatgcctttgcgccataatcaaatcaagtttagtgttgaggaagtgagagatgaagattctcccattcctgtacccacccaagaggagaaacctgtagataggctgaatcatgatgtcgatgatcccctatatctgatggcattgaccatcccacatctttttcttaagtcattgcagattatgtgggatgctaccacttatgatcagacaagtatacgagctgggaatgttgatgtgtatggattcctcaagccacggtccatataa

SEQ ID NO: 44703 - DNA, 447 bp, Glycine max
  Peptide Sequence Number=SeqID_136388
gttacagatgcagatgctccagttcttgtacccactaatgaggtttccttattggggcaaacaattcacaccttccttacttggccgacacatctggtcaagtctttatcacatcaggcaactgtgtcttcagcaaaaccacctcaaaagccccatccggaggttgatgatccactttatctgatgacattgaccatcccagagcttttcttaaggccttaccaggttacatgggatgccaccatgttcagggtctttaatccagacttcccgctctacataaagcacgaagacctgtccgaaattgcgcacgatggtcaatgtctcagcatatcagtgttacagttgtggattatgcatctaactgaaacaagtatgcgagcggggaattctaatatctatggattcctcgagccacagtccattcagaggtctgggcaatcgtag

SEQ ID NO: 44704 - DNA, 144 bp, Glycine max
  Peptide Sequence Number=SeqID_136389
atgactaaagcacgtcaaaagggggtacggaaaggaaaagagggagaagcttgccacccagctcgcccaggcgagctcagctggaggaacatcctggaaggcccaagtgggcctggttgccatttgcacccccctgtttactaa

SEQ ID NO: 44705 - DNA, 476 bp, Glycine max
  Peptide Sequence Number=SeqID_136390
tcgattgggaccaacatttggcggagatagggggcagcgcaatcaattggtttcctcgttggaaggaaggcaaggaaggagttcttttctcgtgtggggactaccctaatgttccattgatagggactagggggtgtattaattataatcccgctcttgccataggacagctagggtaccccatgaggggagcgccaacggaagggagtctctcacctttccttgtgaaaaatttaggcgcgcaaggtctcaaggttgtacaaagaatgcacaaggcgtggaagagtccgttgaggaaagacaaggagcttaggggcatccgtaatggcgtcaaatcggaggttatcaggagtatccctcgcccatactatgaccagtccgttgaggtgcaccgagttatggaggacctccaaacgcggccgactattgcaagagcccttgacaagaaacaaattagggccctcaaggaggaatag

SEQ ID NO: 44706 - DNA, 246 bp, Glycine max
  Peptide Sequence Number=SeqID_136391
atggttccagcaggtgaggtgtgcattgtgctaggtcagtgtgctagcgactacatggattggttcttccacatctcgcatactttcatgacatcaggccacgcatcagatcctctgctagatgttcatgctctgcagccccaagtcgtccctcaggccctacagacagatatctctcacgtgccagagccaggagcaccgtcgacatctgcgaggcccgctgtggaggagcctagacatgcagtg

SEQ ID NO: 44707 - DNA, 78 bp, Glycine max
  Peptide Sequence Number=SeqID_136392
atggcgcctcaacagaaatgcatgagaacaaatggcacagagcgtgtttgctctatgcccctatttgggaacctatag

SEQ ID NO: 44708 - DNA, 219 bp, Glycine max
  Peptide Sequence Number=SeqID_136393
atgtgctgcaaggcgataaagttgggtaacgccagggttttcccagtctacgacgttgtgaaacgacggccagtgaattgtaatacgactcactatagggcgaattggagctccacctcggtggcggccgctctagaactagtggatcccccgggctgcaggaattcggatcagccaaatacatttctccacataggctactactctactgatctctaa

SEQ ID NO: 44709 - DNA, 666 bp, Glycine max
  Peptide Sequence Number=SeqID_136394
ggagttcttttctcatgtggggactacccaaacattccgttgatagggacgaggggttgtattaactataatcttgcacttgtcataagacagctagggtaccccatgaggggagcaccaacggaagagagcctctcgcctttccttatgagagatttcggcgcgcaaagtctcaaggttgtacaaagagtccacaagggcgtggaaaagcccttgaaaattatcaacgaggagaacttcgaagctccggaagaggatgaagaagtccaagctctaaaattagagctaggaaaggtgagactcaccaaagaaaaattcaagtcagccgctacaaacatccggaaagagtgtgccgagttacgagaggaaaacgcggctactgcaagagcccttgaacaagaaaccaagagggcccacaaggaagagcatggccgagataaattccgaggagctttgtggggtagcaacaatgagctcaagctccgaagagaggaaagagaccagtcacgggacttcgcacaagcgtacgccgagaaggaagcaagagggagggtgattgatgcattgcatcaagaagcggccatgtggatggataggttcgccttgaccttaaatggaagtcaagacctcccgcgactactagccaaagcaaaggccatcgttgaa

SEQ ID NO: 44710 - DNA, 402 bp, Glycine max
  Peptide Sequence Number=SeqID_136395
atgggtgaagtagaggagatacaagagaagatgaaggccgacatggaggccattaaagagaaaatggccacaatgatggaagccatgatgagcgtgaagaagataatggaagccaatgcggttgcaattgccgctaccagcgttgttgctaaggcacatatctctcaaaccataggggagacacatgaaattccccaccacaatctagctgacttcgagccttggctcggatatgccactgaagggcaagcagttggtggtataccctttgaaaaccctttggaaggccctcagtatcacccacaactgcacctcttgcattccacagcggttaaaaaccctcatgactatggcaggaatgggaaagttggatcatctagaggaaaggctcagggccattga

SEQ ID NO: 44711 - DNA, 177 bp, Glycine max
  Peptide Sequence Number=SeqID_136396
atggctaccaaaggttggagctttgttggagcttcaatggtggaggaagaagaagagaatggcaactccctcgcgtttctctgcacccgtcggggccaattttcgaaagtaggcaatatatatatcaaaacgcttagaatgaaaccccgagcgtggttcagaggttggttttgttaa

SEQ ID NO: 44712 - DNA, 354 bp, Glycine max
  Peptide Sequence Number=SeqID_136397
atggagaaaggacaagggcggtcttgcttggcgcaaaggctgctgaacttcgattcgcccggccagcaggcgggcggcgtgcttatcttgtgtgacaacactacagagcgagtggctcttctaggcgggcagctgtgtgacaacactacagagaaagcggcgctttcgtttaacatgctatggtctcaacgcccttacgagatagtgatgagtttcacgcgctctaagcccggcccgcgcgcggttaggaagattggccgcaatctgagcggtaccacccaccctaccctaccacctataggcggccgtccgttctacagccgcccgaaaaggaactgcagtgatcttgaatag

SEQ ID NO: 44713 - DNA, 932 bp, Glycine max
  Peptide Sequence Number=SeqID_136398
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcctagttttgacttctccaaccttgatgcctttaatgtctctaacaacaatttacaaggtcaagttcctgatgtcaaaggaaaattccatgaagacagcttttctgggaatcctaacttatgtggaaaaccgctttcacaagaatgtccaccacctgaaaagaaggaccaaaactcattccctaatgatttgtccatttattcagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44714 - DNA, 529 bp, Glycine max
  Peptide Sequence Number=SeqID_136399
tgaaagtgaagaagcaaaaggggaagaatctagtgaagaaatctacccccaagaagatggacaaccattagtggttaaagagaagtgtaaagagataagtgtctcctccaagaggttagctaagaaggaaactgattttacaataaagacaaacattaaagaaactttccctcttaaacaacctccacattttctcttttgtaaaaagacacttgctagcattgccacacctctcgggcttgagtttattcctcaagtaaagaagttgttggatgagggtttggttcgcaagagattaaatccttgtgctttgttggtgcccaaaataagtattattaggcaccaaatccctaaaataggtggtgtgatgaatgctttgggtggtgcaacactcttttgtaaaatcactcgtgcacccaacatcttcatgatttgtgtacatagggactcattaggggttcccatgaaccctaagagaataaaggtgttgaggaaaaaagcccagagtttcaagaacctcgggatttga

SEQ ID NO: 44715 - DNA, 459 bp, Glycine max
  Peptide Sequence Number=SeqID_136400
atggacaatgaagagggcgtgcaggaacagatgaaggccgatctatcggccttaaaagaccaaatggcttccatctcggaggtcatgttaaaactccagaaaaccatagaggataaagctaccgcaaccgcctccagtacagttagggaagcggagctggtgctgcaacccgccttgaatccgggcctagacagaaacacggtcgtgttcggtcgaaggtatagtccgcaagcttatccttatggcctgcctccggacttcaccccccgtgccaccccggaagatttaagccaaggccctacttttgaggggcaactcccaccttatgaagactatcccgggcaagatgatggggaaggagatacccatcttggccccctgctccacctcaaagatccatctccgcatgaactaccccagccgaacatagtccgccatatcccggcctcacccacaccc

SEQ ID NO: 44716 - DNA, 161 bp, Glycine max
  Peptide Sequence Number=SeqID_136401
atggcagagccattaaagaagagaaagggatcatcctccaccgctgatgctactgcccatcgctgccacggaccatctgaagcatccacagcacctactcatccatctttatcatctccaagatcatcaccattattttcttccgatgatcagcgtctacg

SEQ ID NO: 44717 - DNA, 306 bp, Glycine max
  Peptide Sequence Number=SeqID_136402
atgggaaaatccctcttccatattatgaacattaaaatcaataggaaaaataagttcaccaacccaaaccagcacatcctctatgaaacctatggggtgcacagctcctttagaaacttggcatatcttggaatctgcttgatggcatctagcagaggtatgttcacctctactcatctgaaggtctccaagatctccttttctgcttcttccatcttttcgtttgcaattgctctaagtgggaatggaagagggataggagactgtggtaagtcagaattactagaggaaggtccacctgcatga

SEQ ID NO: 44718 - DNA, 630 bp, Glycine max
  Peptide Sequence Number=SeqID_136403
atgggatcaagtcaaaagccttcgcttaaaaagaggttctatcaagtcaaaatcaagagcttagaggtcaccagtttacgaaagttggggcaattaatgggtcaacttcaagccttccgcaaagcctatggtaagatttgggacctagctagggtagaagtctccatggaaccgattgcatccctttcccagtattatgaccagcccctaaggtgcttcacatttgaggacttccagctagtgccgaatgtgaaagagtttgaagaaatcctgggatgcccaatgggaggaaggaagccatatcttttctctaggttctatccttccacgacaagagttgccaaggtagtgaaaatctcagcacaagagttggaccggaaggaaggaagaatcaggattctatcttcatgcgaaggatgtccaaatgttctcttgatgggaacaaggggttgtattaattataatcccgtcctcaccataagacagcttggctaccccatgagagaagtaccatcagacgaaagcatcacgcctttcatcgcatggggtttcagtgaccacgaacgcgagggtactccaaggagttcgcaaggcatgggatgcggcgtgaagaaaggacagagagcttag

SEQ ID NO: 44719 - DNA, 444 bp, Glycine max
  Peptide Sequence Number=SeqID_136404
atggccttcattattggagaatcatttggtggtagccatacccgggagggtcttctagccaccctaccccaagtgcacctaatcagtgccggctggctatcgtttcaagaggaaggcccaaatgttaaaactaacccgctagctagtcatggaaaggctagcgtaaacgccatccaagaggatgggccatcgcaggcaaggagattaggagaggtggctacttccagacgttttatctaccaatcgctgcaagcggcatgtatggtctcccatggcggaggcgaaagggacgaatgtttgtttcacctcggggagtcgcacgacatggaaacctgtcccgcggtagaagtattgcttcagcgtttcatggattgtgggcagcttgaagtgtccataggagggagggaagaaccacaaatttgcatgcagtcggaagagaagaag

SEQ ID NO: 44720 - DNA, 706 bp, Glycine max
  Peptide Sequence Number=SeqID_136405
atggatggacctgttgagttccgcggccttctgggtcgcggtgttgcggctggcgacgccgctgatcctgggcacgctgggcgtgctgctgtgcgagcgcgccggcgtgctgaacctgggcatcgaaggcatcatggccgccggcgccttcaccggctggctggtggtgtacctgggcgcgccgctgtacgtgggcgtgctggcagccgcgctggcgggcgccgtgttcggcctgctgcacgcggtgctgacggtgccgctgggcctgtcgcagcacgtctcggggctgggcgtgacgctgctggccaccagcctgagctacttcgcctaccgcgtcaccttccccagcgtgaacacgccgccgacgatcacgccgttcgccgagatgaagttcctggacggcattccgctgatcggcccggtgctggccgggcagacgccgatgacgctgctggcgctggccgcggtgccgatcctggcgtgggtgctgaaccgcaccccggtcggcctggcgatccgcatggtgggcgagaaccccgccgccgccgagggccagggcctgtcggtgaccaggctgcgcatgggcgccatcgtcgccggctcggcgctgatgggcgtggccggcagcttcctcacgctggcggccttcaacgccttcttcttcaacatggtcaacggccgcggctgggtctgcgtggcgctggtg

SEQ ID NO: 44721 - DNA, 222 bp, Glycine max
  Peptide Sequence Number=SeqID_136406
atgttgacatctccggaaagggcgcagatgaccatattggcctctgctcatcaatcacacttggggtcactggatgacgaggtgcggataactgtaaggggtctccgcggattaccagctcttgggtcatggcaacaaaaaggtggtgtggtcgataaaagcgaggctcttgctcatacgtatcctccaatgaggaactcagacctacgtagttttggataa

SEQ ID NO: 44722 - DNA, 554 bp, Glycine max
  Peptide Sequence Number=SeqID_136407
atggcttctatcggattctcttgctatccggtcaactctaagtcttccgtaatctgtgcggaaagcttgcacttctccttggagaggttctcaaccgccctattccttgatcgctggtgtatgagagcttggaccttcttcggtaaacctcttccgccatggtcgggatggacccacatgaatgccattacaggaatgcctctacagttcttgatctttcctaagaatgcgggtgttcccatgccttatggtctcctttgtatagacattgggaattttgtgcccaaatccctcacaaggaaaggagacatgctttcttccgtcggtgctcccctcatggggcaaccaactgattgttctacctcctatcccggccaaaagctggtcccaatctattcccctcttttcagtacacgagcgatggctcaggagcggacatggatgtcttgtgtcttgttggaacaagtgcgaaaccaaccaaacacagaggacgggcaagcaacagatgatccgcaaggaaagcgtcgattgctgctagtccaccaaaccatcac

SEQ ID NO: 44723 - DNA, 714 bp, Glycine max
  misc_feature (534)..(534): n is a, c, g, or t
  Peptide Sequence Number=SeqID_136408
atggcgagccaagagaagtggggtccatttgcggatatactagctttgttgatttttggggttgtcctctttccgaacgtggacggtttggtggacttagccgcgattgatgctttcctcgcatatcaccatagcaaggagagtccagtggtggctatctttgatcggagcgcaatcaattggttttctagatggaaggaaggcaaggagggagtccttttctcatgtggggactaccctaacgttccgttgttagggacaaagggttgcattaactataatcccgcacttgccataagacagttagggtaccccatgaggggagcgccaacagaggagagtctctcgcctctccttgtgagggatctaggcgcgcaaagtctcaaggttatacaaagagtccacaaggcgtggagaagtctaatgaggaaagacaaggagcttaggggcatccgtaatggcgtcatcggtggttatcatggatggctaagagttcacacacgagggttagattggctctccaagttgaaagtnatcgatgagcagaacttcgaagctccggaggaagataaagaagagaagttcaaatcagccgctacacacatccggaaagagttcaccgagttacaagaggaaaacgcggccactgcaagagcccttgaacaagaaaccaaaagggcccgcaaggaggaacatggccgagagaaattctga

SEQ ID NO: 44724 - DNA, 282 bp, Glycine max
  Peptide Sequence Number=SeqID_136409
atgtgggcatgggaacgatgtggaactctggctccaagaaggactcatcccataatagaaaaaaaatcacttggacacaggtggctgcgatgggaaaatcaacatattggtaatgatgatttgatactttttcgttacaaactagatattatgaaacgacatgagtttttctgggagccttactcagcaaatgttatgtcagtgttgcctccaatttgtttagttgaaagtgttgcatggtgcgcggtgatgccactaatttgtttccaagtcattgagtga

SEQ ID NO: 44725 - DNA, 731 bp, Glycine max
  Peptide Sequence Number=SeqID_136410
atggtgaaagttggaacctcttacgtgccgatcaacgtctcatgttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44726 - DNA, 893 bp, Glycine max
  Peptide Sequence Number=SeqID_136411
atggtgaaagttggaacctcttacgtgccgatcaacgtctcatgttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgagtctcggtgcgcggggttagccaaacaggccgcacgtgctacagcagagtgttctgctggccagcgcaagaacactttccgcaagcccgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 44727 - DNA, 48 bp, Glycine max
  Peptide Sequence Number=SeqID_136412
atggagaattgcactaagcaatcactacgcatagctcccaactcaaag

SEQ ID NO: 44728 - DNA, 267 bp, Glycine max
  Peptide Sequence Number=SeqID_136413
atgacaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttatggttattcgcaccctttcttttgctatctgcaatttgtgaaattctgggaacaacaagtcatttgcatgtggagattttatggtcacccgcgactctcgtcaaattga

SEQ ID NO: 44729 - DNA, 984 bp, Glycine max
  Peptide Sequence Number=SeqID_136414
atggttctgaaagaggagttgattgcttgttcaaggtccaaaagaagcttgtctcagcgtttatgcgagacagagaccaacatgttagctatcatcgccaagtacgaagaagagttaggtctagccacggcccacgagcatagaatcgcggatgagtacgctcaagtatatgcggaaaaagaggctagaggaagggtgatcgactctttacaccaagaggcaaccatgtggatggatcggtttgctcttaccttgaacgggagtcaagaacttccccgattgttagttaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagagcgcggccactgccgccgctgtcagttcggctgccgaagcagacccgactctcttggcaactacgcaccatcctccctcaaacatagtaggacggggaagggacacacgggggcacgatggcagccctcacctgggatacaatcgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgccccaacccaacatcgcagcatcgccaatagttttgtctatggaagggccgcccccggcaactgaagaaaggaggaagctcgatctccttgaggaaagattgagggct

SEQ ID NO: 44730 - DNA, 135 bp, Glycine max
  Peptide Sequence Number=SeqID_136415
atggcctccatcattgtggccatttgctctttcatggcctccatgtcggccttcctctactcttgcacctcctctacttcactcattactctagctctagcacgggttcgaggagaacgcaaggatcacgcatga

SEQ ID NO: 44731 - DNA, 411 bp, Glycine max
  Peptide Sequence Number=SeqID_136416
atggtgaaagttggaacctcttacgtgccgatcaacgtctcatttcgccaaaagttggcccagggcttcccgtggcgtatctggtttctatcagctgttccctcctgttcagctactgaattcggggtggtatccgcgtcacaattcggcacacaagcataccgagccggaagcatcagcgcggcaagtgtagcggtgccagacgctgcagctaactcaccacccgccggcttaattgctgccgctacagggcgcgtccctttccagtcgggactgcggcaactgttaatgacggcaagcgcgggcgatcgaggcgggctcttgcgctattacgccggcgctaaagggggatgtggtgtttcccagtcgaagtgctgtggaaaaagcgacgtgcgtcagcagaatatgtaa

SEQ ID NO: 44732 - DNA, 291 bp, Glycine max
  Peptide Sequence Number=SeqID_136417
atggccaaattcgacccagacatagtgctcgaattttatgccaatgcttggcctacggaggagggcgtgcgagatatgagatcctgggtgaggggtcagtggatcccgttcgatgcggatgctatcagccagttcctaggatatcctttagtgctggaagagggccaggagtacgagtatcgccagaggaggaaccgggaggcgagtgcgaattatgtgcaccaacatgaccaccccgacccagatatggatgacgttgctgctcagcaacatcctgcccagcgatcataa

SEQ ID NO: 44733 - DNA, 249 bp, Glycine max
  Peptide Sequence Number=SeqID_136418
atgccactgaagggcaagcagttggtggtataccccttgaaaacacttcggaaggccctcagtatcacccccaaccacaaccctcatgttccacagcggtttaaaaccctcatgactatggcaggaatgggaaagttggatcatctagaggaaaggcttagggccattaaaggaggtgaagattatgcctttgctaacctagaagagttgttcctcgtacctaatatcatcacccctcccaagttcaag

SEQ ID NO: 44734 - DNA, 507 bp, Glycine max
  Peptide Sequence Number=SeqID_136419
atgaagcacttcactgacaccctcatcagtgccaacataggaacaaaagctggtaccgggccccccctcgaggtcgacggtatcgataagcttgatccaactaaacttaaagattgggattgggtgcagagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 44735 - DNA, 153 bp, Glycine max
  Peptide Sequence Number=SeqID_136420
ggttttataggcgctttatcaggggattttagcaaagtggcccttccattatccagttgggggcaaagggaggtggagtttgattttgatgaccggtgcaaagaggcttttgattgcctcaagcgtgcggtgactaccacccctatcatttag

SEQ ID NO: 44736 - DNA, 177 bp, Glycine max
  Peptide Sequence Number=SeqID_136421
atggccaaaactagtgccaaagaccctggaaggtcagtgcacagtgccctccacgatcatacacaacatccaacgtatgaacgtggccaaaagctagtgccaaagaccctgaaaggtcagtgcacaatgccccccacgaacatacacaacatgcacatgccaatggggatcctctag

SEQ ID NO: 44737 - DNA, 129 bp, Glycine max
  Peptide Sequence Number=SeqID_136422
atgacggatatggaaaatcctcccttgagatcctttatggctttgctcatctgcaatgagattatggtactcgaccaagaacctatcgaaggggacacaataggcaatggtgtcagaaaatcatggtaa

SEQ ID NO: 44738 - DNA, 195 bp, Glycine max
  Peptide Sequence Number=SeqID_136423
atgaagaaagagtgtcccaagtataccgcatggcgtgtgaagaaagatacttggtgggtagattctggtgctactactcacataagtatgactatgcagggttgcctgtggagccgactaccaagtgatgatgaaagattcatctttgtgggtgatggcaagaaggttgcagtggaagctattggaactttttga

SEQ ID NO: 44739 - DNA, 171 bp, Glycine max
  Peptide Sequence Number=SeqID_136424
atgaaactccagaaagcgcaccggatcgtcaagtatttaaaattaaaacggatgaatctgagtatcgaactcaaggaactagtattagacaagcctaaagtactaaaccttgatccctcattaggcgaggttaactcaagctttgtccttagatccctcttgttggactag

SEQ ID NO: 44740 - DNA, 684 bp, Glycine max
  Peptide Sequence Number=SeqID_136425
atgggtcaacttcaacggcaagcctttcgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcatcgccattttggccatgtatgacacgttcaaccggggatgtgaaaagagtggcgcaagaattgattctatcttcatgcgaaggatgtcccatgagaggagtgccatcagacgaaagcatcacgccttttcatcgcacgaggtttcagtgaccacaacgctaggggtactccaagggaggttcgcaagggcatggggatgcggcgtgaagaaagggacagaaagcttagggggaaggcagtaa

SEQ ID NO: 44741 - DNA, 423 bp, Glycine max
  Peptide Sequence Number=SeqID_136426
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggaagactcaattgcaatatcatggactgagtgtactaacaaaattgatacagattaaggctgccattgcagttattcgcaatgttcgtggtttacccccagtgcaagatttcaagaaggacggagcctttgtggatctatttgattttcttcagcattgttttggattccag

SEQ ID NO: 44742 - DNA, 222 bp, Glycine max
  Peptide Sequence Number=SeqID_136427
atggggctgttttggtacaatgcagtggtgtcgccagtgccattagcgatttggccatgcaaggggtctagccagtttgacttggatttgcagcaggctagggcacggctttccaaacttttcagatttcagatggcagtgcttttttcaaatggccgtgctttagacggtgtcaatggatatagcaagtggtgttggcgagatcatgcaatatggatatag

SEQ ID NO: 44743 - DNA, 341 bp, Glycine max
  Peptide Sequence Number=SeqID_136428
gaggtgccactcggactgatttcaatcgtcatttcagtcccgtttaccgccagcgtactaataacgagtgggaaggtttggatggctttgctcagcatgcacgtaaactccgggaaatcatcgcatccggcaaaatagaagtttgcgatgagcttcgtgacgggaatctctatgccaccaggcatcgcgttttgtgtaccaagcacaatggtgaagaggtggatatggaagtttatatgttcgctgaaacagatgatgacgggcgctttattcgtgtcgaagaagcgacgctaatgcttcgaggtgtggagagcgatcggggtttaggtaaggtaaggtaa

SEQ ID NO: 44744 - DNA, 557 bp, Glycine max
  Peptide Sequence Number=SeqID_136429
ggagcccattaatattttgcaatatgctgacgacacggcttttgagggagatgctctttgggagaatgttctagttttgaaggctttgctgcgaggttttgaattggcttctggattaaagatcaactatgccaaaagtcagtttgggattattggagggatggagttccagcttcgaagagataaaaggggattttccaattggtggaaggatctgaggaagatttaccaccagtctcagcacagcatttttcatcaaaacatggtttggaagataggttgtggtgacagaattgatttctggcatgacagatgggtaggcgaatgcactcttaaacagcaatacaaccaacttttcatgataagcagtcagcagcacaacctcatttcaatgatgggtaatttctcccaggataattggagatgggatttgcagtggaggagaaatctttttgatcatgaacatgacttggctgtgagctttatggaagacattacatctatatgtattcagagaaatgtgaaggacattatgatgtggaaagctgaacctaacg

SEQ ID NO: 44745 - DNA, 162 bp, Glycine max
  Peptide Sequence Number=SeqID_136430
atggggagtaaattcgaatctaggccctcccggaacattttggaagttgggttgcttaaggagagtcacaacctacccttcggcgggagggcgacgtgtgactcgcgggatgcgtgttccatgaaaggaatacgcgcggagtcgccaccaacgtttatttga

SEQ ID NO: 44746 - DNA, 519 bp, Glycine max
  Peptide Sequence Number=SeqID_136431
atgccatatgtggaagccgcagaggagtcattagaaacagccttccagtcttttgaggtggtaagcattgcctctgtagattccttctctgggaaaccttgcctgtccgatacggcagtaatggtggcccgagtgatgttggggaatagttacgagcccagaatgagtttaggcaaggacaacgacggcagaacctgcctgataagcgccagaggaaaccacgagaagtttgggttaggctataaacccatacaagcggacataaggaaaagcgttgcaggaaggaagagcggaggtcaaggcttgcgattggtacaagaagtcgaaggaggcccgccctgccacatcagtaggagctttataagcgcgggtctaggacacgaaggccaagtcgttgtgatatgcaaagatgattctccgagtgggtcagttttggtacgaccatgccctcctggtttccgactaggaaattggcgagtggaggagaacccagacatttacgcaacaagcataatgtaa

SEQ ID NO: 44747 - DNA, 737 bp, Glycine max
  Peptide Sequence Number=SeqID_136432
actctagaggatccccagtcagaggtcatttggtgaagattgatgctgacagtctcaacgcattcctggagacacctgtggtattagctgagggagagactctacccgcttactccagatactgcaggttgcctacaaacttcagagagatagaggctgctttatgcatacctggccgagggttcatcttgaactctgagggccatcctgggaggattcttaggaaggatttgactacactagctcaagtgtggagtgtcctctcatactccaacttggcccccacatcacatacctctgatctgacagtggacagagctaggctgatctttggcctagtctctcacttggatatgaacataggagcgctgatttctggccaaatggcttctatagcccagtctaacacctctagacttgggttccctactttaatcactgcattatgcagagccagaagggttgtatctgatagccttaccttcgagcgcctgagcccagtcattaacttggcctacatctggaagaactgttggaaccccgaggatctaacagtctctatccgagggatgatagcacctccagactctattcataaggaagacgaaggtcccacagcccaagtacctgagtatatggaggatgagtcatctgaggccaccattccagagccatttgatataggagaagaggtagaggagacacaggtgagaccggtagctgctaccaccccttaa

SEQ ID NO: 44748 - DNA, 333 bp, Glycine max
  Peptide Sequence Number=SeqID_136433
atgagtcatcattcatctagtgttaatggaaagggaaggcataggtcacatcttagacctcactcccatagaagagaaaaggaaagaaagcctcaagaggttaacattaaactctcatacttccatgggaaggacaatgtagaggctaacttagattgggaaatacgggtagagcaacaacttaaaaagaagtctacttcaaaatctgatggctctcactcttatccaaagaaagaccaaggtcaaggcatcttaggggtgacaccttctaagcccaaagatgatacggggaagacaatagaaaagcaagccaagatgaggctactactttaa

SEQ ID NO: 44749 - DNA, 372 bp, Glycine max
  Peptide Sequence Number=SeqID_136434
atgcacacacaaggtttcacaattccacaattccttagaataggcctaactctcaaaaaggtccccagtggagtcgccaactgtcgcaatgttcccttttgcgggcgagcgaaggcgtggctcacgggtgcgctttccaaaggaggaaagatgtgcggagtcgccaccaacgtttatttgtggaaaacgttggaaaaaccgaaggaaaccggtcgaaatgaaaattctaagttcgggagttgtatttacgttcgaggaaggtcgacaaaagcggggctcttgctcctacgtaccctccatcaaagaggaaatcagacctgcgtaattcttcctttaaaggtgaatcaagcgattcttttacttgaaaggtga

SEQ ID NO: 44750 - DNA, 294 bp, Glycine max
  Peptide Sequence Number=SeqID_136435
atgggttgtggcctctggcttgaaaacgaagtcaggaaactaagggagcctctgagggatgggtcactggtaatcgattaccagatcgtgatggcggcgcagctaatccatgatcgagtagagatggagtgcctagagggagcctgggagaccctcgaaggcaacacgaggtgccgatttcggggcaccattcgattcacggctacttctttggtgcatccagatgaacctgcacggacgcttcagcgcacggtggagtggacagctttctggatcagttttgtatacttttga

SEQ ID NO: 44751 - DNA, 256 bp, Glycine max
  Peptide Sequence Number=SeqID_136436
accacgtcttttccggtttttccgatgttttcctcaaataaacgttggtggcgactccgtgcgtattcttttcttggaaaacgcacccgtgagtcacgtgtcgccctcccgccgaagggtaggtaagtggttgagagcccacgtgcaaggtttggattggctcccaagtttgagaaccgctaaaagggaggaaattgaggcaccagaggaagacgaagaggtgcaggcccttaggacagaactcgagcaagcttaa

SEQ ID NO: 44752 - DNA, 402 bp, Glycine max
  Peptide Sequence Number=SeqID_136437
atgcttcaaatgaaatggctccgaaaaaagctttccgcgaagagatctaggtgggacgccgcggctgaagggactagtgccgcccccgagtttgatagccaccgtttcaggagcgccgagcaccaacagcacttcgaggccatcaaaggatggtcattccacagagagagacgcgtccagctcagggacgatgagtacacaaattttcaggaggagatagctcgccgacattggacgtcgctggtcactcccatggctaagtttgaccctgatatagtcctggagttttatgctaatgcttggcccacagaagatggagtgcgagacatgcggtcatgggtgaggggtcagtggattccctttgacgcaaatgcctcagccagttcctgggtgacccgctag

SEQ ID NO: 44753 - DNA, 321 bp, Glycine max
  Peptide Sequence Number=SeqID_136438
atgttttttcctgcgttatccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacaggtatgaccatgatgccccccacgcgccccaacgtccctcctcgctcgtggccgtggcgcgtcgtcgtcaccttcgctcctggtcacgcgcgccatcgacgtgaacgagttcctgggggacttcggggcgcgggaccctttccccgcggagcttga

SEQ ID NO: 44754 - DNA, 285 bp, Glycine max
  Peptide Sequence Number=SeqID_136439
atgatgataacaaaagatgatcacaaaggtgatgacaaaaagctcaaagatcaatcaaagaacaactcaagtgatcaagatagaatcaagaacaattcaagagttcaagatagaatcaagaagaattcaagactcaagaggaaagttaagagtcaagaatcaagattcaaggttcaagatctcaagaatcaagatcaagattcaagacacaagattcaagaatcaagagaaagcttaatcaagataagtatgaaaagtttttctcaaaaattgagtagcacatga

SEQ ID NO: 44755 - DNA, 165 bp, Glycine max
  Peptide Sequence Number=SeqID_136440
atgctgcagttcacagcagtaagagcatggagacagggggagcagaaagctgatgtcacaattttgctgtcaccactacagatactgctgtgcttgattactctgataatgaaagttgctgatcccacttgcatgactgctcgtacctgctcaggaagtgtctaa

SEQ ID NO: 44756 - DNA, 150 bp, Glycine max
  Peptide Sequence Number=SeqID_136441
atggaaaatgataagcacatggctacaccaatgagcactgcttgttatttagataaagatgaaaccgatcagtcaatagatgttaagcaatatcgagatttcaatcaaatcccaaacaatcacatcttagtgccattaaaagaatcataa

SEQ ID NO: 44757 - DNA, 186 bp, Glycine max
  Peptide Sequence Number=SeqID_136442
atggaaatgtaccaacttacttggattgtgattggaatgcagaataaagaaaggaagatgcagacaatcagtacaaacacgcaccagaaatgcacaattgctcaagtgagcgtctggggcttagcgcagcaggctgcgcttagcgctttttgcaacacaattttttgcaatatgcgcttagcctga

SEQ ID NO: 44758 - DNA, 369 bp, Glycine max
  Peptide Sequence Number=SeqID_136443
atgtcgcgggagtcaggagaccttggggacatcaggtggggtgctattgtccaaaaccaagcttggctaatcccgacccaacccgggcatagtcagtccgtgagaacctgtgacgtacctaagcaggcgagctcctggcagtcaaccaataaaagaacaaagtccacgaagcaaggagacttgtgtggcggctggccagctatgtatcttgggtggtatctgaaaattaccctctgggcactggtaatcgattaccagttgtgtgtaatcgattacatagtgctacctgctactggtaatcgattaccatttatgtgtaatcgattacacagtgtaacttgtagattccaatgtgcaaaggttgagtaa

SEQ ID NO: 44759 - DNA, 1010 bp, Glycine max
  Peptide Sequence Number=SeqID_136444
tacatgctctcaccttcagaggactacacgtcctcaccttcagaggactgcaggtcctcactttcagaggactacacgtcctcacctttagaggaccacacgtcctcaccttcagaggactacatgccctcaccttcacagggctacacaccctcacctttataggactacacgtcctcgccttcagaggattacaggtcctcgcttttagaggactatacggattcctcaccttcaaaggaccgtacgtccttgccttcagaggcctacaagccctcaccttcagaggactacatgtcctcgccttcagaggactgcacgtcctcaccttcagagggctacacgccctccccttcaaaggactacatgtcctcgcctttagaggactacacgtgctcaccttcagagcaccacacgtcctcgccttcagagggctacacgccttcaccttcagaggactacatgtcctctcctttagaggactgcaggtcctcgctttcagaggactacacgtcctcacctttagaggaccgcatgtcgtcaccttcagagggctacacgtcctcgctttcagagggctacacgtcctcgctttcagagggctagatgtccttaccttcagaggactacacgtccttgccttcagagggctgcacgccctcgccttcatagggctacacgtcctcgccttcagaggactacatgtcatcgccttcagagggctgcacgtcctcgcttttagagggctccacatctgtgccttcagagaactcaaggcaggtgcaggacgagacaccacaacagcctggggatggccgacagcgggcaacagacgcaccgccgccacccccagagcccctcagctcatctacaaaagctggagcgttgcctacgatccgtggccgactagcacgcgaccaagtccaaagccaaagttaagcaaaagtactaggcctgtgaccgacaagtcatcacacgtccggctcaagacgttaaagaagcgctactag

SEQ ID NO: 44760 - DNA, 195 bp, Glycine max
  Peptide Sequence Number=SeqID_136445
atgtcttttctgatggtagtggtcctagatgcagggaagaatttctccaagaacaccctcttaaggtcatcccagctgaaaatggacttgggagcaagggggcttcatggtggaacaaacaatatggaaccccttaagatgcttatgaggatcttcacctgcaagaccatgaaacttgggcagcaaatgtattag

SEQ ID NO: 44761 - DNA, 123 bp, Glycine max
  Peptide Sequence Number=SeqID_136446
atggaaagtgctaagcacatggctacacccatgagtattgcttgctatttagacatcaaacaatatcgagattttagtccaatcctaaaacaatcacatctaagtgcagttaaaaggttataa

SEQ ID NO: 44762 - DNA, 249 bp, Glycine max
  Peptide Sequence Number=SeqID_136447
gagggaacctattgggtgagaacttctaatctgcctctaggttcacttgaggctcatgcacgatgcccctcattgccccagtgtaaggctttgaggtaccaatcgttgtcttgttttcatagcctcgtatcgaatgactcctatgtagaagcaagatgttttgatgttttgatgatgccaaaggatcaagtgcttccaagttttattcaaggcaagaatccaagaatccaagaagatcaagatatatga

SEQ ID NO: 44763 - DNA, 61 bp, Glycine max
  Peptide Sequence Number=SeqID_136448
gtgcggataaccagaaggtgtttccgtatgctaccagactcttgggtcatgatagcaaaag

SEQ ID NO: 44764 - DNA, 306 bp, Glycine max
  Peptide Sequence Number=SeqID_136449
atggctgcattagagagagaaggtagcagcgggctcgtctccacagaggcacaactcaccacctcgaaagattggaaagttgtttccaatgattctttcgttgcttctacgtatgcgttgaagggaccactcccacgcatgaatccaaggtctccccaagaggcagctataggcgggatttatgtccatcacttgaaacaccacattgcaagtgtgggggcctatctgaatgggaatgtcgatttcccccatcacttcccgccgagtaccatcgaaggctcgtaccaccatcgaacttggttttaa

SEQ ID NO: 44765 - DNA, 540 bp, Glycine max
  Peptide Sequence Number=SeqID_136450
atggcgagaatagccaaagtagtcaaaatctcggcgcaagaattggaccaagtaaagcaaaatagaaatggggtagtcagaattccgaggaagcacttggaggagaaagcgaaggctttggaggatcaaggtgagtgggcttcattcattgatgtcttggcactattggtatttggagtcatcttctttccaaatgtggatgggttgatggatctagcggcgatcgacgtcttccttgcttatcaccatagcaaagaaagctcggtcgttgctattttggccgatgcccatgacacatttgaccgaagcagttgggctaagtgcataaccaccgctaagcccagcatcagagcgcttagtgcaaaggagaatctggcagagcatcagcatcaatgcgctaagcgcgagatcagtgcgctaagcgcaaaaggtgccttcagccaggctaagcgcaagactggcgctaacccaatttcacttactcgcgctaagcccgggggtggcgctaagcgcaacgttgcgaattcagaccctatttaa

SEQ ID NO: 44766 - DNA, 300 bp, Glycine max
  Peptide Sequence Number=SeqID_136451
atgctccaaccatgtgggatcggcacaggcttaaaggagcactcaaactgggtgtatttatccccaaggcctacactccaaagaattcgtcagggcctctccctcctgattcagttttatctcgtcgcgcttgtgattaaactcgttgggtccccacattggttcccatcacaatactcgtcgttcttaaagggtcttagcattaactcgtcatccttaaagggtcttaacatcaactcgtcgcctttaaaggatcttaacattaactcgtcacccttaaagggtcttatagtcgtgtga

SEQ ID NO: 44767 - DNA, 153 bp, Glycine max
  Peptide Sequence Number=SeqID_136452
atgaagaagattcatggcctaaaagttccacatggagctacatcctgtgggaattggaaaggagcattggtgccatatcttgaagaatttgagtcaagaagaaaggggccaaccaccttaagagctattggactaagaagcactccaaattga

SEQ ID NO: 44768 - DNA, 390 bp, Glycine max
  Peptide Sequence Number=SeqID_136453
atgcctgaatactcatttcaagttccttctacctcaaaagttttttatggaccctcacaaaggtttggcaccactttcaacactccaccatctgcatataatgtaccaccattgagctcttattatcgtccatcattatctactcaaatgtgtcacatgggttatgaagatgaggaggaagatgataataacaagaataccaaccataacaatgatgatgatgacaacggtggtgatcatgttcctcaacaacaacacaaaattacacgtgatcatcctacactactacaaaatgttaacagtctggaagcatctattgtggaaaggtacattgcagaagaagccattgaaaaaaagggttatttgttcatccaactacgatccatctaa

SEQ ID NO: 44769 - DNA, 552 bp, Glycine max
  Peptide Sequence Number=SeqID_136454
atggagagacctggcaactcaaagtggcaccttaatgacgataaaacgatgacaatgatagtagacacattaccagtattctactatggaaaatggtgggctacgcaccttcaaagctttgaggatttggtctttgccagtgaaaggatcgatgtgggtatgaaaaaaggcaaatttagtcatcctgcttggacgaatgagaaaactggggcaaatgaagagggtgagaaagagggagaaacccatgctgtgactgccattcctatacggccaagtttcccaccaacccaacaatgtcattactcagccaataacaaacctcctccttacccaccgcccagttatccacaaaggccatccctaaatcaaccacaaagtctgtctaccgcacttccaatgacgaagaccacctttaacacaaaccaaatacaccaacaaaaaggaattttgcagcaaacagcctgtagggttcaccccaaattccgttgtcatatgctaaacttgatcccatatccacttgataattcaatggtagccataaccccaagcaag

SEQ ID NO: 44770 - DNA, 168 bp, Glycine max
  Peptide Sequence Number=SeqID_136455
atggctaacagactccaagaagattgggccagagatgcaggagaaggccctagggttctcatgagccttagtcacactttgtgcatgtccttcatgctttacatgcctcataactccaaagcacacttagtggagaatcttggacttgatcttggattagtgggatga

SEQ ID NO: 44771 - DNA, 345 bp, Glycine max
  Peptide Sequence Number=SeqID_136456
atggctgagaagactaagaataaattggaggaagttgctcaatccgaaagcactgaggccatgattgaccctccatctcccatcagacgacacatgaagtggaagatgatcagcaccaagaaaactaggcagatgacatctgaggcagcaaaggaaattgctgagaagattgaactcctgactgctgccattaggcgaccaaaacaccctggtcgtgtgtgtgatactggagttggtggacttgcactgcctccggagcctgaggttggtccttcagctgctcgtgtcagcacaaaggagagttgtgttgatccctcagggaacgatccagacacggatgactaa

SEQ ID NO: 44772 - DNA, 336 bp, Glycine max
  Peptide Sequence Number=SeqID_136457
atgtcagaagcccaaataatagcccatgcgactcaactccatgaggctcaacaaaagaagagagctgaagatgttgttgttgttgctattactgagaaagaacttgttgctattcttggaagagaagctatttccactatccaagttaaaacatatgctaaagttgtgggcgacaccttatgtgaaaagatgaagaataaaaaggttgttgtggctggtgtctcgctaagcgaggcttgtgcacttagcgagaattatccgctaagcgaggcactcagcccgcttagagagttgggaaaatctagaggagaatctgcccagcatttgcgtgcttag

SEQ ID NO: 44773 - DNA, 417 bp, Glycine max
  Peptide Sequence Number=SeqID_136458
atggctcaacctccacctcatgagaggactcttagggagatggctgcatgtgacatcctagaatttctacccggaattttctccaaaatttctccacatttctactccaaatcgcaaggagaagccattttcggagtcgtgaagcacacctctacgttgtggggcttcgaatttcagttatttgttaaggaatttgttgaaagcatgctaaacttgacatgtttgataaaactggtagagatgatggggagagttaacttagggttaaatgtgagaatggtagtgatgaaatcatgggcagagcaagtgagaaaaaggattaacaagtgtgaaagaaaagagccatttctaggaaaatgcttgtgcattgctagtcatgggaagagtagtacatttcgggttccaggccgtttttag

SEQ ID NO: 44774 - DNA, 331 bp, Glycine max
  Peptide Sequence Number=SeqID_136459
cagggatcgcacccaagagacacccagtggacccagaaaagtccaacagggccctggggtttccagctctggttacgggcctctatcagtcctacagggtgcccgtacccccccggcaaggtcacgtcatcatagggatcgcgactgcaagacacctagtggacccgaagaagtccaacagggtcttggaattttctacggagtacctgtcacctccagcaagggcatcaggccccctactaatcgagctttcatcaagaagtactgcgccccagacaggcacagggcgaaacaccacagcagcattgggatggtcggcagcgggaaatag

SEQ ID NO: 44775 - DNA, 778 bp, Glycine max
  Peptide Sequence Number=SeqID_136460
atgggcaaaaccaggtcatttctcaagaacatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtggtttggccaatagtgggccaagaaatattgaatggtgatgtagggggagggttccgaggaatacaaataacctccggtttttttcagatttggagagcatctggaataagtagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggggttgggatctctttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggag

SEQ ID NO: 44776 - DNA, 478 bp, Glycine max
  Peptide Sequence Number=SeqID_136461
atgcgttgttggcacaaaacaagttgttgtccaagcaattggaagcattgaccgaaacactaagttgcagggtgtgccatttgtggtggagctcacaattctggctgctgtatccccaatgaagaaccagctcatgaagtcaattatatggggaaccagccaaggaaaaatttcaatgcatgtggatattccgggtttcaacatggccagccatataattcacagcagggacagtggaggaatcaccctgttggcggataggccgtcaagcagctttagtgctaacactgagaagaatctgaaggaagaatgtaaagttgtaatgacaaggagcagaatgacagttcaggctaatgaaggtagagctgaagagaaggaggagggatataaacaacagtcggcagctgagccagcactagaactagtgtctgactttgttgaacttgaggaagttgtggaagatgaagatgaccaatag

SEQ ID NO: 44777 - DNA, 351 bp, Glycine max
  Peptide Sequence Number=SeqID_136462
atgttggtgcgcatgatccgcactcatctttttgcagcggcacgggggaaatcttgccccggtatgcatagtagatgcgtgatagcctccctctctggatgtgctcgcacagttggtcaccgtccaatatcaggggtgtggatatggagcacactgaaaatgaggacgcgtagccctctaaaggcgagggcgtgcagccctctgcaggcgaggatgtgtagtcctctgatggcgaggacatatagtcctctaaaggtgataggtactagtacccaagggtccacctttatgagaaagcaagagatcgactcatcgagagggccagtcatccaacaagattggacacgagat

SEQ ID NO: 44778 - DNA, 565 bp, Glycine max
  Peptide Sequence Number=SeqID_136463
tcccagtttcagtcgcagatgcaatcacaaggactcgcactgcctcctaaacccgaggttggtcgttcagctactcgtgtcagcacaaaggagagttgtgttgatccctcagggaacgatccagacacaggtgactcagacaaatgtgggttgtacatcgaagaatattctccccacctggttgccctaggaagagtttatgagggatccacaaccattcacaacattcctttgctgcatgatcaagtcaaggttggtgttcaggaggttagagatgcagatgctcccattcctgtacccactaaagaggttaaggtcatgggacagactcttaacacattccttgcttggctgacacatcttgtcaaacctgtgggacccgtgaaacttgcagataggccgaatcatgaggtcgatgatcccctatatctgatgacattgaccatcccacagctttttctgaagtcattgcaggttatatgggatgctaccttgtttggcctgtttaatgaagacttccccttgtacataaagcatgaagatctgtctgaaatagcacatggtg

SEQ ID NO: 44779 - DNA, 403 bp, Glycine max
  Peptide Sequence Number=SeqID_136464
gggagaagcttgccgcccagctcgcccaggcgagcaaggttgcttcctccagaagcaacacccttctggaggaatcttctggagggcccaagtgggtctggagttacggaaactcacggattgcgcaaaaacacctcttttcgatttccgccacattacggaatttcacggatcgcgcaagcctgcttccggtgatgcgcatcaggccgcaggcgcaccgccaccacctcgacaggccgatccagctgggccactgggcgttgagcgttatctacagcatttggttcgccatcaggcggccaaccaccgtgggcaggggcagggctccgccccttttgtatgccctaccccggagcagtttggggctgaggtcgcatggcctagagactggcccggtgcctag

SEQ ID NO: 44780 - DNA, 567 bp, Glycine max
  Peptide Sequence Number=SeqID_136465
atgggtaaagtagaggaggtgcaagagcagatgaaggccgacatggaggccatgaaagagcaaatggccacaatgatggaggccatgatgagcatgaaaaagataatggaagctaatgcggttgcagttgccgttaccagggctgttgctaaggtgaactcgatgcccccatctgatctcaaccaaatgaatcatccaaccttagctatggtaggcaaagatttgggaatgagaatatcaataactccactcccatactcattgagagccgacaaccccaaactgatcatgcgcatgtctcttgacccattggggagacacatgaaatgccccaccacaatcaagccgacttcgagccttgcctcggatatgccactgaagggtaagcagttggtggtatacccttgcaaaacactttggagggccctcagtatcacccacaaccacagcccttgcattccacaccgggtaaaaccctcatgctatggcagaaatgggaaagttagatcatctagaggaagcttcaggcccattgaaggaggtgaagattatgccttgctaccttag

SEQ ID NO: 44781 - DNA, 207 bp, Glycine max
  Peptide Sequence Number=SeqID_136466
gatagaagacctcaagaggttaacattagccttccatatttccatgggaaagataatgttgagatctacctagattgggaaatgaagattattggggatcctccagtagagtattggaatgatcttaagagtgcccttaggaagaggcgcattccccctactatgaaagagagcttttggacaagctccaaaggcttagacaaggga

SEQ ID NO: 44782 - DNA, 417 bp, Glycine max
  Peptide Sequence Number=SeqID_136467
atggaacttcaacgtctcaaccaaaatgaagagaccgacaaaaggaaaagaagcataccactcaaagtctcctcctcaatgcaagaagaagaaaaagaagaagaatctgatgatgaagaggacttctcactctttgtgaagaagtttcataaattcgtcaaaaatagaagaatggagaaaagccataacttcaacaataggaagagatctcaagaattttccccaacacttaaatgctataagtgtaatcaaacgtcatggcccgagaagaatgagaagaaaagctataaagaaagaagatccaagaaggcgtatattgcttgggaccataatgactcattcgatggtttggagaaggagatcaaccttctatctaaggaatatgaaagtgatgagaacatctctcaagaagtttaa

SEQ ID NO: 44783 - DNA, 471 bp, Glycine max
  Peptide Sequence Number=SeqID_136468
atgttttcttgtatgcaaagaagatctactgcaggtgatttgatccccattgatttggagattaacgccacttgtagaaggtgtaatcaagagagaattagaaaaattttgcaggatttagaagcagcaacaattccagaggaagaacctcaatcttctgaggcatcttttagttttcctattacaggacattctcatttagatcctatcgaagaccacatcatggatgaagagccaagaagagtcaccctggaagattattcaagttctaatgtgccacaatttttcaccagcattgcacaactagaagttcaagcccaaaccattacatatccaccatcattgattcaattgattcaaaataatttgtttcatggattaccaaatgaagacccatatgcacacctagccacttacattgaaatatgcaatactattaggctagttggtgtacttgaagatgcaatctaa

SEQ ID NO: 44784 - DNA, 225 bp, Glycine max
  Peptide Sequence Number=SeqID_136469
atgaaacatgccggtgtcggccgatacgcaacttcggttgagctcgatcgaaaagacccagccggcctacaccgaaatgttcgatcggcgtcatccggtgatacttctttttcaaacctcgatcggtcatctctcctggccgacgccggtttgcattgtgttcgatcagtatccgcgaatcacatttttctgacgaggtgggctaatgttttcccggccgagtaa

SEQ ID NO: 44785 - DNA, 336 bp, Glycine max
  Peptide Sequence Number=SeqID_136470
atgtctagtcaactgctgcgcctcaaccatttggggagaacccttctcgggttcggggctattttcaccgagttccttagagaactgtctcgcgcctctggtattctctacctacccacctgtgtcggtttcgggtacaggaatattcatgttgctatttcgactaccccgatcgggggtgatcttaccctgactcaccctccgtggacgaacctatgcggaggagtacccttgggttttaggctgattggattccacgtgccccagtgctactcgggtcaagcgaatgctagttccgcttcgtccagcactgctcgcgcgggtccttccctctaa

SEQ ID NO: 44786 - DNA, 420 bp, Glycine max
  Peptide Sequence Number=SeqID_136471
atgatgaatgttttgagtggtgcaaccctctttggtaaaatcactcgtacacctaatatcttcatggtgtgtgtacatagggacccattaggtagtgatcaaggggttcccatgaaccctaagagaataaaggtcattcctgagtggcccactccaccaacaccactcattgagttggtgagaaaccgtgttccttcatgggaagaggcccaggaaatgggttttcagaccttatcttacttcaacataccaaacaccactaatacatatgtttttgttctttttactggtgttgagggaaggagcccagagtatgaagaacctcgggatttgaggtcaaatcctttccaaggtggagggaacttgatggaagcttgcttgtggggcttctgtggaggctggatctttgagcttcaatga

SEQ ID NO: 44787 - DNA, 450 bp, Glycine max
  Peptide Sequence Number=SeqID_136472
atggcccaagagcccacagatatagccaccacctcgaaagaagtagatcctcctgtggcaagaggagccgaaaagaaagagggacttcaaggaaaaacagtgactttggaagaggcccatgagttcctccgcctcatcccccctcctcaatcaacaaagcaagtccttaacgatgcccatgtagcacatgatatctcagtggagggtttcgaaggcatcgttaatcatataaccaccaacaattatatcgcgtttgcggaagaagagattcccattgaggggagaggaaacaacaaggctctacatgtgtcagtgagatgtatggaccatgttgtcgcaaagctgcctcttgggaagaccgtggattcatgccctgggagtggtcccttcaacgcttcaccagaaattgaagttcgcagtgggtggacttttagtgatagtatcgggtga

SEQ ID NO: 44788 - DNA, 204 bp, Glycine max
  Peptide Sequence Number=SeqID_136473
cggtatagacctctgattggcttatcacgcgccagttccccacttgggaatcgggatggcatggtgtcgcaacgtgcccttttgcggacgagcgagggcgaggctcacgggtgcgctttccaaaggaggaaagatgcgcggagtcgccaccaacgtttatttatggaaaacgtcgggaaaaccgaaggaaaccggtcaaaatga

SEQ ID NO: 44789 - DNA, 492 bp, Glycine max
  Peptide Sequence Number=SeqID_136474
atggagcataatggggacaaaggaaacttccttctctgggatgcaacatgtatcaagctgtctggtaaaactgctggagaatgtcgagatgagttgatagcggttggggatgatattaaggtatttccaacatgcgttgatgaaatcctgttgaaaacttgggctgtcagatttaagttccgttcacaattacgccaatcatctgtgttggatgtgagtgaagaactccatcatattcaatcattgatagccacccttgggttgaaggaacaatcaaataagggaaaaggaatagctgttgagccagaaagttcaccaccaatttttgttcccacgccaccgttgccacagtcttctgattacgatcctggaaactctacctgtttaactccaaccaaaaggattagttgtcagcaatccagttctgattttgattctgatgagcatgcacagtatcagttatcaactaacaaacatatcaaggctgagtaa

SEQ ID NO: 44790 - DNA, 187 bp, Glycine max
  Peptide Sequence Number=SeqID_136475
atgggctttagctctgaatctcaatcttctggccgggacgatcgacctcaacccgataactctaccctcttaatagaatgcttcgcgtcgatacgacatgcttggaccccctatgctggaaaggatttgccaaacacactcatattcttaaaaagactgaacaagaagggtggtgctttgcctgccg

SEQ ID NO: 44791 - DNA, 186 bp, Glycine max
  Peptide Sequence Number=SeqID_136476
atggccggtgtcggtccttatatggccccgactgatatctttcagccgacattgggcaatttcttttacaaatgctggccgataatgttctttttttacgatagaggaagtcggctaggtttttccgtgcgagctcagccgagggttcgttccgacggacactggcatgttgttcttctcatttag

SEQ ID NO: 44792 - DNA, 289 bp, Glycine max
  Peptide Sequence Number=SeqID_136477
tctgcctacaaagtattgcaagaggatcataataatgctgatgaagacagggcctccaagattatgcagagattgaaaattcccccaagggcgagtgctttttcttggagactattcaagaacaggctccctactagggataatctcagaaggaggcaagtgacattgccttcatacaactgccctctatgtgagcataaagaagaatcggcaaagttctacaaccaagagatgggaattcctgtggatagctctgtgtttgtccatttggcatcacagaaatggcatg

SEQ ID NO: 44793 - DNA, 386 bp, Glycine max
  Peptide Sequence Number=SeqID_136478
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggcgacgcgggacttgcgggtgcatcttccaaagaaggaaaacgtgcggagttgccaccaacgtttattcgaggaaaacgtcgaaaaaaccagaaaaggcgtggtctacgaactttaagtgaaag

SEQ ID NO: 44794 - DNA, 210 bp, Glycine max
  Peptide Sequence Number=SeqID_136479
atggaaacctatcctgtgaggccaatactccagttcccaatcttcaacttcttcttgtgtctttcttctgcggagaacgaagttcttatgaaatggacatacttgtcaattgatctaacacagttgctgcttcacaatactggtgatgccaactttgcaaagcgaaagctcatcatggaaccagagatgacaaggtggaatacaagatag

SEQ ID NO: 44795 - DNA, 206 bp, Glycine max
  Peptide Sequence Number=SeqID_136480
caatcactacgcatggctccaaactcgaaggtggaggacacatgaatgaaaacgcaattcatgggggcgccgaaaaaagattgagaatggagaattgcactaagcaatcaccacgcataggctacaaactcgaaggtggaggacacatgaacgaaaacgcaattcatggggctccgaaaaagattgagaatggtgaattgcactaa

SEQ ID NO: 44796 - DNA, 362 bp, Glycine max
  Peptide Sequence Number=SeqID_136481
atggaggcaccagctattgtagaggacattgtgctagacattcctgcggacacaggtgtagaggctgttgaggacaagcatgagggatttccgggtggtccgagcgacccatccgtgttgaccctgtatgcggatcacgttgcttgcagcgtatggacgagagagaagcgtcttgaattgaagctatcctctcatgggaggaaggtccacagtttaggcagacctgtccctgccattgagggacttgttgctggtacaagactaagtcctctgatcgcgtgttcggtagacaccggcgatcggggactttctccgcgtttgtggagcagtggcaccgggagacgtctagtttccatctccca

SEQ ID NO: 44797 - DNA, 210 bp, Glycine max
  Peptide Sequence Number=SeqID_136482
atgcagaagacgacgttagtctcagcatgctatcatgcgttgagtcttagagatagcaaaagaacgtttgcaggttatcgtcaggtgtctccgcatgtcaccggactcttgggtcatggtaacaatggtggggtggtcgacaaaagtagggcttttgctcctacgtatactcaatttgtgatgaggaactcagacctacgtagttcttga

SEQ ID NO: 44798 - DNA, 58 bp, Glycine max
  Peptide Sequence Number=SeqID_136483
gtttatgatcccaacatggttggctcatgaggaaaacgcaaggatcatgcatgagtaa

SEQ ID NO: 44799 - DNA, 444 bp, Glycine max
  Peptide Sequence Number=SeqID_136484
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggagctcggccatgtgggcgttgtagtcacgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 44800 - DNA, 138 bp, Glycine max
  Peptide Sequence Number=SeqID_136485
cgctacgcaagaacgtcgcaaggctcaagactcgaagacggaggacacatgaacagcgctaggcaatggattcatggggctccgtggaaagtggagaattggcgaacagcgctacgcaataacttcgcggggctctag

SEQ ID NO: 44801 - DNA, 606 bp, Glycine max
  Peptide Sequence Number=SeqID_136486
atggcagacacctactccgcccccgaagagattcacgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaagtatgaagcagctcatagagaagaacgcggccaccgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactactcaccacccgtcttgcaagaagatgcgggccatattgcttctcccgtccttgaaagagagcctcctcaacagcccgacgaagtccataaagaccctcaagactatgctcgaagggatgtcgagttctatcccccgatcccgaagggccggcacccagcacgttgcctcaacccaacatcgcgactcaaccaatag

SEQ ID NO: 44802 - DNA, 231 bp, Glycine max
  Peptide Sequence Number=SeqID_136487
atgcataaatgccccaggtgtgcggtatcacagtacaaagtgaaggatgatgacgagtgtagcagtgatgaaagctcaaagaccttacatggcatgcagatgggagaaattgcgatggaatgcttcgccatccgaccgattcctcctagggaaagaagattaatggtctatatccgaattttggtaaagaggcaagaaatcttaggcttggacttgccactaatggaatga

SEQ ID NO: 44803 - DNA, 186 bp, Glycine max
  Peptide Sequence Number=SeqID_136488
atgaacacaaaaagtgatcaagggcttcccatgaaccctaagagagtaaaggtcattcttgagtggcttactccaccaagtgttgaggaaagaattaatgagtttcaagaacctcgggatttgacgtcaaatccttttcaagggggagggaatgatgcaatcctaccctccaagggcattggatag

SEQ ID NO: 44804 - DNA, 411 bp, Glycine max
  Peptide Sequence Number=SeqID_136489
gccattcactacatctgcccttaccttgcttcatctccctacattcttgcacctttgctattctttgcattcatctacacaatccaaatgaacgcgttaagcgcagctgtagcgctaagcgcatttatcttctctgttgagttatctggtgaactcgctaagtgcggttatgcgctaagcgagtactatatggcttctcgtaaaaggaaggcatcagcttcagtggcccaggcacgatatgacagatcaaaattcacatctcaagatgcctgggacagatatgcagacaatattcttggccggaaaatccttccggaaaggaatgtgaagttgttctatgccgaatttgatgaatttagaagggaagttgagaggaggaactggcataagaagctcactaacttctcatag

SEQ ID NO: 44805 - DNA, 417 bp, Glycine max
  Peptide Sequence Number=SeqID_136490
atggccggaacaaattccgaggggctctgtggggtagtaacagtttgcctaaggtccaagagaagcttgtctcaacgtttatgcgagacggagaccaacatgttagccatcatcagcaagtaccaagcagagttaaatctagccacggcccacgaacacaaagtggcggacgagtatgcccgagtgtatgcggaaaaagaggctagaggaagggtgatcgactcgttacatcaagaggcaacaatgtggatggaccaatttgctcttactttgaacgggagtcaagaacttccccgattgctagccaaggccaatgcaatggcggacacctactccgcccccgaggagatccacggacttctcagctattgtcagcatatgatagacttaatggcccatataattaggaaccgctag

SEQ ID NO: 44806 - DNA, 509 bp, Glycine max
  Peptide Sequence Number=SeqID_136491
atgacggtgaaacctcggacacatgcagctcccggagacggtcacagcttgtctgtaagcggatgccgggagcagacaagcccgtcagggcgcgtcagcgggtgttgccggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggtcatcccgtgagaccaagtgcaggtggtgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 44807 - DNA, 153 bp, Glycine max
  Peptide Sequence Number=SeqID_136492
atggagaagtctgaaaagaaaaatattaatgaaaagaaattgaagaaagcatacattacatgggatgaaaatgatatggaatcttctgaagattcagaaaatgaagaaataaacctctgccttatggcaaaaagttatgaaagtgatgaagag

SEQ ID NO: 44808 - DNA, 228 bp, Glycine max
  Peptide Sequence Number=SeqID_136493
atggaaaaacgccagcaacgcggccttttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacctccctgaatcgaagactgtag

SEQ ID NO: 44809 - DNA, 336 bp, Glycine max
  Peptide Sequence Number=SeqID_136494
atggtgtatgacttggacgatatttttgtttcgctgcctaataagtggacttgttttaaaaagcacgatctgcaaatgggaaagttagatatgaatttaggtatatcccttgatgcaaagtttgatatcgcagaagctacgaaggtgaagacgaaggttatgtcaacagtagcgacaagatggcggcaatttaagtccacattgactagcaaatttgtgtttgctaagagtgaaggtcaacaaacgcaagatgttgtgacaaaatatggactagatcctgaagcatggaaacaatttgaagaaacccggctcacacctaactgggaggttagttga

SEQ ID NO: 44810 - DNA, 192 bp, Glycine max
  Peptide Sequence Number=SeqID_136495
atgctgaagataggaaattcgggtaaagttgtgataaaacaagacatgaagggaagaaggcataaatatgggtttaacaacaacaaacgtgagaaggcagagaacaaaagggtggtggatgatgaaactggcgacaaacatcaactagatgaagtcctaaggatgccatgtacaattttgtgtttactgtaa

SEQ ID NO: 44811 - DNA, 234 bp, Glycine max
  Peptide Sequence Number=SeqID_136496
atgatgatttggaaacaacgtgcaaaattagtcatggccacagccaggtgggcactcaagcatcctgtttatggcattgtgatactacggttgggaacttacacaaacagacccaacgtttccaaattatgttctttcatcagttcaatgaatccatccattcttatctcggacgacgttcctaaaggaaaattctacaagattccgcaacaaacattatcgacaaataacgaa

SEQ ID NO: 44812 - DNA, 219 bp, Glycine max
  Peptide Sequence Number=SeqID_136497
atgcacacacaaggtttcacaattccacaattccttagaataggcctaactcacaaaaaggtccccagtggagtcgtcaactgtcgcaacatgcccttttgcgggcgagcgaaggcgaggctcatgggtgcgctttccaaaggaggaaagatgcgtggagtcgccaccaacatttatttgtgggaaacgtcggaaaaccaaaggaaccgatcgaaatga

SEQ ID NO: 44813 - DNA, 435 bp, Glycine max
  Peptide Sequence Number=SeqID_136498
atgcgggggtccggggaatttgtccccttcttagatacgacgtctaggggtagcaaaatgcccccacgcacgtttttaagaaggcgacacggaccctccgttggttctccacctgcctccactcctcctcctcctcctcctccttctcctcattctcctcctcctcctcctcctccttcagacgcatcggctttgccgtctgccgtgaagcggacacgcaaagcctcacgtttacgatcgttgtccactagaccacctggtgctgagagaccagtggtgcatgttgatcctgctatatggaaggccgacggtccccacaggaagaaattaagaacatatttggagattgtggcgcgcgataaggtggacgtcacctacgagaactggaaggaggtccctactgctcagaaggacctgatttgggaggatattcag

SEQ ID NO: 44814 - DNA, 846 bp, Glycine max
  misc_feature (526)..(526): n is a, c, g, or t
  misc_feature (565)..(565): n is a, c, g, or t
  Peptide Sequence Number=SeqID_136499
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccaaactaggctgcaggttgccacaaaggatgctgtagagagaaatgtgttttctgttgcaaaaggactacttaaaacagacggcatccctggtttgtatagagggtttggcacagttatcactggtgcaattcctgccagaatcatattcctctccactctagagaccacaaaggtgactgccttcagaatgcttgagccatttgggtaccgagctcgaattcgtaatcatggtcatagctgtttcctcggtatcagctcactcaaaggcggtaatacggttatccnacagaatcaggggataacgcaggaaagaacatgctccgnccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccgg

SEQ ID NO: 44815 - DNA, 726 bp, Glycine max
  Peptide Sequence Number=SeqID_136500
atgggtcaacttcaacggcaagcctttcgcaaagcctatggtaagatttgggacctagctagggtagaagtctccatggaaccgattgcatccctttcccagtattatgaccagcccctaaggtgcttcacattcgaggacttccagctagtgccgactgtgaaagagtttaaagaaatcctgggatgcccactgggaggaaggaagccatatctcttctctgggttctatccctccacgacaagagttaaggaaagtgtttggaggaaagggcaaaggccttggaaaatcaaggcaaatgggctttcttttattgacatcttggcgctttttatctttggagttgttctctttccgaatatggaagggttagtggacctagcagtgattgatgctttcctctcctttcatcatggcaaggaaagcccgatcgtcgccattttgtccatgtatgacacgttcgaccggggatgtgaaaagagcgatgcaagaattttttgttgtgcactggctctctttgtgtggctggtttcacatccttttctccaagaaggtaggcccgtctatccgctacaaggtcaccgctcgggcgtcgaaaaaggaaaggcgaattgggaccaactcttggctagcatggaggggcgtctgttaattggttccctcgctagaaggaaggaagaatcaggattctatcttcatgcgaaggatgtccaaatgttctcttga

SEQ ID NO: 44816 - DNA, 198 bp, Glycine max
  Peptide Sequence Number=SeqID_136501
atgacaagggctagatcgtggaaagccaatgaagctcttcaacaagtgttgtccatactatttgaatacaagcccaagtttcaaggaaaaagttcaagttgtaataagggcccaattggcaacctaggcatcagccttttgggagaccaaatggtggctggcttgatggctgttggaggtgacttttggttgccataa

SEQ ID NO: 44817 - DNA, 375 bp, Glycine max
  Peptide Sequence Number=SeqID_136502
gttctggaattccatggagagttgggggtttcggttcgaaggttataaaatgcggtgcgggttcatctctctcgaccagttcagggaaagacggattggatcgagaggcgatgcctactctactcgttaccactaaacgacgaagccaagagcggaaggagggacttgaaccctcaacctcagccttggcaaggctatgctctaccattaagctatttccgccagcaacggtagtggcgaagcactacggagcaattaacgggcggctgccttttcaatcaatctccggccgctcagtgccgctattggtgcgagttgtacggagtcttgggtctcgagtcgagctggggcgtcctttcattctcgtaacgggga

SEQ ID NO: 44818 - DNA, 102 bp, Glycine max
  Peptide Sequence Number=SeqID_136503
atggtgatgcaatcctaccccccaagggcattggatagaagacaccaagaagattgggctagagatgtaagagaaggccttaaggttctcatgagcttaagg

SEQ ID NO: 44819 - DNA, 915 bp, Glycine max
  Peptide Sequence Number=SeqID_136504
atggcggaaccatcgaaaaagcggaaaggaacttcgactcggagtcagcggcattctgggtcacaggaagcaccaattcctccctccattccctttggatcattattctcatcagaggaacagcatatacggtacacaaacctcttttcctctcgttccattgtagacccaaaattcatagatatggagttcttctcaaatgagaattttgaatgcttccaagcatttgaaaactccaatcttattccattcatgtctctgaaattacatgtctattatgaattagtcaaagccttctattctaatttagaaatcatgaagggtgcactaattgatgaatggaaattcgatttctctgtgcatgatgcccgccggttggtttgcaccaaccaagcggatatgaccggaaggcttcttgccgatctcattgtcatgtgggcctttcataaaggtttacaaattgattgggcacatcttattagatatcgcatgcataaggcattgcgattgaatgccccattgccttatcctcaccttgttaccctcttccttcaacatttcaacatccctcttgattctgaaccttatgttccaatcaagagatcattccttataggcgcttcagtcatagcatcctttggttatattaaggagcatgatggatcatgggtaaagaagggtgctagaaatattggtgaagaaggacacgagggagaagattcatatcttctttcaaagattttggaaaggtttaatggtcttcaaacctttgttggtgagaggtttgatactttggaactgcaagtggatatgcgcttcaatgaaatggagtcaagaatgactaaggttgaagaagatgtatcttacatccggttaagctttgatcttccaccaccgccgtcaccatcatcttag

SEQ ID NO: 44820 - DNA, 1311 bp, Glycine max
  Peptide Sequence Number=SeqID_136505
atggtcgaagcggccaagaatcaccagaagattgcctcgaacattcgcgaattagttgtctcacctttccgtcgctggtgcgatcagcatgaggcacgaatccagaattcacacgacgaccttcaggctcgtatcaaagaacacacaaaacaggcggacttggtcaagaaactgcggagccactatttcaacaaatgccgtgtggtggaagacttggaggaagagaacaagctcgcattccaggctccggaggctagcccgccagtcaaagcgcctcccaagatcgtacttccggaggaggcagaggatgaagagcctatggaaatcggtgatcacgtctacacaccagagggtctcaagcagctgttggtgcacatgctggataatatcaagatgggtgatgtcaaggtgcccattatcggcacgtaccagaatacatcgaccggtgccgacatcgtggaatacacccagaaacacatgaatgccactagcgtcagctatgcagaaaggattgggcaggatctcgtcgacaatggcctgctccggttggtgggtaatatgggtagcacattcgctaatagcagcaagatgcgataccaatggcgccccaaagtgttccagatcactggtattcccgaaaagaagacgcctctcttgcgtgtaacatcgatggcgaacagcgaggacggcagcgagtccccgatatctactgtttcggaaatgttggcaggctggaaccctctcaacaatgctcatccgaatgagacgccggcagagaagctgcgcagagaagcgcgcgaggctgatgaacggtacaaggctgctgtgcggaagctggaccagatcagatgcaaacttgaggaagagatcgtggagaatctccggtttatggaacagtgtgagctggaccgacttaaggcgatcaaggcagttgtcctcgatttctccggtgcaatcagcaacgtcatccccaatttgcagagcacagtggaccatatgatgctttaccaggagactatccagcctcttggcgatcttcggtatcttcttgagaattaccggaccggaggtttcgtgccccgcgtccaagcatatgaaaactattatggctccgtcgaaggtatgatatcattaattaggtcttgtgcaaggtggacaataactgacccgtcagatcaaaatttcggcgtggaccttgaggcccgagcaagagctgatcgcaaacgggtccctgtcctggttactacgctcttgacctatcttgataatcgtaagattatagcagttcctgacttcaaacattggcattaa

SEQ ID NO: 44821 - DNA, 1092 bp, Glycine max
  Peptide Sequence Number=SeqID_136506
atgagtgatgatcaaacggcagtgcgttttggtattcttggatgtgctaacatctccatcaagctatgcaaagccctaagcaaagcaccaaatgccaagctccatgccataggcagccgttccctcgagaaggcgacggcgttcgcggctgagcacggccttcccgaggctgttagggtttacgggagctatgagggtgtgttggaagatgaggaggtggacgccgtgtacatccctcttccgacgggtttgcacgtgacatgggcggtgagggccgcggagaggcggaagcacgtgctgctggagaagccggtggcgatgaatgtggcggagcttgaccggattcttgaggcttgcgaggctcatggggtgcagttcatggatggcaccatgtgggtgcaccaccctcgaacggctaaaatgaaggaggctttgtctgatgctcaacgttttggtcaactcaaatggatacactcgtgcctcacgtacaaccctggtcctgaatttctcaaaaacagcattcgtgtgaagccagatttagatggtcttggtgccctgggtgacactggttggtattgcataagagccattttatgggctgtgaactatgaacttccaaaatcagtgcttgcattcccaggagcaattctcaatgaagaaggtgtaataatctcttgtggctcttctatgcattgggaagatggaagatctgccacgttccactgttctttcttatcctatgtaacttttgatgtaacggttttgggaacaaaagggtgtcttcgtctcaatgattttgctcttccatttgaggaaagtttagggtttgggaaatttttggaggcctcagagttggattatgggaagattgaacagggaatgtggtgtccaaagccaaatgagcatgttgttgagactgggttttctcaagatattttgatggttaaggagtttgctgatttggttcgaaaggttcaggggtgtgaaatgaagcctgagaagacttggccagttttgagtaggaagactcaggtagttttggatgcagtgaaagaatccattgagaaaggttaccagcctgttgaattgtga

SEQ ID NO: 44822 - DNA, 141 bp, Glycine max
  Peptide Sequence Number=SeqID_136507
atggacacccgtctccgtgtgattggtgatcccatgaatgaagttcaacgggggtggggtcataacccactctctgaggattcacctagtgagtatggtggtggggccgccattgtgagatatggattaatctctaagtga

SEQ ID NO: 44823 - DNA, 207 bp, Glycine max
  Peptide Sequence Number=SeqID_136508
atgactgcgataaaggcaaatggttttaataataaagatgacaacggtaaaggcagcttcaatgagatggaggggcgtggcagagaagtggttgtttcaaagagaatcataaaacggacaagtgtagtgaaagatttaacatttaatactctctcaacgtataagaccttccaaatccaatacaagaattttcatggtgccatataa

SEQ ID NO: 44824 - DNA, 423 bp, Glycine max
  Peptide Sequence Number=SeqID_136509
atgactgtgttcattgttgtgttgtctgaatatgtggtggatacaattgaggatgcatcagattcatggggtttgtctgtcagcttcctcagcataatcttgctactaatagttggaaatgcagctgaacatgcaggagcaatcgtatttgctttcaagaacaagctagacatttcattggctgttgcattgggttcagcaactcagattgccatgtttgtgcttatgcaattacacaatataggtcccattatgtgtaatcattgcttggataatacctatcaatatggacctgaatttcaacctcctagagacaggttcccttgcattggcaataatagtcacgggcttcactttacagaccaagctgatgttactaacatcacacttaaaccagccactaatgcagttttaagcgcttaa

SEQ ID NO: 44825 - DNA, 918 bp, Glycine max
  Peptide Sequence Number=SeqID_136510
atgagctgctttagtgatctaaatcccctctggcagcctcttggtaaggacacaattgaatacttcactctgcaagatctttgggactgctattatgaatggagcgcatatggtgctggtactcctgtgatgttggaggatggtgataccgtgactcagtactatgttccatatctatctgctatccaaatctacaccaacaagtctgttgtcgcttctcgcaatcggagagaggatagtgatggagttgaatttgaaagtgattcatggagtgaggatagttcaagtgataacctatctagatcattaagtaacaattccagcaaagcttgggaggatgctgtttctgaggattcaagctgtgaccaggagggttcatggctaagggataacaagcttggctgcctttacttgcagtatactgagatggcttcaccttactcgagggttccacttgcggagaagatagacgagttagctcgaagtcacccggcattattaacattgaagagtgtggatctttccccagcaagttggatggctgtttcttggtacccaatttatactgtcccatgccggaacactgaaaaggacttggaagcatgcttcctcacttaccatacattgtcatcatctttcgaagattgtgcaatggagtgtgatgacattgacatagggaatgatccacattgctccatccaaggagagaaatgcaaggaaaagaacagtggccatgtctctctccttccatttgggctagcaacttacaaaatgcaaggagacatttggctaaaccctgaaccttatgacaatgaaaagatatcctatctgtacagtgcagcagactcatggttgaaacagctcaatgtccatcaccatgacttcaactttttcacattacacaacaacaccttgtaa

SEQ ID NO: 44826 - DNA, 1379 bp, Glycine max
  Peptide Sequence Number=SeqID_136511
atggcaatggggcgggtcgggtacgggtattgtctccccaatcccttaccccgacttctcaacatatccccatacccgtacccgatacccgaagggtttgagtttattgtcccatccccgtacccgtcggtaatcccatacccgtacccgtactcgacttttggttatcggggaaaacccgaacccgaacccatacccggtcaactcgggtattacccgtcaaagtcgggatggattcaggcggtatcctatgaggtatgcttttctgttgatccattgaaagtccagcagtgtggatggtcacacgctgcttctgtcccttctgaggaaccggaagccccaaaaggtcaaaaaagggttccaagacatgaaaggagagctatggtggagtcttttgtgaacaaagcagagaatgctgggaaattcccaagaatatcagatacccagaaacaagttggtggcagttattatgttatccgggaaatcattcaggagctagaatataaatctaaaatgaattcttcaaacagtgtgaagaagatttttgtggaaaagcaatttgatgagagtaaactacttaccactgaatctgtgaatgtttcatccggtaatattgagattgcaaatgaaagctctgtccaagatgattctcaatcagtagttttagatgacaaggagagtgttaacactgtatatgagcatcttgaagaaaagagagggccacagacttcctatttggagaggaggttgtctgacgaggttgaaattatgtctacaccagagccttgcccatcaagtctcgatatgccaaatgatattaagactgaggaagttgtctctacttattctgattcttttgcacctgaacattctcaagaggaaagaaaacattctcctttatttagtgaaaatgatggtactggttatgacaaagctcagggtcatgaatatgattttgttaatatggaaaatcatcaaaatgtggaggaaaaatgcattaagaaagcagattgtgagagaagggagcaacctgacttggaagacctgtctagagagcttttgcattcaagtctcctggagccaaatgatgtgaagagtcgggaagctgtatctaattcttctgattcggttactcaagaaaggcacccacttaaagaagaaatagaccaattttctgcttcttttattgaaaaatctgtaagtagttgcagcgaaggtcagagccatgattccaagtttgttgatatggaaaagcattcagcatttgtgaaaaagagctttgagaaaagatacgagagaaaagaccaagatgctgtggatagtttaaagcataaaatagagcaatctcaaaggtctttagagtatgatgaatccaaaat

SEQ ID NO: 44827 - DNA, 474 bp, Glycine max
  Peptide Sequence Number=SeqID_136512
atggtggaccgtggctctttatgggggcttgttcttaaaactaaatatgggaatgtgcttgattctccaaatgtgaggcaatctcagatggaatccatttggtggggggatattatggatgtgacttggtgtttggagtggtggggtgttgagcatggttctcttgggagtggcaacttgatgcataatgaggccgataaagtgttgtggaaaagagattcaataggggatttctctgtcaaattggcatatgattttgtgtcatttgatctttctcttgttgaaaatcttttctatcgacatatttggaagctttatattccaaaaaatgttggtgagttcatttggagattgtcacttgatagattgccaacatgtgataacctgcagcagtgtggaatcgtaacagattctgtaatgaaatggaagaaaacatggaacacttgttgtttacgtgtagattcgcatcgttag

SEQ ID NO: 44828 - DNA, 774 bp, Glycine max
  Peptide Sequence Number=SeqID_136513
atggctttgcgatcatgttcctcttccttgagctacgatgtgttcctcagcttcagaggggaagacacacactatggtttcactggcaatctctacaaagctcttgatgacagaggaatccactctttcattgacgatgaggagcttcagagaggagacgaaataacacctgcacttcccaaggcaattcaagagtccagaattgccatcattgtcctctctaaaaactatgcttcttcctccttttgcttagatgaacttgccaccatccttcactgcgctcagaagaaagggttgttggttataccggtcttttataacgtcgatccttctgatgccagacaccacaaaggctcaatagtatcttcaaaggtagataagtttagtgccaatagtagcctcttgcataatgatttcttttcaacaagtttcacgcagcttgctcaggtggaaactttaagtctacggggcaataatttcacattccttcctggatgcataaaagaatttcaacgtttaagaagtcttgatgtgagttattgtgagcatcttcaggaaattagaggggttccaccaaacttaaaaagaattcagggcaagagcttgcatatccttgtcttcctcgagttcaagcatatccctcttctggtactgcttcttgcggagatatattcagagactaccttgatagatttgttcttgggttttgggttaagcttggggaatgttcctcaaatgatgaggctgaaatatggggtgtttatcatggtatga

SEQ ID NO: 44829 - DNA, 885 bp, Glycine max
  Peptide Sequence Number=SeqID_136514
atgcatgtctttgaaatcaaccctgctgatggcaaggatgttgagggtacaaattctggatgtagtgttcaaggttcaactgtggactcttcccaattagagccttcagtaggaaaagctgaaactcaaccacaactattggaagaaaatgccagaagtggggactcctttcatcttgagctttcagcagatgaaactgaaactctagcacagcctactgaagagaatatcagaacaaacttgggcaatatgttctgttccattcttatgaaactatgttcaatggcgaataaaacttctgaatctgctaatcctgggaatcttttagttgagactgatctggtaaattttgatacaacatctttgatagctcttgtatcaggaattagtaattgtggaacagagaaacttttggccactccagagagtgacatgaggcagcggtttaagggaaactacgattttgtgattggtcaaataatgtctgaaattcaaaacccaatccatatggaatttggtagaatcctttgtgggaagaatggcctaatttgtgagagtgttcttatggaatttaaggagttagtatcaatgtgtggagggcccaatgagaaactgagatctgacaggttgataaattgtctcaaacgcttgaatcaagtgtctgttgatgctatttcttgtcgtattgtcaatgcctcaaaacgcatgatggacctcccaacaactaggaagctggcattgaaaaacaaggttgtctttggcaccggtgaccattggcatgccccaactttaaccacaaatatggcatttgtcagagctgtttcacagacggggatgtccctttctacctttgaacatagaccaagggccttacctggtgattag

SEQ ID NO: 44830 - DNA, 1512 bp, Glycine max
  Peptide Sequence Number=SeqID_136515
atgggctgcgtggtgtcaactacgaaggactctggtggaaatagaaggaggccagggagtattggtgaagtttcagtatatgttcctggtttgaggattcctaagcctgttgattttgctcaatcacttggcaattatttgtccaagaatatagtggaacacctgtctgctcttagaatgcgcatagttataatggctggtcaagaaggtcctacaattacaagaacaaaaagaaaaactcagcatggaggttcaatgctggctgatcttctgcaggctcttgaagattacttgcctgttgttctgggattagttaaggatggaagccatttacaatataaagtacaatttacttgggtgaatcaagaggatgacaaagaggaaacaaccatgtctaatgcttggtatgaggtgttgtcagttttgcatttgatggcaatgctatcactatcacaggctaacttgttactgcttccaagatcatcatcctctgatggtcatctgccaaaagtatcagaagaaagcagacgaacctctgttgatattttccttaaggctgctgggtatttggattgtgcagtcaaacatgttcttccgcagttgcctgtggaactcaggagaaatttacccgtagacctagcagaaggagttcttcgagcactctgtctacaagcattaggacagaatttgtgtgatggaatatatctgtatggtgaatcttcctgggagaaaagttctgtgataccgatattgaatggaagcttggagaaggaaaatggtatagatatacaacttggaatggcaattgatagtaccaaagccactcttgcagttaagcgtaggcttgcatgtgagatggtgaaatgctggcagcaggctcaagataacattatgaatcttccattagcaaatggttggggtgaaaaacattgtctttttgtgaaatggaaatatgttgaagcaaagactttcttagtggtgagaaacagtgtgatttggatatatgagataaggtatctgcatggtagttgtggtgtggttgtaaatgctcaagctgcagcatattattatcatggtttgattcttgatgagggaaatacagaaaaatctcatgggatggctgtagctgctttgcaagcagcagatgagtattacaaagaaagtaagaagttgtgtgaggcattcaacgcagcatctccattgtcaagaaaacagggtttagccttctttaagaacttgctgtaccaacagttagatgtaataaatcccccaccttgggggaccgtgaaatatctctctgaaaaaattcctaaggatacttcaagcaaggtgcgaataaaccgcgatttgtactcttatgaaaggatcatggagacagcaccaacattgcctgatttttcattggccttgaaaccagatgaatatcaacttcctcaagtggactcatcttggagaacagagaacataaaagtgggacaaactgatcctaaccatctcaagggtgacaagtga

SEQ ID NO: 44831 - DNA, 2298 bp, Glycine max
  Peptide Sequence Number=SeqID_136516
atggtgaagttgggtccttacgatggtgaggttcggtccatggggacgcctggagttactggaggagtgaggtgggacagtggagttgtattggggaagtttctagagcattctgttgactcagggatgcttgttttccagggaaacaatattgttgaattgggatctgtgctaggatctgatgtagtgtacagtgagggggatgttttggatctgctagagacccttgtgcagctctctggacctaatacaacaatttttttggcgggagaactccgaaatgatgccattcttgagtatttcttagaaactgcaacggataatttcactatcggccgcttggatcaaaagctctggcaccctgattattgcagcaatcctgcagtggcatggagagctggggaagcattggtgatggaggaagtagaagtgagtcctccccaaccaatggagattaggattaaggttgtctccacctctctctgtcgcagtgatctctccgcttgggaatctcatgccatatttcctcgcatatttggccacgaagcatcagggattgttgagagtgtgggacagggagtgactgaattcaaagagggggaccatgtgctaacagtattcattggagaatgcatgtcatgcaggcagtgcacatctggaaaaagtaacacttgccaaattttgggattggaaaggaggggtttaatgcatagtgatcagaagacacgcttctcattaaaagggaagcctgtttaccattattgtgcagtttcaagtttcagtgaatatacagtagtccattctggatgtgctgtgaaagtcagcccccttgcacctcttgagaaaatatgtcttctgagctgtggggttgctgcaggtcttggtgcagcatggaatgttgctgatgtgtcaaaaggatcaactgtggtgatttttggtcttggaactgttggcctatctgttgctcaagcttccaaactaagaggtgcatctcgaataattggtgtggacaacaatccacagaagtgtgaaaatgccaaagcttttggggttactgaagttgttgatccgaattcctacaaagaacctatagctcaggttattaagcgcattactgatggtggggcagatttctcgtttgaatgtgtaggtgacactgatacgataaccactgcattgcagtcatgctgtgatggatggggtttgactgtaacacttggtgtgccaaaggtgaagcctgagatgtctgctcattatgggctactcctaatgggaagaacattgaaaggatctctatttggaggatggaaacctaaatctgatcttccttcattagtagagaagtatctcaacaaggggaatctaactttcattgatgatgaggagcttcagagcagagaggaaataacaccagcacttctgaaggcaattcaagagtccaggattgccatcactgtgctctctataaattatgcttcttcctcatttttcttagatgaacttgcctacattcttgagtgctttaagaggaaaaatctgttgaaaggtagttatgaagaagcattgactaagcatcaggaaaggttcaaccacaacatggagaagttggagaattggaagaaggctctgcatcaagtagctaacttgtctggctttcatttcaaacacggagatggatatgaatacgagtttattgggaggattgttgagttggtctccagcaagattaatcatgctcctttacctgttgcgggttacccagttggactagagtcacaagtactagaagtaaagaagctttcagatagaaaaatcaaacaaacatgggttacaacatcttcaaaacatccttctttgggaaatacttggagggaaggaagtcaacttaacaagtgtagaacaaggagcttcaatgaaggtactctggattctagaaaacctgattggtttggtccaggtagtagagtcatcatcacctctccggacaaacaactgctagcatttcatggggttaaaagaacatatgaggtgaaggttgaagatatactttgtgctcattatgttgattgcatgaaatatcatattggagtgttggttgaaaaatctcttagttggtatggtagagttacattacatgacttgattgagcagatgggtaaagaaattgtgaggcaggaatcaccaaaagagccagggaagcgcagtagactatggttaccagaagatataattcaagttttggaagtcaacaagggaactagtgaaatagaaatcatgtctggatttgccgggatttga

SEQ ID NO: 44832 - DNA, 396 bp, Glycine max
  Peptide Sequence Number=SeqID_136517
atgccactggtcaccctactacgacgggtttattacgaccgatgtaaaatgcgcgtcataaaagacttttttttagtagtgttgtcaccttctacctttcctcttaactcacattctcactttcgttgtccacaaacactgtcttctttctccgctatggtaatatgtaaaggtgattatgtgatgcctaaagccttcaacttaaggcaaagcttccacactcaacaatctaaaaaacaagatgggctgccaactcttcaacaacaatgggagcctcaaacagttgtcacgaaacaaagggcacatggtagacacaacaccggtgacacaatggtggacatcgagcggcgcggtggcgaaaagtggtcgtcaaagtggctcgaggcgcaacactga

SEQ ID NO: 44833 - DNA, 672 bp, Glycine max
  Peptide Sequence Number=SeqID_136518
atggtggaagttgttgtcggtgagatgtgtgtggtggcattgttatcgatggtggttgaggggaactccatcgtcatcgttgcgaaagttgttgtcagtggtggttgggaacaggcagaggtggtgacagcgacgagaagaagaaacttagatgctaagagagagattggatgtcatggtgagggtggtgcaaacacagtggcagaggagagtaccgccatcaccaaccatgaccggaagggggttaatggcggtggtgggaagaatgaggaattgcgcgaccctagcttacatgaaattatggggtcggcggccaatggtttaagcaagctggtcacaatgtctggcactggggaagatagcaagagctccgagttgtcgtcagcgatgaagaaatgtaggcgaggaagaggagtggccaaaggagaaggcgacgagaaacaactaggacgctggtggtcctggagtttatcttcctgcaacttagagagcacaatggcttgtggcaacgataacgagataatcattgacggttcccttttgctggagcttgaacaaagccttgtggggattgtcgtagaaggatggcgtaaagttggattcgaggtgagtgcgacggcagtggagaaggaaggtggtgacaacggcaagaagaagaaacttagatgctaa

SEQ ID NO: 44834 - DNA, 711 bp, Glycine max
  Peptide Sequence Number=SeqID_136519
atggttgaggcaaagaagagaaacttgacaccatcagttccctctataaagttcgatgcaattgtttctgcagatgcttttgagaatttgaaacctgctcctgatattttcttagctgcatcaagaatattgaatgtgcccccaatgagatgtacaatgctaatctatttcttcattccagataccgaatcagccaaagtatcaagacaacagcttaaagaagcaatttatgcttccttgtttgacattaatgtccctgttgtttgtgctatcaaccagaatttgtttctgctattgagtatattgagtcacagatgtaagaaagtgagatcgccaaagcacttgattaagtgtagtagaagttttactctctgtcgacttatgagtctagacattggagcaaagaaccttgtttacaactattcaaattatcatctattaaatgccactctggctctgtacgctgcgaaacgaacttttggaatagttccaaacgcggcactacaaaaactcattcttcttcttctttggccaagttattccttgatgacaatttcacgctctcaagcctcaagcttaagcaaccctctgattcaggcgcttcacaatccttatctctctctagtgaagggactttataatcagattggattcgttatgttaatgtggtggagattattgatgatgacgcagcactgttggagaatttag

SEQ ID NO: 44835 - DNA, 327 bp, Glycine max
  Peptide Sequence Number=SeqID_136520
atggctaagaaaagagggttttccctaagggagaggctcaggctttggatttcttcactggagagctttgagactcgcgcgccttgggcttttcctcgtggaccttctcgtgctgagcccgacctgcgcgctaagcgagagttgcattctgagcgagacttcatggtgagcctggactttcccgctaagcgaaagttgcatgctgggcctggattgtgcactaaacgagttgtccaattcttccaattcttcttcaatgctttttcttccacatttttcatcaattttcctctaaagcacttcaattcttcttttgacttttgctaa

SEQ ID NO: 44836 - DNA, 726 bp, Glycine max
  Peptide Sequence Number=SeqID_136521
atgaagatgacattggtaacattggtccttatggttgccttgagcacaaaggcacttcttggtgcagctggtcctgcacctgagcaagtgctggacacatcagggaagatagttcgagctcgtggccttgatatggcaagcacaggtgcagattgcccacttgatgttgtagctgttgatggttaccaaggccagcctttgatctttacacctgttaattttaacaaaggtgtcattcgtgtttccactgatctcaacatttatttccccgttggcacaagttgtccacagaccacagtgtggaagcttaaggactatgattattcagcatcacagtggtttgtgactactggtggtgatttcggcaatcccggttcgcaaaccatggcgaattggttcaagattgagaagtatgaggatgcttacaagttggtctacggtccaagtgtgtgcaacgattgcagttatccatgcagtgatattggaatataccaggatgaatatggcaagcgtcttgctctaagttctgaaccatacaaagtgaagtggccgttagagtggtggaaaatggcgaaaacactttgttctggcttgacagtggatggatgggtgtctaactgtgtattaaaggagaagtatccaaggttgttccaaatcgcagaaaataaattagcacagattgctgaagtggtttccatggtaaatggagggagagcgtatttttga

SEQ ID NO: 44837 - DNA, 492 bp, Glycine max
  Peptide Sequence Number=SeqID_136522
atgaagtacatgttgctagcattgttgcttctcttttccttgagcttgagcacacaacccctacttggagcagctaatgtatcaccccgagccagtattcctgctgctatcacatcaggcaagaagctccaaactggtctcagttactacactgttccagctatgcaaaccatcacaaaatgtggaaagtacgaatgcttgaatgctgaaggccttccacttgccagcattggtgaatcatgccctcttgatgttgtggttgtgcaaagatcttttggcttgccgttgtcattttcacccgttaaccctgatgaaggtgttgttattcctatgtccactgatttgaacttcattttctctattggtcgtactatttgtgctgagtattcgccacatttctgcaaagatgttggtgtgtttgtggatgagaatggctgtaggcgtttggctcttagcgatgttccatacaaagtcatgttccagcgagcctga

SEQ ID NO: 44838 - DNA, 664 bp, Glycine max
  Peptide Sequence Number=SeqID_136523
atggcgatttcgtcgtcgacgcgacagcttgcaccggtgtcgccatcttcaatggcgtgttgcaccaagcttggactcgccagtttgactggcgagttgagggtaggggtttgcagttctcaggctacgtgcagcagctttgcaggaggagggacagctttttggtggaaaacgccagtgctactggcgatttgtgctgcaggaaaatatattgccttgcaaatttgtgatgacgaagacgttgagacgatgctggaaagttttaaacaacaacaagaaatgtcagttctagaattgtacatagaaaaggatgtggctggtggttcaatgtttcattctgcaaattcccttacatcatgtggaaattatgtatctaacgatgacacacaaccgccaacaaatatgagcaatttaaatcttgacgaagatgatgatgatgatgatgattatcttgtgtctaactcatacgttgaagagtctttagacgaagatgacagcgttgacggtatctctgatacagacgatgaagtcaccgacattcctcaaccagtaagaattgttcacccagcagaaggtgcacaacgaattgaaaatccattttggaatgatgctttacattataacaatatcaactggagttatcctgatgaggaggacatttgcg

SEQ ID NO: 44839 - DNA, 81 bp, Glycine max
  Peptide Sequence Number=SeqID_136524
atgacggagaacttagaaatgggggcagaccaggggctgggcggaggccaacgggtatatgtgacagcacaacgtgtttga

SEQ ID NO: 44840 - DNA, 288 bp, Glycine max
  Peptide Sequence Number=SeqID_136525
atgaacggggctaagcgatctgctgaagctgtgggatgtaaaaaagaatcggtaggggagcgttccgccttagagggaaggacccgcgcgagcagtgctggacgaagcggaagcgagaatgtcggcttgagtaacgcaaacgttgaaaaaatacaccatctattcagagtgagtaagggtctgaaagaacaaaactgtctttcaggtttgtgtgtgcgccgcttcccgttcaatttgcaatggctgaaggacaaggcaatagctttttataggtggtctccaaggtag

SEQ ID NO: 44841 - DNA, 911 bp, Glycine max
  Peptide Sequence Number=SeqID_136526
ttgtggagactttacgatatatggtgtcaccacaagcgaggaacacgtggacggttgatgatctcgtgccttacgtcgataagttagcgattatatctgaagagcaagagagaatcactgagccagtgtcacatggtccagcatcagagcgtgaattcccagccccagagtttcacattcttcagtcaagtgttgaaactcgaggcataggcagacgaagggagcctgttgaagccgaacaatattccctacaaatgatggagcgtggtcatggaatgtattacacgccagcaacattttccgaatatccttcacagatgtatcagtatccttttgcaggtcatcatactgatacttctgagacctcacattcgttcggtggtgttgcggaaacacaacctcatttttcatggcccactatgactccttcacagcagcacgatgcccccatggcaacacctaacgccccatttgcttcgcaatggaatgtacccggagcaatacctgatatgggcgacttattaggtgtggatttgcgtcaggagttttctgcagaggctgagcaagttaggggtttaagggatagggttgggtggcttgggtttgggttatggttagggttagaggggtttaagggattaggtgttggattaggggttagggttagaggggttatggttagagttaggagtttaagggttaagggttggattaggggttatgcaacacaaacaccttccttaattctctcactagctaaaaagacttatttgaagaagaaagaaagacatggcagagtcatccctaaccaaccagcagaagaagttttggtgggaccaccaccactgctatgccacagagctgagaccaccattccattatggtgcacactaggctcctacacacgttag

SEQ ID NO: 44842 - DNA, 1050 bp, Glycine max
  Peptide Sequence Number=SeqID_136527
atgtcgccgtcaaacgggttgcagaacggcggcggcggcggtggtaatggggtgagttatatagagcaccaggtttcaaaacttgacactcttgctggtgtggcaatcaagtacggtgttgaggtagctgacatcaaaaggatgaatgggttagccacagatcttcaaatgtttgcactgaagacattgaaaattccattaccaggacgtcatccgccatctccttctcctggtccacatgaagaacctacaaaatcaggagatgctagcagtgagaggaaacccctacgcataggtcaatctgccatgaaggaacctctccagtccttaagactgaaaccacctcaaccgaatatttctccagctatgagcattttacagaaattctatggcctcaaatcttcaaattcaagagatacgttgaatggaacagaaatggcagtttattcatcctcaacttctgatcattctaatggggaatggcttcccaaagccttgccaatttctgacctgccatcagcatcaaatgattaccccaggtcaacaaatttagtgtatgatctactgaccggggatgatgaatatgtgcctcttgcggaaattggggatgcaggagctgagaagtctgatgagaaatctgtccgaagacgtcagaaagctgaagttgataacggagccagtaccccagaaaaaattatgaaagaaggaaatggtaatggatcaaatggtttttcttcaactggaaaaacattagccatgaggccgaaatcggctagtcgagcagcgctgttccctgagtcagaatcaggatggttagattcaattccagtggggttgggagaatctatatttactgatggcttctccggagtgcgcaaatcgtcgagcgcatcaagcctcagagagcaggaaaagaacaattcagcagcagcctggccacctgcaatatggggcttgaaacctgacttgcaagcagccatttcgaaacctatctttgatggtttacctatcccaatatccggccgcagaagcaaagctgccctggattag

SEQ ID NO: 44843 - DNA, 660 bp, Glycine max
  Peptide Sequence Number=SeqID_136528
atgactcctactcttcgaaggaggaagacaaacaacctagggtgtcatatcgaaatgatgaaagagtttcccaatgtcggcaacgatttgaagcatctcttgcaaatgattgatgatggagaagctgttgacataaagggtacatcagaaaagtctttaacgaagcatttgaaaaagttgttcctttcgttaaaccttgaggatggaaatagggttttcttactgcattctaaagctcaccttaatttggatgttgttggccctctcattcaatcctatatgaatatgaatcccatgaatgagcaagttgagacttccacactagtgcctgaatcaagttcaattccaatagatactggaaatgaacagatgatcgatgaccatgcaacaacaggtccagaggatcattctgttggtcctagaagaaggatgattggccctgcaatgccatcagctgaattacctcttcaattcacatctgacgacaatgatgaccattttgatgccaatgtctttagagatattgaattggacgacactaaactatttgtaggaccatcaccacctgctctagtttctgaacgagaatcagctaatgaatactttcaatacaagggatttccgtgccaaagatctactgtttcatctcaaacatgttga

SEQ ID NO: 44844 - DNA, 777 bp, Glycine max
  Peptide Sequence Number=SeqID_136529
atgtgttcctcagcttcagaggggaagacacacagaggagaggaaataacaccagcacttctgaaggcaattcatgagtccaggattgcaatcactgtgctctctgaagactatgcttcttccacgttttgcttagatgaacttgcaaccatccttcactgcgctcaagagaaagggatgttggttatacctgtcttttatatggtggatccttatgatgtcagacacctgagaggtagttatgaaaaagcattggctaagcagaaatggaagaagacggctatcagagatggatatgaatacaagtttattgagaagattgttgagcaggtctctcgggagattaatcccgtttgtttacatgttgcggattacccagttggactagagtcacaagtgctacaagtaaggtggcttttggatgttggaactgatgatggtgtccacatgttagggtttcacggaatgggtggggacatcaacataacaagttgtcaagaaagagctacaatgatacatgataggctccaacaattgaaggttctcttggttctagatgatgttgacaggctcaagcaattacaggaacctgttggaagacctgattggtacaaggtgaaggagttgaatgagaaggatgctcttcagttgcttacacagaaagcttttgaaaacgaaaaagctgatccaaggccttccattggctttggtagtgataggctccagcttggttggaaaaagtatggaagattggaaacttgctatcgaaaaatataa

SEQ ID NO: 44845 - DNA, 660 bp, Glycine max
  Peptide Sequence Number=SeqID_136530
atgactgttgcagaggatgagcatattgcccctattgatctaacattgaaagatccagttaaaactaattgggacgatgaagatgtggatgaaaatgatgtgaaggaatcatgggaggatgaagatgagcctgctccggcacctgcagcacctgctgtgaaaactactgtaaaggctcccaaaaaatcttctgataaagataatgacaagaagggtaagacagtagaaccaataaaggaagaaccattagatcctgtggctgaaaaacttcgccaacaaagattaattgaagaagcagattataaggccactaaagaattgttcagtgggggaaatgaaaaagatgaaaagaaccttgacactttcataccgaaatctgaaagtgatttcttggagtatgcagagctcatctcacacaagctccgtgcttttgaggcagtaatgagactatcaacgacttctctaaaaggggcagatgccaaagatattgcatcttcggtaactgccattgcaaatgagaagataaaggcagaaaaagaagccaatgctggtaaaaagaagataggtggaaagaaaaaacaacttaatgttgataaacctgatgaggattttattcctgctgatcgatatgatgctctggatgattatgatttcatgtga

SEQ ID NO: 44846 - DNA, 462 bp, Glycine max
  Peptide Sequence Number=SeqID_136531
atggaatgcttgatttgtttgttctttcttcagggagagtgcgtggggattctaaagcgcggcgagcaaactgcgtgggttgccatccgtcaaaatgggttccggtctttgggccagcccggtccattgtggactagagtcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattcccgcttcctcgctcactgactcgctacgctcggtcgttcgactgcggcgagcggaaatggcttacgaacggggcggagatttcctgggaagatgccaggaagatacttaacagggaagtgagagggccgcggcaagccgtttttccatag

SEQ ID NO: 44847 - DNA, 711 bp, Glycine max
  Peptide Sequence Number=SeqID_136532
atggagtggaggacatgttatctggatatgacactgatacctttggggttactcataaacattggctaccatgtttggttatgttataaggtcaggacacaggcttccttaaccatcttcggaatagatgccgatggccggtgttcgtgggttcctgccatgatcaaggatattgaaaagaataacattgtagctatccaaaatattcggaacatgatcatgggatcaatctttatggccagcacaagcatccttctctgctgtggccttggagcaatgataagcagcacctacagtgtgaagaagcctctcattgactcaatttatggagcacacggggaatttgtattggcactaaaatatgcaaccctctttacaatattcttattctcatttctctttcactctctctcagttaggtttctcacccagttaagcattctcatttgcacaccacaagatgccatcatgaccttggttaccccaaagtatttgactgagctattaagaaaggccacttttttgaatattgtgggaaacaggattttacacacaggacttgcccttctcctttggatctgtggaccagtgatggcattcttgtgttcagttgccatgttgttggtgcttcataagctggactttgtggctagaaaagaaaagataaaggttggaattaccgaagaaagtggcacacagcctgagatttga

SEQ ID NO: 44848 - DNA, 1149 bp, Glycine max
  Peptide Sequence Number=SeqID_136533
atgaagaagaacacctatacggtggagaattccggtggcagcggcgacggtggcatcaaggcatggagtttcggtaaccaccagcttttggtgagaagggtgatgcaagtaaccatgtccattgcagggcttgctgtgttgtggatgtttctctctaactctgcctcttccattgaatttcataccttctcacattacttcagtgctcagtcaataaaggctggttatgaatcaaagctagagagtgttcttagaaccgcgtctatgaaggataataagacagtgataatcacaactttaaacgatgcatgggcaaagccaggttccatatttgacctctttcttgagagttttcgcctagggaatgagacacaatggcttttgaatcacttggtggtaataacttgggaccaaaagacaaatgcttattgccttgctatgcacaagcattgttaccaagttgaaactaaaggttccaatttcaccggtgaagtatttttcatgtccccaacatacctacgcatgatgtggagaagaactgaattccttacttctgtccttgagatgggatataactttgtgttcacggatactgatataatgtggcttagagatcccttcaaacaattttacgaagatgcagatttccaaatagcttgtgatgctttcaatggcaattcctctgacataaacaactatccaaatggagggtttaaatatattaaatcgaataacagaactatttggcttaacaagttctggttcaactctagcaaagagtacccagggtttggtgagcaggctgtgttcaacaagattaaattgaaccctttaatttcccaaatgaagctgaagattaggttccttagcactagctattttggagggttttgtgagcctagcaaggacctcaacaaggtctcaacaatgcatgccaattgttgtgttggcatagacaacaaagtcaatgatcttaaaattttgcttgaggattggaagaagtatatggcattgcctgaaattgagaagaaacaatcaaatcttacttggagcgtaccacaaagttgcagtacgtcctttgaacgagccaacgaagaaaggaagaagaacaaagggaggttgcaacgggctttggttgaaactgtttga

SEQ ID NO: 44849 - DNA, 204 bp, Glycine max
  Peptide Sequence Number=SeqID_136534
atggatgtgatgtttgtgccatcagggttagtaatcctcctagcatatcatgtgtggttatggcacaagagtcggacacagcccttcaccacaacctttggaagagatgctgatggtcgcagattatgggttcctgccatgatgaaggtattttgcaattatcaagccaacattaagaagtcagagtttggatacaataactag

SEQ ID NO: 44850 - DNA, 1470 bp, Glycine max
  Peptide Sequence Number=SeqID_136535
cacgagaacgcggcggtgaccgtggccaaagatggccgtttggtggtgtacatgggtgacgacgagcgcggcgaacatatctataagtacgtttccaaaggcgtggtcgacgccgccaatccggccaacaaccgcacgctgctggacgaagggacgctgtacgtggcgcagttcgacggcgatgaggccggcacgccgctgaagggcaaagggcgctggattgcgctcgagttcggcaagaacggcctgacgccggagaacggtttccgcgacgaggccgaagtgctgatcttcgcccgcaaggcggcgcagcaggtcggcgccaccaaaatggatcgcccggagtggatcgcggtgaacccgcatgacggccgcgcgtactgcacgttgaccaacaacagcaagcgcggcgaggaagggatgccgctgaacgccgccaacccgcggccgaacaatatctatggccagatcattcgctgggacgagggcggcgacgccaccgccggcaccttcgcctgggacatctatgcgctgtgcggcaacccgatcgcccatccggaaggcgtcaaccgcggcacgccgaacatcacggcggaaaataccttcaacagcccggatgggctgggcttcgatcgcgccggccgcctgtggatcctcaccgacggcaagtacagcaacaagggcgattacgccgggcagggcaacaaccagatgctggtgggcgatccgatcagcggcgaaattcgccgtttcatggtggggccgaagtcctgcgaactgactggcatcaccttcaccccggactacaagacgatgttcgtcaacgtgcagcatccgggagaagagggcgattcgcacttcccaaacaacagcccgcgcccgcaacgcggccagcctgccggcgtggtcgggcgcctcgccgcgattagcgggctgcgtgaagtaacggtggtcttcccagcgcagcatcgtcagatcgccgccccagcagcagcctgtgtccagcccgatcacgccttccggcgtgcccttgccttccagcgaggcccagtggccgaagacgatggtgtattccggatccaccaggcgtggcagatcgaaccacggtttcagcggcgcgggcgcggtgcccggcgcatctttgcagatcatgtcgagctggccgttggggaagcaataacgcatgcgcgtcagcgcattggtgctgaaacgcagacgcgccaggccgctcagctccggcgtccagttgttcggcatatcgccgtacatggcgtcgaggaacagcggcaccggttagcggcgcagccagttgatcagctcgtcggcgtccggggcctccagcagcggggtgatgcgatctttgggtttgttgcggctgatgccggcgtaaaccgccagcaggtgcagatcgtggttgcccaagcaccatgcgcaccgccgggccgagcgaagcgcacaaaagcgcagcac

SEQ ID NO: 44851 - DNA, 225 bp, Glycine max
  Peptide Sequence Number=SeqID_136536
atggagaaaaatgaagaaacaaaaatggaagagaagcttgcttgtgggccttctatggaggctggatctttgagcttcaatgagccatggaagaaggagcttcaccaccaagatgagccttggataagaagcttggaaaggatgcttcaatggaggaaaagaaagagggagagaaagagggagggggagcacgaaattgaaggaagaaaaagggagagaagttga

SEQ ID NO: 44852 - DNA, 777 bp, Glycine max
  Peptide Sequence Number=SeqID_136537
atggcgcagggcatcgtgagcgaagataagacgtacggactgtttatggtcagccagctcgcgatgccggattacaccttgatgatgccgctgcgtatgccggggttagaagccagcgcgcagtaccgcatcacgctgctcgatcacccgaatattcagattacgggccgggattgcgctgccgattctggatccggaaaccgccattctgattggcgtggaacgcgtgtaagggtgacgggccggagacccggccctccgttgaggataaaaataatgaacacaacaacctgtacccacaaagacaaccctaacttctggattttcgggctgttcttctttctctacttcttcatcatggccacctgctttccgttcctgcccatctggctgtcggacatcatcgggctaaacaaaacccataccgggattgttttctcctgcatctcgctgtcggctatcgcacttccagccggtgttgggggtgatttcggacaagctggggttaaaaaaacatctgttgtggattatctccgtgctgctgtttctgtttgcccccttcttcctgcctatatcgaacgcgtaagccgcaacagcttctttgaatacggcaaggcgcgcatgttcggctgtcttggctgggggctgtgcgcctcaacggggggcatcctgttcggcatcgatccgtcgtatgtcttctggatgggttcgggggcggcgctgctgttgatgctattgctggtggtcgcgaagccgaagcccaaccagacggcgcag

SEQ ID NO: 44853 - DNA, 324 bp, Glycine max
  Peptide Sequence Number=SeqID_136538
atgaagaacgataaagaatttccacagaattgcttacggaagcgttacggaagcacttcggcttggattttcttcgcggaaacatgttttttacccaaaatagccaaaatgcatagccaagggatccggaatattttgaaacagcccgccctccctatttttaggaaaaagggaggttttcaaaaattttacggaagccccggaaaccatttttcaaaaacggggaggagattgccgcccagttgcttcctccttaagcaacccaacttccgaattgttccggaagggcctagattcgaattgctatttacacctctatcttga

SEQ ID NO: 44854 - DNA, 563 bp, Glycine max
  Peptide Sequence Number=SeqID_136539
agcagaagctcctggctgagaaaactaagaagaagctggaggaagctgcacagtcaggaagtgttgatggcgttatcaaccctccatcccccatcagacaccacgtgaagtggaagatggcccgcaccaagaaaacatgggagatgacgactgaggctgcaaaggaaattgctgagaagatcgcaaagcaccctggacgtgttcgtgctgctagagtcgcagctgacccagcaaatcagggaccagctagaggagtcgatcacagaaaaagtgactcgacaactcatggcatcgttcagccagatgcagtcccagtttcggtcccaaatgcaatcttagggacttgcactgcctccgaagcctctggaaacgatcctgagacgggtgactcagaaaggtgtggcttatacatcgaagcaaatcctgcccacctggttgccctcactattagaaaatacactttcaacatcgattatttagaacattctacatcggttctaaaaccgatattgaaagtgccgatgttgaatgtatcaatgttaacatcggttttggagaactaa

SEQ ID NO: 44855 - DNA, 348 bp, Glycine max
  Peptide Sequence Number=SeqID_136540
atgtcattgcctagcgctgttcatgtgtcctccattatcaagcgcgaagcctctgaagaaaaagaaggagtagagacgagagtcgtcatcacggaaagggcaggacggacgaaatcagtgtcctatctttgctttcctcttatctccgatgagaggtatgtaaagaggggcaactgtcataccctaatttcgtcgggatatatgatgagggccattctccattctcaatcttttcggagccccatgaattgggttatcgttcatgtgtccccccccttcaagtttggagctatgcgtagagattgcttagggcaattttccattctcaatcttttcggagccccatga

SEQ ID NO: 44856 - DNA, 600 bp, Glycine max
  Peptide Sequence Number=SeqID_136541
atgctcgccttcagaggaccacacgtcctcgcctttagaggactacacgtcctcgccttcagaggactacacgtcctcccttcaaaggactacatgtcctcacgtttagagggctacacctccttgcctttagaagggctacacgccctcgccttcagaggactacacgtccttgccatcagaggggtgcacgccctcaccttcataggactacatgtcctttccttcagagggctacacgtccttagcttcagagggttggacgccctaaccttcaaaagactacacgtcctcgccttcagagggttgcatgccctcaccatcagaggactacacgtccttgcctacagaggactacacgtcctcaccttccgagggctacacgccctcgccttcagaggactacacgtcctcgcctttagagggcatcacactctcaccttcagaggactacacgtcttcgccttcagaggcctgcacgtcctcgccttcaaagggctgcacgcccttcccatcagagggctgcatgccctcaccttccgagaattacacgtcctcgccttcagaggactacacctcctcggccttagaggactgcac

SEQ ID NO: 44857 - DNA, 272 bp, Glycine max
  Peptide Sequence Number=SeqID_136542
attgtgttatatgtggtggagcacatgattctggctactgcattcccatagaagatacaacacatgaagtgaactacatggggaaccagccaagaccaaactttaatgtaggtgggtattctggatttcaacatggccaacaatataatcagcaacagggacagtggagaactcaccctggtaatcaattcaataaagaccaaggtgggccatctaacaggccacagcaacaagggcctagtctctatgacataatgacaaagctggaatag

SEQ ID NO: 44858 - DNA, 1350 bp, Glycine max
  Peptide Sequence Number=SeqID_136543
atgactgctcagaatgccgatgtactggcacaaagcctgaaaccccgccacgtgcgcatgctgtcgattgccggagtgattggcgccgggctgttcgtcggttccggccatgcgattgccgaagccggaccggcggtgctgctggcctatatcgccgccggcgcgctggtggttctgattatgcgcatgctggcggagatggcggtcgcctcaccggactccggttccttctccacttacgccgacaagtctcttggccgctgggccggctttaccatcggctggctttactggtggttctgggtactggtgatcccgctggaggccaacgccgccggcaccattctgcacggctggttcccgcaggtggcggtgtgggaatacacgctggcgatcaccagcttcctgaccatcagcaacctgttcagcgtgaaaaactacggtgagtttgagttctggttcgcgctgctgaaagtggtggctatcgtcgcctttctttgtgccggcagcctggcgctgtttggcctgctgcccggcagcagcacgcagggtgccgtgctcgccgccattctcaccaccatgttctctttcatgggcacggaaatcgtcactattgccgccgccgaatctaacgaaccgcgcaagcaaatcacccacgccaccaactcggtgatctggcgtatcgcgctgttttatctgctgtcgatctttctggtggtggcgctggtgccgtggaatacgccgtcgctgatgaaagccgggtcttaccagacggcgatggagatgatgaacgtgccgtatgcccggcagattgtcgatgtggtggtgctgatcgctgtatgcagctgtcttaattctgcgctttataccgcgtcgcgcatgctctattccctgtcgcgtcgtcaggatgcgccagcggcggcctcgcgcaccacgcgcagcggcacgccgtgggtcgcagtgctgatgtctaccgccgcagcatttctggcggtgatcgccaactatctggcgccgagcgcggtgtttgagttcctgctggccagctccggcgccattgcgctgctggtttatctggtcattgccgcttcgcatctggtgctgcggaaaaagcgcgaggcgcgcggcgagcagctcagctatcgcatgtggctgttcccgggtctgacgtgggccactatggtgttcattgtcggcgtactgacgtcaatgctgttcaatgcgcagcatcgttccgaaattatcgccaccgggctgttaacgctgctggtgctggtcgccagccagatagtgcaccgcaagcgcgcggcgcgtaaaaacagcgaggagatggtagcgctgcgttcgtaa

SEQ ID NO: 44859 - DNA, 198 bp, Glycine max
  Peptide Sequence Number=SeqID_136544
gattgtcatcatcaaaaagggggatattatggaagcaatgctttccaagattattttgatgatgccaaagactcaaattctagaatcaagagtcaagcaagtaccaagaatcaaagagtcgttcaatcaaagcaagtttcaagaatcaaggagtcattcaatcaagactccttcagtcaagactcaagattcaagtaa

SEQ ID NO: 44860 - DNA, 219 bp, Glycine max
  Peptide Sequence Number=SeqID_136545
atggcagcggaatggagaaggaagagagagaggagacgccacttcaaggaaaagatgagtctagaagaagctcaccaccataggaggccatggataagagcttggaggaagaaggagatgaatgaaaggagaggaagagaagagcacagaattttgtgctctaaaagagctttgaaatctgaatccactaatccaagattctccactaagtgtgcttag

SEQ ID NO: 44861 - DNA, 156 bp, Glycine max
  Peptide Sequence Number=SeqID_136546
cactgtcacaacctacccttcggcaggaatgcgacgcgagactcacgggtgcgtcttccaagaaaggaaaatgcgcggagtcgccaccaatgtttattcgagggaaatgttggaaaaaccggaaaatgtgtggtctacgaactttaagtgtgaaag

SEQ ID NO: 44862 - DNA, 270 bp, Glycine max
  Peptide Sequence Number=SeqID_136547
atggagcggtatttacagcacttggttcgccaacaggcagctaaccacagggggcaggtgcagatccatgagtgtctctatcagctcagcctcagtcagcagagccagggtttcgctccttttgcgtgccctactccagatcagttcaggacggaggtcgcatggcccggagattggcctgaggcccaggcaggggaggcgcctgcagaggctcccggcgatgcagaggaggcccgcatttatagttttcatttaggagcgtcgtcctaa

SEQ ID NO: 44863 - DNA, 405 bp, Glycine max
  Peptide Sequence Number=SeqID_136548
atgtctttctccaaccttgcctcgcctccttctcctcctcctacttccgacgcatcagctttgtcgtcttccgtgaagcggacacgcaaagcctcacgtctacgattcttgtctactagaccacctggtgctgagagaccagtggtacacgttgatcctgctttcggcaaggccgacggtccccacaggaagaaattaaggacatatttggggattgtggcacctgataaggtggacatcacgtacgagaactggaacaagatccctactgttcagaaggacttgatttgggaggatattcagactgtcgacgagagatggaggcagtttaaatcagacctcatgaggaaatgggcccttgcagctgatcaggacggtgtggatgacactgtttgtgagaaatag

SEQ ID NO: 44864 - DNA, 414 bp, Glycine max
  Peptide Sequence Number=SeqID_136549
atgatccaacacatcaaacatcagattaaaatttgtttaaggctatcttccattacctatcaaactcaagaaactttctttgagatgaagaaaggaaagaactttggattcaagatgcaagttttccctcactcgtattgtagttctacatcatccacaccacccaaaaccccaaaaaaccaacataaaacacatcaaaaccttgaaagagaacacttttatgaaacttctaaaagtgcctatggaagaaaacaaaagtggaggataagaagggaaatggtagggtcacttacttatgaaattagtccaaattcgaaaaagaagcttagccacaaggtcctttgtgctagggattcaaggtctcacattagagaatggtgggttgtcttggaaaggaaaaagaaagtgaaatga

SEQ ID NO: 44865 - DNA, 1012 bp, Glycine max
  Peptide Sequence Number=SeqID_136550
atggattgggaccagctcttggccgggataggaggtagaacaatcagttggttcccccgatggaaggaaggaaaagaaggagtccttttctcatgtggaaggtacccaaacattccgctggtaggaacgaggggttgtattaattacaatcccacgctcgctataagacaactggggtaccccatgaggggagcaccgacggaagaaagcatgtctcctttcctggtgagggatctcggcgcacaaaattccaagactatacaaagaatccataaggcatgggaaaccccgttaaggaaagatcaagagcttagaggcattcgtaatggcatcattggtgattggctcgccaagttaaaagtcgtcagcgaagagaattttgaagcaccggaagaggacgaagaagtccaagctctcaaaagcgagttaggaaaggcgaaacttgccaaggagaagttcaagttggccgctacacacgttcggaaggagtgtgccgggttacgggaagagaatgcaattactgcaagagcccttgaacaagagaccaagagggctcgcaaggaagagtatggccggaacaaatttcgcggagctctatggggtagcaatagtgaactcaagttgcgaagggaagaaagggaccagtcgcgagcacatggcatggttttgaaagaggagttagttgcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggaccggtttgctcttaccttgaacgggagtcaagaacttccccgattgttagccaaggccaaggcgatggcagacacctactccacccccgaagagattcatgggcttctcggctatt

SEQ ID NO: 44866 - DNA, 144 bp, Glycine max
  Peptide Sequence Number=SeqID_136551
atgaagaaacaacaatggaagagaagcggaaggcaaaggagaagaggagaggggaggcaccatccactagggaataagccaaggaagaaggagcttcaccaccaagaattgccttggataagaagcttgaagaggatgctttaa

SEQ ID NO: 44867 - DNA, 377 bp, Glycine max
  Peptide Sequence Number=SeqID_136552
atggagtttatttctatctcagaccatactcctctagttgtcaccactgagttggtagtgcctagaggtaattctccatttaaattcaacaatgctattgtggatcatccaaatttcttaagaattgttgcagatgtctggaagcaaaatattcatggctgtagcatgttcaaggtctgtaagaaattgaaagctcttaaagctcccttgaagaatctttttaagcaggagttcagcaacatctccaaccgagtagagctagctgaggctgaatataacagtgtgcttaattctctaaagcaaaatcctcaggatccttcccttcttgctctggcaaactgcactagagggcagaccattatgcttagaaaagcgga

SEQ ID NO: 44868 - DNA, 234 bp, Glycine max
  Peptide Sequence Number=SeqID_136553
atggaagagtttgacgcacaggtggcctggccaggacaccatctttcttcctctggagggggtggggcctccatagcccaggagcttgtgactgagaagccaccaccaccagcaccatcaccaacagcaacagaggaggagaccactccaactcagaccccacagccatctccaccatctgcacctgctcctgaggagactcagccatcagcactagatcttaatgaagactag

SEQ ID NO: 44869 - DNA, 518 bp, Glycine max
  Peptide Sequence Number=SeqID_136554
atggggacgaggggttgcatcagctacaatcccgttcttgctataagacaacttggctaccctatgagaggggcaccactagaggatgagctcgcacctgtcatttcacgaggcttcaataagaccaacgtggagacacttcagaaggttcgcaaggcatgggaggtgttgcaaaagaaggacaaggaactcaggggcagtaacaatgggctcatcggtggctatcgtaagtggttaaaagcccacgtgcaaggtttggattgcctcccaagtttgagaaccactaaaagagaggaagttgaggcactgaaggaagacgaagaagtgcaggcccttagggcggaactcgagcaagcccaaacagttaaagaaagggctcgtagggaagaacacggtcggaacaagttccgaggggctctgtggggcagtaacaacgagcttaagctccagagagaggaaagggaccaatcgcgagtagacaatttgatcttgaaggatgagttgaaggcttgctcgag

SEQ ID NO: 44870 - DNA, 483 bp, Glycine max
  Peptide Sequence Number=SeqID_136555
atggcgaggacgtgtagtcctctaaaggtgaggacgtgtagtcctctgaaggtgagggcatgtagccctacaaaggtgaaggcacatgaccctttgacggcgaggacgtgtagtcctctgaaggtgagggcatgtagccctacaaaggtgaaggcacatgaccctttgacggcgaggacgtgtagtcctctgaagttgaaggcatgccccccctttgaaaatggggaacatgtgagggcatgtagccctacaaaggtgaaggcacatgaccctttgacggcgaggacgtgtagtcctctgaagttgaaggtacatgaccctttgaaggcgaggacgtgtaatcctctgaaggtgaaggcgaggacttatagtcctctggaggtgagggcgtgcagccctctggtggtgaggacgtgtagtcctctcaaggcgaggacgtgtagtcctctcaaggcgaggacgtgtagtcctctgacggtgagg

SEQ ID NO: 44871 - DNA, 418 bp, Glycine max
  Peptide Sequence Number=SeqID_136556
atggacaggaggcagaacaaccaccaattctggatggaaccaactatgaatactggaaaggtaggtgaatacctttctcaaaatagcagaacctggaaagctgtcatcaaaggtcacctgggaactgtgaagatgctggacacagaaggaaagcccactcaagaagcagagaagacttgtagtctgagaacagaagaagacgaattggcacttggaaaagtgaaggaggcaaagaggagtctcatgagcttaaggaacagtgttttcttgaactctaaactgccttgggagaaaggcatgacaaatcataaagatgctgcactggagccacgagacaacatcggtctcgacatcaggaacgagaaaaagagcaaaagaatcaagtggaggtgtccaactgatgaaggagaagaagcaa

SEQ ID NO: 44872 - DNA, 819 bp, Glycine max
  Peptide Sequence Number=SeqID_136557
atggagttcttctctaatgagaattttgaatgcttccaagcatttgaaaactccaatcttattccatttatgtctctgaaattacctatctattctgaattagtcaaagttttttattctaattttgaaatccatgaaggtactctaaactctgaagtttatgggatcaagatggtcattgaccaatccctattttatgatttaaccaaattgcctagtgaaggtgtgccttatgagggtgcactgattgatgaatggaaattcgatttcgcggtgcatgatgcccgccggttggtttgcaccaaccaagcggatatgaccggaagacttcttgccggttcattggcttttgaaagtcgcatcctccattaccttatagttcgcattttgcttcctagatcttcaaaccttgcccaggccccattgccttatcctcaccttgttaccctcttccttcaacatttcaacatctctcttgattttgaaccttatgttccaatcaagagatcattccttataggcgcttcagtcatagcatcctttggttatattaaggagcatgattgctcatgcgtaaagaagggtgctagaaatattggtgaagaaggacatgagggagaagattcatctcttctttcgaagattttggaaaggtttgatggtcttcaaacctttgttggtgagaggtttgatactttagaattgcaagtggatatgcgcttcaatgaaatggagtcaagaatgacaaaggttgaagaagatgtatcttacattcggtcaagcttcgatcttccaccaccgccgccaccatcatcttag

SEQ ID NO: 44873 - DNA, 210 bp, Glycine max
  Peptide Sequence Number=SeqID_136558
gtcgactctagaggatcccctaaaggttaaggaggagtgtaaggagacactttttagcattgccacacctcttgggcttgagtttattcctcaaataaaggagttgttggatgaggcaccactcattgagttggtgaggaactatgttctctcatgggaaaatggtattgaggaaagaatccctaagtttcaagaacctctggctttgag

SEQ ID NO: 44874 - DNA, 525 bp, Glycine max
  Peptide Sequence Number=SeqID_136559
atggctccgaaaaagctttcctcaaagagatctaggagggacgctgcggctgaagggaccagtgccacccccgaatttgatagccaccgtttaaggagcgccaagcaccagcagcgcttcgaggccatcaaaggatggtcattccacaaagagagacgcgtccagctcatggacgatgagtacacagattttcaggaggagatagctcgccgacattggacatcgctggtcactcccatggctaagtttgaccctgatatagtcttggagttttatgctaatgcttggcccacagaagagggagtgcgggacatgcggtcatgggtgaggggtcagtggattccctttgacgtagacgccctcagccagttcttgggtgacccgctagtgttagaggaaggccaggagtgcgagtttagattttgcccggaccgctgcagggaggcgggtgcggatcatgcgcaccagcatgattaccttgacccagatgtggataacattgctgctcagcaatgtcttgcctag

SEQ ID NO: 44875 - DNA, 288 bp, Glycine max
  Peptide Sequence Number=SeqID_136560
atgtattgtcggaggatgggggcatacgcaaaagatgagaaattgctgagacattccttccaaagaaagtcttactggggtagctgttacctgggtgaggatgaaggagaagcccgtgctgtgactgccattcctatacagccaagtttcccaccaacccaacaatgtcattactcagccaataacaaaccttctccttacccaccgcccagttatccacaaaggccatccctaaaatcaaccacaaagcctacctaccgtacttccaatgacaaacaccacctttag

SEQ ID NO: 44876 - DNA, 348 bp, Glycine max
  Peptide Sequence Number=SeqID_136561
atgtcgacttacgtacgtctcgttgaccaaacgatcaggctacctctcctatccgcttctctacaaggtctactttcttcttccttcagaccgggccaagcctttagtttaagtaggtttgggctaggtcgttgcgctcctgccacgtcttggcaaaaaagtaggctgatgggcaagcctcctcctgccgcaatggtgtggggcgtcagaggctgttgccccgtggccaactcgaaggggctgaagttcgacgcagagctttttggttgtttaatttatagcagcactgagctacatccaacagctccagtccttctggttggttttgcactaaagtgccttaagtag

SEQ ID NO: 44877 - DNA, 138 bp, Glycine max
  Peptide Sequence Number=SeqID_136562
atggccaccacaccccccgttttgttgaaaaatgggattccggggcttccgggacacccgaagcaacccagctcgcctgggcgagctaaggtcgcctgggcgagctgggcggcaacctcctccccctttttcctataa

SEQ ID NO: 44878 - DNA, 165 bp, Glycine max
  Peptide Sequence Number=SeqID_136563
atgtcgaaaaacctcaaaatattgatgcacaatccgcccatttgggccctccagaagattcctccagaaggcggttgcttctggaggaagcaaccctgctcgcctgggcgagctgagctcgcctgggcgagctgggcggcaaccacctcccctattttgctataa

SEQ ID NO: 44879 - DNA, 459 bp, Glycine max
  Peptide Sequence Number=SeqID_136564
ttgttggaaactgagaagctaccaagttgtggacaattatatattgaaactcataaaaggaaagatgagtcatttgtatatgaagcagcaaagactatagcggaacaaattgaagtaggattgactcaaagcatagttgaagaatatgaagtttctcctcttgatgttgttggtagagtgttagggttagaacactctgggagagtgcgatgcatgggattaggagctgttccttctaatacattcaggaacacaagacttcgagcttttagtctgagctcttcttcatctggtgttgcctttccatcttcaaaccaatggcaagagaaatacaacaatttagaatcagcttttaaggcctacatgataatgaaggaaggaaggatccctgaagaattagctagttatttcactcctgatcaaacacatgtagattttatagttaatcaacaatattaa

SEQ ID NO: 44880 - DNA, 168 bp, Glycine max
  Peptide Sequence Number=SeqID_136565
atggatggcgaggagttgccctcgcccgtgaactccgatcaaggagcagaatcgtctcaggtcacagttagaagtcaagacaagttgactgcggaaatcaaccaaggtacatggggacggatgcaagtggggatagaccgaccaatcgttgccctttcccggcgctaa

SEQ ID NO: 44881 - DNA, 411 bp, Glycine max
  Peptide Sequence Number=SeqID_136566
atggccgctttggagagagaaggtagcgatggacttggttccaccgaggcgcagctcactacctcaaaggattggaaaaccgtttccaatgattcttccgccgcttctacgtatggtgcggaggaagggcagctcactaacatgtcctcttcacccgacactatcactaaaagtccacccactgcaaacttcaattttggtgaagtgtcgaagggaccactcctagcgcatgaatccaaggtctccccaagagacagctataggcgggatttatgtccatcacttgaaacaccacatttcaagtgtgggggcctatttgaatgggaatgtcaatttcccccatcacttcccgccgagtaccatcaaaggctcgtaccaccatcgagcttggttttaaacgtgacacactaa

SEQ ID NO: 44882 - DNA, 468 bp, Glycine max
  Peptide Sequence Number=SeqID_136567
atgggtcaacttcaacggcaagccttcgcaaagcctatgggttctacccctcattggccagaatttctaaaaagtccaaatctcagcgcaggaattagaccgccaaaggcaagtcgaaaatggggtggtcggaataccgagaaaatatttggagggagtcctctttccaaatgtggatgggttggtggacctggcagcgatcgacgttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttttccaagaaggtaggcccgtctatccgctacaaggttaccactcgtgcgtcgaaaaaggaaaggcgaattggaaccaactcttggctagcatgggggggggcgtctgttaa

SEQ ID NO: 44883 - DNA, 321 bp, Glycine max
  Peptide Sequence Number=SeqID_136568
atgaaagtttatgaccaggactcaagcttttcacatgttattggtagtgacgatgaaaataaaaattatattgggagtaaggacattgatgaaaggcaaacaacctttgtgaagggtagacagctgctccatggtgttttgattgccaatgaggtggttgaggaggctaggaggtctaagaggccttgcagccaaggaagcaatttgtcaaagctagcaccgtgcaagcatagcaactcccactatagtagtgctggaaatgttgctgctgaggcaaagcaacattgctactcaataaaaaataaaaaaataaaagtctga

SEQ ID NO: 44884 - DNA, 393 bp, Glycine max
  Peptide Sequence Number=SeqID_136569
atgggggtagacttcctcactagactcttcaccccttacttgatcggcacttccactagaggaagggcaagaagtagtctcctcttgactacaataaatgtcttgacccctcatgatcatggttttctttgtggggcattgagaggcaatgtgacctctcccaagacatttgaagcatttaatgttgctagtcctttcttgggaactagtcttaggggtgcagcccctaaaattctgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 44885 - DNA, 127 bp, Glycine max
  Peptide Sequence Number=SeqID_136570
ggccccattgaagctcaaagatccagcctccatagaagctccacaagcaagttttcatcagataaaggcgaggactttgagtcctgtgaaagataaagacgaggactttgagtcctatgaaagataa

SEQ ID NO: 44886 - DNA, 198 bp, Glycine max
  Peptide Sequence Number=SeqID_136571
atggtttttcacttaaggcttgtaatgagcttcaaaacaaagaaaggggaacataggctcaaaggggctatcaaaggaattaattcaagcaagaaggatcaacaagagtcaagccaaggctattgtgcaagcaatcaatggggcaaaaacacaccgaataaaatagatgatgatggctcaaattctcaccaggggtaa

SEQ ID NO: 44887 - DNA, 303 bp, Glycine max
  Peptide Sequence Number=SeqID_136572
atggggaagaagattctgcagatgggcatagaagatcagaagatcagctttgatttgttccaggaggacaaagatccactagccaaaatgacaatgcgtcaagctagtgacgttaaaagagcgcttactgggaggcaacccaacttttctttctcttttctatttttcattcttatctcttgcataaaaagacttagaatgttttttgcaattgtctatccgctaagcgtagaccatgcgctaagcgctcagtcttcacgtgctaagcccgagcttgctcacgctaagcgcatagacccctga

SEQ ID NO: 44888 - DNA, 309 bp, Glycine max
  Peptide Sequence Number=SeqID_136573
atgtcagtgtctttcggccgagactacgaaaaagtatcattttctatccgtaagactcaaagcacgatagcaagcagtgacttatacgtcgacacctgcacccttcccagagatgtcagcgtcttccagccgagactacgaaaaaggccaacgagtccattgacacgtggagatttacagtcttccgcgctttctgagactcgtgaagtacatggtgacgtacggatgatagcaagcgattacccgcagagatacccaagtggttatccatataaacactctttcgctatccgtcagcatcagagtccg

SEQ ID NO: 44889 - DNA, 459 bp, Glycine max
  Peptide Sequence Number=SeqID_136574
atgagagcagcacttttccttgcgggggccccgtctcccatcggtgcgctggagacgattctttctgtatcttcggcttcgtcttctcctccttctgagcaggggctattgctttttactaggctagacgactcggcgattctaccctacttttttcccaggattggacgcctattgacgaagctcaggattggattgtcgccttactgcttgacgagaacaacctaccacttactttttgaaagtacctctctcattgcactaaaagagtctgtctttgacgatagggcttggaggtcgatcggtccaccactaaggatctatgatcagctgacaaaacagaaaggggattcggactcgcctgggttcatgtctatcgtcgagggatctcagattgcgcttgacctcggactcttagcatgggtggagaattcttcatcttggggaaggaagggggcg

SEQ ID NO: 44890 - DNA, 470 bp, Glycine max
  Peptide Sequence Number=SeqID_136575
aatgggtggaatgtcatgagtggttgtcaatagaggcttataacaagacataccaacattttattgaaccagtccaaggaccacaatatttggccagacacagtatacacatcctgttcccaccacataaaagggtccaaagaggaaggcctaagaaaaatagaagtagatctgtagatgaggacaatgtcacaggacataggctaaagaggaaattggctgactttacatgtggaaggtgtggccaaacaaatcataacatcagaagctctttgaatgaggctgaagaagctgctgctcatgttcaacaagatcctgtggagattaatttatctcaacctcatttgtcacaagatagtgacatggagttgatggtccctgtcactattgttccaccaatagcaaggaataagctaaccataacaagagacaaacaaaggaaggttgctgataaagatgatgcagtataa

SEQ ID NO: 44891 - DNA, 243 bp, Glycine max
  Peptide Sequence Number=SeqID_136576
atggccaaactgagggctgtacatagtagtacacaacactctccattcgatgtagtgtatggttttaatcctttgactcctcttgatttgttaccattgcctaacatttctgattttaagcataaggatgcacaggctaaagttgcaaagaaggtgatgattctaaacattgaagggcaaatgctttccaagaaggagagaatgatgagaatcgtaaaactgcccaaatacaaggacctatga

SEQ ID NO: 44892 - DNA, 1068 bp, Glycine max
  Peptide Sequence Number=SeqID_136577
atggggacaaatcaaaacggaaaaagattctatcaagtcaagattaagggcctagatgtcaccagccttaaggagttgggacggttgatgggacccctccaaaggcaagccttccgcaaagtgtacggaaagattttagatttgaccacagtggatgtatttacggaagccgtcgtatccctcgcccaatactatgaccagtcgttgagatgcttcacgtttggggacttccaaatactactgactgttgaagaatttgaggagataataggatgccttcttgggggaagaaaaccgtatcttttctctgggtttcttccctccttgagcaagattgcagctgtggtcggagattcggcgagagagttggatcgtatgaagcaaactcgaaacggcgtagtgggcctaccgcagaaatacttggaaggcaaggcaagggatatggcgagtcaagaagagtgggtcccgtttgcggatatactagctttgctaatctttggggttgtcctctttccgaacgtggacggtttggtggacctagccgtaattgatgctttccttgcatatcaccgtagcaaggagagcccggtggtagctatcttggtggacttatttgatacatttgaccgaaggtgcgagaagaacaatgcacggattgtttgctgtttacccgctctttgtgtgtggttggtttcgcacctattccaacaagacataaggcacccgtgtccacttcaaagttatcgctcgtgcgtcgaaaagagaagagtagattgggaccaatacttggctgggataggaggcaacataatcaactggtttcctcgatggaaggaaggaaaggagggagttctcttctcatgtggggactacccaaacgttccgttgatagggacgaggggttgtattaactataatcccgcacttgctataagacagttagggtaccccatgaggggagcaccgacggaagagagcctctcgcctttccttgtgagagatttcggcgcacaaagtttcaagatcgtacatagagtccacaaggcgtgggaaagcctgttaaggaaa

SEQ ID NO: 44893 - DNA, 510 bp, Glycine max
  Peptide Sequence Number=SeqID_136578
atgacccaagagctggtagcccgcggagacaccttacggttatccgcacctcgtcattcagtgagcccaagtgtgattgatgagcagaggccgatgtggtcatctgtgccctttctggagatgtcggcatcttccggtggagactttttcaagtctcacaagttatctagaactacaggcggctggcccgatgacacgcagaggccaatgtggtcattctgcacccttttgtcatctagaggcggcgggcccgatgacacgcagaggccaatgtggtcattctgcacccttttgtcatccagaggcggcaggcccgatgacacgcagaggccaatatggtcattctgcacccttttgtcatccagaggcggcaggcccgatgacacgcagaggccaatgtggtcattctgcacccttttgtcatccggaggtggcgggcccgatgaaacgcagagacaaattatggtcattctgcacccttttgtcatccagaggcgacgggcccaatga

SEQ ID NO: 44894 - DNA, 508 bp, Glycine max
  Peptide Sequence Number=SeqID_136579
atggcacaccctccagcccgtgagaggactctaaggaaattgactgcacctgatttcacctacgaaagcttgtgcatccaataccctaatgaggatgtctcgtatgttcttaaaactagactgattcatttgcttccaaagtttcatggccttgcaggtgatgacccacacaagcatatgaaagaattccatattgtctgctccaccatgaaacaaccagatgtccaggaggatcacatatttttgaaggcctttcctcattctttagagggagtggcaaaggactggctatattaccttgctccaagcaacatggagagaagtatgatagatgctgccagtggtggagcccttggagacatgacccctgttgaagccagaaatttaattgagaagatggcttccaactcccagcaatttagtgccagaagtgatgctattgtcattagagcagtgcatgaagtagccacaaattcatccccatcaggcgagactaagaagcttgaag

SEQ ID NO: 44895 - DNA, 502 bp, Glycine max
  Peptide Sequence Number=SeqID_136580
cgccacgcttcccgaagggagaaagtcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcactaatgcagctggcacgacaggtttcccgactggaaagcgggcagtgagcgcaacgcaattaatgcatgcaagcttggcactggccgtcgtttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 44896 - DNA, 399 bp, Glycine max
  Peptide Sequence Number=SeqID_136581
atggtggtcctagaggaagcatcctgtacctgttggggttcctgggctgtgggccttccctatgaagagaaggttgggccccaggctaggctaccttctccagaaactgctcaatggaaggaatggatcctggaggtgccaccacctgccaaattaatgaccgggctcaggcgctcaaaagtgaggctgtcagagacaacccctctggctcgacatagggtggtgatcagagcaggaaacccaagtctagaagagttagactgggctataaaagtcatctggccagaaatgagagctcatatgttcatgtccatgcgagagactaggccaaagatcagcctagctttgtccactgtcaggttagaggtgtgtgatgtgggcaaagttacctgggcttag

SEQ ID NO: 44897 - DNA, 606 bp, Glycine max
  Peptide Sequence Number=SeqID_136582
atggcacgcagagacaaattatggtcattctgcacccttttgtcatccagaggcggcaggcccgatgacatgcgaagacaaaatttggtcattccgcacccctttgccattcagacacagtcgtgtccgatggcacgcagagacaaattatggtcattctgcacccttttgtcatccagaggcggcaggcccgatgacatgcggagacaaaatttggtcattccgcacccctttgccattcagacacagtcgtgtccgatggcacgcagagacaaattatggtcattctgcacccttttgtcatccagaggcggcgggcccgatgacatgcggagacaaaatttggtcatttcgcacccctttgccattcagacacagttgtgtccgatggcacgcagagacaaattatggtcattctgcacccttcgtcaatcgcgaccgacaagcccattgacacgcagagattacatcatcttcagcactcacaagatctgtcatactgactttttgagtcactctgacgagcggaaatacatgaatggttatccgtataaacattcttttgctatctgtaagtcagtacgcttgatagcatgcagagactga

SEQ ID NO: 44898 - DNA, 348 bp, Glycine max
  Peptide Sequence Number=SeqID_136583
atgaatgttgtctttgaggaagaacttgttatttatagtgatcaactccttgtacctattattgttcaagacacaactctagtaatagaatataatgttcaaactattgtcattgttccagaacaagacaacaatgaggttctccctcaaatacctttagagcaacttcaacaatctcaagaagttctgttaaggagatccattagagagatgagaagtgcaatctcaaatgattatattatatttctccaaggacataagaatgacgttggtttaacagaggatgatccaatcaacttctgtcaagctatgctcagttctaactgtagaagcaaggcttcatggtga

SEQ ID NO: 44899 - DNA, 441 bp, Glycine max
  Peptide Sequence Number=SeqID_136584
atgactagaggcaatccatctgacttacaaccctttgatcctgagatagataggacatttcatagattagttaggcatcattttataccttttgatcattctgagcattccattactggtgaatctgtgcattctgttattggtgattttgaacatcctgatcttgagcattataattttgagcattctgattctgagcattctgattttgcacattctgagaacatggcacaacctccaccccgtgagaggactctaagggaagacccgcacaaacatttgaaagaatttcacattgtctgctccaccatgaaacccccagatgtccaagaggatcacatatttctgaaggcttttccttattcattagagggagtggcaaaggactggctgtattaccttgctccaaggtccatcacaagctgcgatgaccttaagaga

SEQ ID NO: 44900 - DNA, 198 bp, Glycine max
  Peptide Sequence Number=SeqID_136585
atggatgtcattacggaatccgtaaagtttcgtgagatttcggaaagaaaacagccaaaaacacaaaaatgggggagtgaacttatcaagataagggacattttggaagttgggttgcttaaggaggaagcaactgggcggcaagctcctccacgttttctaaaaatggtttccggggcttccgtaatgtttccgtaa

SEQ ID NO: 44901 - DNA, 210 bp, Glycine max
  Peptide Sequence Number=SeqID_136586
ggaaagggtgtttaccagtttgtagacaaatacggtgctaatgtcgatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 44902 - DNA, 153 bp, Glycine max
  Peptide Sequence Number=SeqID_136587
atggcgggagattcatcaaagttcacacatatctcttccaagaaaagtgggcatgttacttatggtgacaacaacaaaggtagaattcttggagttggaaaaatagcaaagatgatgatccatggctatggcataaacgtattgctcacataa

SEQ ID NO: 44903 - DNA, 684 bp, Glycine max
  Peptide Sequence Number=SeqID_136588
atggcatcactctatgaccataaaccaaagaagtttcacttggttacataccaaaggatgatgatccattgccatccttcaatgtacctattggtttccttcagaggagttaaagtcctcgcctttagagggctcaaagtccttgccttcagaggactcaaagtcctcatctttagagggctcaaagtccccgccttcagagggctcaaagtcctcgccttcagagggctcaaagtcctcacctttaaaaggctcaaagtccccgccttcagagggctcaaagtcctcgcctgtagaggactcaaggtcctcaccttcagaggactcaaggtcctcacctttagaggactcaaagtcctagcctttagaggactcaaagtcctcgcctttagaggactcaaagtcctagccttcagaggactcaaggtcctcgtcgttagaggactcaaagtcctcaccttcataggactcaaagtcctcacctatagaggactcaaagtcctcaccttcataggactcaaagtccttgcctatagaggactcaaagtcctagccttcataggactcaaagtccttgctttcataggactcaaagtcctcgcttttgtaggactcaaagtccttgcctttgtctttcataggacccaaggtcctctatcatttgcttttcaaagatcatcatag

SEQ ID NO: 44904 - DNA, 503 bp, Glycine max
  Peptide Sequence Number=SeqID_136589
atgggtgatcaagaggagacacaggaacagatgaaagccgacatgtcggctctgaaagaacagatggcctccatgatggaggccatgttaggaatgaggcagctcatggagaaaaacacggccaccgctgccgctgtcagttcggctgccgaagcagacccaactctcttggcaactgcgcaccatcctccctcaaacatacccgacgaggcccataaagaccctcaagactatgctcgaagggatgtcgagttctatcccccgatccccgaagggccggcacccagcacattgcctcaacccaacatcacgacacaaccaatggtcttgtccacggaaggaccgcccccggcaactgaagaaaggaggaagctcgatctcctcgaggaaagattgagagccatggaaggatttggggactatccgttcgcagacatgacggatcgttgcttagtaccagaccgtgttatcaccccgaagttcaaagtgccggacctcgacaa

SEQ ID NO: 44905 - DNA, 375 bp, Glycine max
  Peptide Sequence Number=SeqID_136590
atgaagagagaatctcctctatccctgcattacaaattgtttgaggggacacatgtcccagacattgtctcgacatcaggaaaagctgctgcctcaggtgctgtgtccaaggatactctgattgctgaactcaaggacacatgcaaggtgctggaagcaaccatcaaagccaccacagagaagaagatggagctggaacggctgatcaataggctctcagaaagtggcattaatgatggagaagcagctgagcaagaagatgaagcagctgaggaagaagtagaagcagccgaggaagaagaagaagctgctgaggaagaggaagatgcagcagaggatactgaatcagatgatgattctgaagccaccccatga

SEQ ID NO: 44906 - DNA, 702 bp, Glycine max
  Peptide Sequence Number=SeqID_136591
atggtagctacggcttaccaaacctcccatgaatgttcagaagaaaccattatagatatcttagtggcaggattttctggacaactaaaaggttggtgggataattatctcactaatgaagagaaatcaaaaatttacagcgcagttaagacggatctcaatggaaaagtcattactaatgacgatgataaagagattcctgacgctgttaacacattaatttttacaatagcccaacatttcattggagacccatccttgtggaaagatagagatactttcctaactagggtttacacaagagaagatagtcaacaacctttttggaaagaaaaatttctagccggtcttcccagatcattaggagacaaggttagagataaaatccgtagtcaatctgccaatggagacattccatatgaaaacttaagctatggtcaattaatttcctatgtccaaaaggtagccttaaaaatctgtcaagatgacaaaattcagaggcaattagccaaagaaaaagctcaaacaaagagggatttaggttccttctgtgaacaatttggcttaccagcctgcccaaaacaaaagaagaaacaaacctctaggaaagaaatccaggatcataaaccagccaatagaagaggattttcaaaaagaagatactctcaaaaaccatcgactagtaaggtgtggcgtccctaa

SEQ ID NO: 44907 - DNA, 243 bp, Glycine max
  misc_feature (22)..(22): n is a, c, g, or t
  Peptide Sequence Number=SeqID_136592
atggccttcgtggataactggncggtgggtaaggagaagacccacatcgatccttttgtcggtgaagacctgtcgcaacgtgcccttcgcgggcgagcgagggcgaggctcacgggtgcgctttccaaaggaggaaagatgcgcggagtcgccagcaacgtttatttgtggaaaacgtcggaaaaaccgaaggaaaccagtcaaaatgaaaattctaagttcgggagttgtatttacgcttga

SEQ ID NO: 44908 - DNA, 519 bp, Glycine max
  Peptide Sequence Number=SeqID_136593
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgttgcacgaaacccccgttcagcccgaccggtgcgccttatccggtaactatcgtcttgagtccaacccg

SEQ ID NO: 44909 - DNA, 458 bp, Glycine max
  Peptide Sequence Number=SeqID_136594
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatccccaaaaggagtagagacgagaatcgtcatcacggaaagggcaggatgggtgaaatcagtgtcttatctttgctttcctcttatctccgatgagagcgaggtacaaatagcaatcaggcccacttgggccttccagattcttcctccagaaggctgttgcttctggaggaagcaaccttgctcgcctgg

SEQ ID NO: 44910 - DNA, 504 bp, Glycine max
  Peptide Sequence Number=SeqID_136595
atgttgggatggccactgggaggaaggatgccatatcctttctcggggttctatccctccatggctagagttgccaaggtagtgaaaatctcgacacaagagttggaccgggtaaggcaaaaccggaatggggtagtcggagtaccaatgaggtgtttggaggagaaggcaaaggccttggcaaatcaatgtgaatgggcttcttttattgacatcttggcacttttgatcttcggagttgtcctctttccaaatttggatgggttagtggacctagcagcgattgacgttttcctcgcctttgatcatggcaaggaaagcccagttgtcgccattttggcctacatgtatgacacgttcgaccggagatgtgaaaagagcgacacaagaattgtttgttgtacaccggctctctatgtgtggctggtttcgcacctttattgccaagaaggcaggcctgtttgtccgctacaaggttatcgctcgtgcaccgagaaaggacag

SEQ ID NO: 44911 - DNA, 567 bp, Glycine max
  Peptide Sequence Number=SeqID_136596
atggagagaagtatgatagatgctgccagtggcgaagccctggcagacatgactcctgctgaagccaaaaatttaattcagaagatggcttcaaactcccaacaatttagtgccagaaatgatgctattgtcattaaaggagtgcatgaagtagccacgaattcatcttcatcagctgagactaagaagcttgaaggtaaactagatgccttggttaacctggtgacccaactggccatgaatcaaaaatctgcacctgtcgccagactctgtggtttatgctcctctgccaaccaccacacaaacctttgcccttctgtgcaacaatctgaagcaattgaacagcccgaagcttatgctgcaaacatctacaatagacctcatcaacctcaacagcaaaatcagccacaacagaacaattatgacctctccagcaacagaatgttgctggcccaggcagaccatacgttcctccaccaatccagtagcaacaacaacaacagtaacagccccagaaacaacaaacagttgaggctcctccacaaccttcccttgaagaacttgtga

SEQ ID NO: 44912 - DNA, 380 bp, Glycine max
  Peptide Sequence Number=SeqID_136597
tcactcttttcctccaacatttcaacatccctcttgattctgaaccttatgttccaatcaagatatctttctttattggtgctattgtggttacgtcctttggttaccacaaagagcatgatggctcttgggtaaaaaagggtactcaaccaaatgatgatgaaggacaattaccggttgaaggagactcttctctccttcaaagtattttggacaggttcgatggactccaaacatatgttggtgaaaggtttgatgctttggaagaacaagtggacatgcaattcgatgcaatggactcaaggatcacaaaggttgaagaagatgtcaccatcattcgagactgcctcgatttacctccacagccaccattagtttag

SEQ ID NO: 44913 - DNA, 177 bp, Glycine max
  Peptide Sequence Number=SeqID_136598
atggatcttgtagtcactgtaatcagcaagggaataaatcactttttgaagcaaagaagtgaaactatgattggagtagaatggagaaggaggaaaggtgattgcagataccacttcaaggagaagatgagtcaagaacaagctcaccaccataggaagccatggataagagcttga

SEQ ID NO: 44914 - DNA, 789 bp, Glycine max
  Peptide Sequence Number=SeqID_136599
gagaaacttgtctcagatgatcgtcaactcaaggttgacattcattttccaaatggagttgtcattcacaatgagtgtggggtttattttcaaagttctactccagtgcccatgagagtaccaaacctctgcgatttttcaactcttaaaagcataatacataacacccttcagctaaacaacaatcaagttgtggatgaaattcattatcggcgaccgctcaaagatacaggtaataacattcacttccattgtatgcaattgaaacatgacatggatgtgaacaccatgttaatgtgtaatgatcaattttcatgtgttgaaccgattgagttgttatgcaccattggtagaacaccagatgcaattttaaacttacttgaatgccccagcatccgtactcatgatgcggttctgtattacaacggaaggtggaacatgccacgcccaaacaactttgtgggttacgcgttcacaggaataaatccccaaaaatttgatgttccaaaaggatgtaccatagatgaactgaaggatttgatcaagcaggtaacacctaaagggaatcctcctcatgggattcatgaatcccaacttgtaaggcgtttgttttatcaacaacctgctcatttggagtattctgacaaagttttaaaatttgaaattattgagctgaaatctgacgacgacgtgctgaaggtgttggtagagtccaattactggaaacaatttgcgccaataaaaattttggctttgtttagtaaagtggttttggaaaatgatgactag

SEQ ID NO: 44915 - DNA, 462 bp, Glycine max
  Peptide Sequence Number=SeqID_136600
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcaattcaccccgtatttggaggggaattgaaccacgaccaaatcatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 44916 - DNA, 303 bp, Glycine max
  Peptide Sequence Number=SeqID_136601
atgaccgaccctctcgatgagtcgatctcttgctttctcataagggtgaacccttgggtactagtaccctcacctccaaaggactacatgtcctcgccttcagaggactacacgtcctcgacttcagagggccccacgccctcgccttcagaggactacacgtcctcgccttcagagggccgcatgccctcgccttcagagaactacacgtcctcgccttcagaggacttcacgtcctcacctttagaagactacacgtcttcacctttagaggactacacgtcctcgccttcaaagggtcat

SEQ ID NO: 44917 - DNA, 360 bp, Glycine max
  Peptide Sequence Number=SeqID_136602
cgtcctgagttgaagttatcctctcacgggaggaaggtccatagtttaggcaggcttgtccctgccattgagggactcgttgctgggacaggactaagtcctttgatcgcatgttcggtagacactggcgatcggggacttttgtcctcgtttgtagaacggtggcaccgggagacgtctagtttccatctcccggtgggagagctcacgatcacgctggacgacgtctcctcgcttctccatctgcctgtggttggtgacttgcacgtctttcagctcttgcacgtggacgatgctgttcagatgctggtggacttattgatggtctttgcagagtctgctatggctgagacagcctaa

SEQ ID NO: 44918 - DNA, 355 bp, Glycine max
  Peptide Sequence Number=SeqID_136603
ggctgagttgtcgtgctttcacgaggaatcggggtgcgataagttagttgagtatgtgtgtcttaatgcggtccttgttgaggtgagtcttacaagaggaatctacggacaatgcttgatcaggattaggctaaactatcacgaggaatcaggggccgagaggagaaggaaacttctgcaagacaaaacagttgcatccattcttgaggaggagactcatttctccgacttattatcacctgattcaccatcatcaagggaatctgccactcaattacctgtagccattaccatggcagaagagcatgaccagaggattacccttgaggattattcaagtagttcagtgccataa

SEQ ID NO: 44919 - DNA, 345 bp, Glycine max
  Peptide Sequence Number=SeqID_136604
atgaagaacttccacaaaatcgcttacggaagcgttacggaagcacttcgactcgatttttcttcacgaaaacgtgttttttttgcaaaaatagccgaaatgcatagccaaggggtttggaatatttttgaaacagccccctcccctatttatagggaaaaagagaggtgctttctgcccacagacttaatgaagaagatttctaagcgcacccaaattactagtgaaatatgcttaccgaaggttttcagaaattttacaaaagcattacgaaagccacggaagccccggaaaccatttttcaaaaatgtggaggagcttgtcgcccagttgcttcctccttaa

SEQ ID NO: 44920 - DNA, 234 bp, Glycine max
  Peptide Sequence Number=SeqID_136605
gcctcacagggatgctttgttgcccatggacgtcaagatgtactggctattgccattgagcaactacaacaccctggttgttttcgtgctgctagagccgatgtcacgatcaaacaatactttggatcaacttcaaggagctcccgcacgtctttgtctatggctcttgaagacctagagcagctgacacaaaaaatcagggaccagttggaggagttgatcacagaaaagtga

SEQ ID NO: 44921 - DNA, 147 bp, Glycine max
  Peptide Sequence Number=SeqID_136606
atgaaaattctaagttcgggagttatatttacgcttgaggaaggtattagcacctctcacgtcaacaaaagcgtggcttttgctcctacgtaccctccattgaagaggaaatcagacctacgtagttctttcttatgcgtgaatcaa

SEQ ID NO: 44922 - DNA, 299 bp, Glycine max
  Peptide Sequence Number=SeqID_136607
gcattcctaatctgcaggatctcggccggctgcgcatcggtgaagacgtgccggaaatgctgcaatcggatctgacgctcgaactggagggggcgaaagacttacgcgaagcgattgcgtacgccgataaagttcatgattacgtcagccgcgacatgatgatcgagattctggcggatgaagagcaccatatcgactggctggaaactgagctcgacctgattcagaaattggaatcgcaggcgatagcgattagtgtatcgcctgacaatactcccgattggggagttatatgctga

SEQ ID NO: 44923 - DNA, 246 bp, Glycine max
  Peptide Sequence Number=SeqID_136608
atgcgaggttaccttatggttacccgcacctatcgtcaaccaggggaaaacgagcccgttgacgcgcgaagaccaacatcgtcttcttcaccttttgtcgacctgacccgtgaagtcagtgacatgtggggttaccctatggatttaccctctccttttgtaactacgggcagacgagccgttgacgcgcagagactgacatcttcttctgcacctttggtcgtcctgacccgtgaagtcaggtga

SEQ ID NO: 44924 - DNA, 336 bp, Glycine max
  Peptide Sequence Number=SeqID_136609
atggcacgcagagaccaagtttggtcattctgcacccatgatacgcggagataccttacggttatctgcacccctttgctaggcagacacagttgtgtccgatggcacgcagagaccaagtttggtcattctgcacccatgatacgcggagataccttacgagaccaagtttggtcattctgcacccatgatacgcggagataccttacggttatctgcacccctttgctaggcagacacagttgtgtccgatggcacgcagagaccaagtttggtcattctgcacacatgatacgcgaagataccttacggttatctgcacgtgggatcctctag

SEQ ID NO: 44925 - DNA, 264 bp, Glycine max
  Peptide Sequence Number=SeqID_136610
atgatagctctagattacatattgtcgcaacctactcttttgcgggcgagcgaggcgaggctctcgggtgcgttttccaaaggaggaaaatgcgcggagtcgccaccaacgtttgtttgtggaaaacgtcggaaaaaccgaagaaaaccggtcatgaagaatattccagatttgggagttgtatttacgtttgaggaaggtcgacaaaagcggggctcttgctcctacgtaccctccatcgaagaggaaatcagacctacgtag

SEQ ID NO: 44926 - DNA, 661 bp, Glycine max
  Peptide Sequence Number=SeqID_136611
aattgcagcagctgaccctgcaaatcagggaccatctagaggagtccatcacagagagagtgacgcggcaggtcatggcatcctacagccagatgcagtcccagattcagtcgcagatgcaatctcaggaaatgatcctgagacgggtgactctgatagatgcagcttgtacatagaagtagatcctgcccgcctggttgccatggggagagtttatgagggatccactgttgttcataacactcctttgttgcctggccaagtaaaggtgagtgtggaggaggttactgatgcaaatgctccagttcttgtacccactgatgaggtttccttagtggggcaggcacttcacaccttccttgcttggccgacacatctggtcaagtctttatcacagcaggtagttgtgtctccggcaaaaccacctcaaaagcccgatccagaggtcgatgatccgctttatctgatgacattgaccatcccaaagcttttcttgaggccttatcaggttagatgggatgccaccgtgttcggggtctttaatccagatttccccctctacataaagcatgaagacctctccaaaatcgcacacggtgggaattatgatatctatggattcctcaagccacagtccattcagaggtctgggcaattgtag

SEQ ID NO: 44927 - DNA, 273 bp, Glycine max
  Peptide Sequence Number=SeqID_136612
atgtaccctctctttgttctcagtataaaaacccaaagtagatgtaccctctacttgtgccacaaaggatgtaccctccaatgtgttaggacaaagaattctcaggcggttagtcttttgaatctttgggaagggaagaatcaaaagaattctcaggcggttagtcctttgaattctcttggaagagggagaagggagacacaaaagaaactcaggcggttagtccttcgattcttttggcaagagaaagaagtgaatgaagaagaagagtag

SEQ ID NO: 44928 - DNA, 348 bp, Glycine max
  Peptide Sequence Number=SeqID_136613
atggggcagcccaaattcgagcaaaactctcacaagcaatcccaccatcccaatttcgcaaaatcatattcatatatcattggggcatttcaccgagcacttggggggcgcacatttggacacaaattgcaagagaatggggacaatgtggcatgccccattgcttcagaatacaacataggcctaatgccttctcacacaaaccctcaactcaacaaaacaagcatggattcagatgcgaattgcttcacgaattttgcaaaaaatgagcaactaaagcaccaaaacacatcaatggagagccaaataaccaagggaaattgcacttacttgtggggagtgaattaa

SEQ ID NO: 44929 - DNA, 267 bp, Glycine max
  Peptide Sequence Number=SeqID_136614
atggctccgaggaagcttcctcgaagagatctaggaaggacgctgcggccgcagggactagtgctgctcccgagtgggagagccatcgtttcaggagcactgagcaccagcagcgtttcgaagccatcaatggatggtccttccatcgagagagacgcgtctagcttagggacgacgattctcgagtgttatgccaatgcttggcctacagaggagggagtaacgggacctccggtcatgggtaaggggccagtggataccttttga

SEQ ID NO: 44930 - DNA, 369 bp, Glycine max
  Peptide Sequence Number=SeqID_136615
atgggaaagcgcagaaagttgaatatcattcagaatgatgaacaacacatacaagaagatagtcatgttcagtctcatacttctcttgaaagtgcaagtgaaagttcaactaaaggtaaaaagagaaccagaggttatacacatatgctagatgtgtgggacttgccagatggagaccccctacttgttgaagtagatcattggggcaatcctatgggttgggaagggaaaactctactgaatgcaattgggagcttggtaaggagacaccaatgtgctcctatcaattttcttagctggaaagacatgcctaaggactatattactgacatggttgaattaattcaggtctggtataaaactttataa

SEQ ID NO: 44931 - DNA, 257 bp, Glycine max
  Peptide Sequence Number=SeqID_136616
agcaaggtcatcaggtcccccctaccaatcgagctttcatcaagaagttctgcgtctccaggaaggcgcagggcgaaacaccacagcagcctggggatggccagcagcgggcaacagacgcaccgccatcacctctagagttcacctctgctcatccacaaaaaggtttgagtattgcctacaccacatggccgaccaataggcgaccaagtccaaagccaaaggtagaaagataccttggatatgcatgtatatag

SEQ ID NO: 44932 - DNA, 128 bp, Glycine max
  Peptide Sequence Number=SeqID_136617
atgcggcagtaatgatggcccgagtgatgttggggaatggttacgagcctagaatgggtttaggcaaggacaacggcggcataaccagcctgataagcgttaaaggaaacccacacaagcgaacataa

SEQ ID NO: 44933 - DNA, 537 bp, Glycine max
  Peptide Sequence Number=SeqID_136618
caacattctgcccagcaaccgcagtgccgatctccccctgcagaagtatcagttggtctgtgccgtcatgatatagggatcgtgcccacaagacacccagtggacctggagaagtccaacagggccctggggtttccagctctagttatgggcctctgggtagcgcccacaagacacccagtgcacccaaaggagcccaacagggccctggggtttccagctctggttacgagcctctgtcagtcctacagggcgcccgtccccccagcgagttcatgccatcgtgacatagggattgtgccctcaagacacccagtggacccgaagaaggccaacagggtgttggagttgccagctctaattacgggcctctgtcagttctacggggtgtctgtcaccctagcaaggtcatcaagccccctactaattgagctttcatcaagaagtattgcgcccccaggcaggcgcagggtgaaacaccccagcagcctggggacggccggcagcgggcaacagacgcaccgccaccacctctag

SEQ ID NO: 44934 - DNA, 321 bp, Glycine max
  Peptide Sequence Number=SeqID_136619
atgaagggcaggatgtcaacgtctgagcttttaaatgtaaaggatgaggattctttcaataggccaaggttcaaaaaaggtctaaggttgtgtcaatggggtcttttatcgtgggaacccgatcttgatatctggggcaaaacaaatttgggtgtcaaggtgtcggtcttgagcatgaacttccatattattccacaaggcacgtgcgacaatgatgatttggaaacaacgtgcaaaattagtcatggccacagccaagtgggcactcaagcatcccgtttatggcattgtgatactacggttgggaatttacacaaatag

SEQ ID NO: 44935 - DNA, 262 bp, Glycine max
  Peptide Sequence Number=SeqID_136620
gccacttggccctcagaatattcctcagagcggtgcttctgaaggaagcacctggctcgcctgggcgagctgagctcgcctggcgagctgggcggcaaccacctcccctatttgctataaataggggaggaagtgaagaagaaaaggccgaggcgcttccgaaacgtttccgtaacgttttccgtgaagaatttcgcaaaggtttcaaccgttcttcgacgttcttcattcgttcttcatcgtttctttcgatcttcaacgg

SEQ ID NO: 44936 - DNA, 285 bp, Glycine max
  Peptide Sequence Number=SeqID_136621
atgatacgcggagataccttacagttatccgcacccttttgtcatccagaggcggcgggcccgatgacaagcagagaccaagtttggtcattctgcacccttgtatcatccagaggcggcgggcccgatgatacgcggagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 44937 - DNA, 465 bp, Glycine max
  Peptide Sequence Number=SeqID_136622
atggccccaaagaagcttgcttcaaagagatccaggaaggataaagcggctgaaggaccacgcttcgaggccatcaagggatggtcatttctccgggagcgacgtgtccagctcagggacgacgagtataccgacttccaggaggagatagttcgccgacagtgggcatcactggttacccccatggccaagttcgacccagacatagtcctcgaattttatgccaatgcttggcctacagaggagggcgtgcgagatatgcgatcctgggtgaggggtcagtggatcccgttcgatgcagatgctctcagccagttcctgggataccctttagtgctggaggagggtcaggaatgcgagtatggccaaaggaggaaccggtccgatgggttcgatgaggaggccatcgcccaactactgtgtatatcggagcaggattttgcccggactgctgttgggagatga

SEQ ID NO: 44938 - DNA, 579 bp, Glycine max
  Peptide Sequence Number=SeqID_136623
atggggagctgttgcctggtgcatatgtacgatcatttgaatgatgcttgtatcagcaccagccgacagcttgctggttacatcaccctcttacaggagactatgaagaccatatctacagcgatgtacaggcagcgtctggatcgactcaagattcctgatgtctgctggatgccttatggggagcatcgactgttcagatacgtccagagtattcctgcacagcctgccgattcatgggagtcatttgatgaaatagacgacaggtggatgcactactcagaccatctttcgccagcaactgagatgtgtgttgtgccaagtcagtgtgcgccagactacatagactggttcttcgtcatttctcattcattcatgaccaccacacagccatcagatctgccacgagatgcacctgtgacacatcatgtcgcatttgtggagccacatagccctcaggtgccggagccaacagcagcatcgacacatgcatgttctgatgtggaccaacctagacatgcagtggaaaggaccagttaccagagccatgagcaagaggctccaagaggattgggctag

SEQ ID NO: 44939 - DNA, 237 bp, Glycine max
  Peptide Sequence Number=SeqID_136624
atgaaggcccaagtggagaaagatgaaggcccagaggcagaggcactatcaagaaaattaatgttgctgaaggcccaaactaatttgaaggcccaattttggcccaacctattaagaaggcccatgtctatttatgatgagaatcatgaaactggccaaatacaggctaaaggcccaagtggagaaggacgaaggcctaagtggagaaggacaaagcccccgagtggagaaggatga

SEQ ID NO: 44940 - DNA, 276 bp, Glycine max
  Peptide Sequence Number=SeqID_136625
atgggtgccaagtacctcgaagtagtcaaacgaggttcgcatcccaaccacggatggtccccggacgaaattagggggaaaaactgttcagaatttaatgttaataacaaaacctcaaagagagctatacttaatcctcaagagaaaacaacactagagattcagccttccattaacaacaaaaatgaaatacatcaactggaaactaattgcaacacagaaatgagaatgaatctacaaacagaaaccgaaaatgaaattgcaattggaaactaa

SEQ ID NO: 44941 - DNA, 234 bp, Glycine max
  Peptide Sequence Number=SeqID_136626
atggaacacttacttgttggtgatgaacaaaagcacaaaacggaatcaaaaaatgcgaaaaaggatgaccctagggctgcaaactcgtcaatcccgtggcgacattctctgctcgtttcgcacagagaaaggcaacgatcggtcggtcgtgaccccatccccgcttgcgttcgtcctgcaagtaataaacaaccaggtatggccaatcttgaccgcgtcattaccctaccttga

SEQ ID NO: 44942 - DNA, 791 bp, Glycine max
  Peptide Sequence Number=SeqID_136627
ctaagcgagcttcgctcgctaagctcccaacacttagtagaatttttgaagagttggtgccgctaagcgcagcctttaaggagcttagcgcaaatccttgcggtcagctaagcagaccatgtctcgctaagcggccaatggcttctagaaagagaaagagcattggtacaaggcccacatctcagtatgacacaaggagattctcttcattagatgcttggaccagatacactgataattttctaggaagaaacattttacctgagaggaaagccgagctggagaggtgtaatttccataaacgcctcaccaatttagccgattggagcatagacctggcttttgtgaaagagttctatgcaaatttatacagttctgaggatcgtccaccaaagcagttcagagtcagaggtcatttggtgaaaattgatgctgacaatctcaacacattcctggagacacctgtgggccaacctgggaagattctcaggaaggatctaactacactagctcaggtgtggagtgtcctctcatactccaacttggcccccacatcacatacctctgatttgatagttgacagagctaggttgatctttggcctagtctctcacttggatatgaacataggagcactgatctctggccatatgacctctatagcccagtctaacacctctagacttggccttaccttcaagcgcttgagcccggtcattaacctggcctacatcaagaagaactattgtaaccctgaggatctaacagtctctatccgaggggctaggaag

SEQ ID NO: 44943 - DNA, 342 bp, Glycine max
  Peptide Sequence Number=SeqID_136628
ggtagcaaaggatcattaaattgtaaacatcatcagccacatgatgagggaagcagtatcaaatcaatgctttacaagcattttggtcaggagcagatatattggatagccactgcccattttgcagtagagaggaagaggaagcaggacatttgtttttccactgcaatagaatcatccctatttggtgggaatcattatcctgggttaacaaatctgcaacttttccaaaagatccaagacaacatttacaagtggtcaaacaaggaattattccacacgcaacgcctacaatctggttttcgaagcttctacaggtggtcagcaagaggaatggtgtaa

SEQ ID NO: 44944 - DNA, 465 bp, Glycine max
  Peptide Sequence Number=SeqID_136629
atgtccaaccttggctccaaagaggactccttccccaagtggctgcgacgtggaaaccaacatatcggcaatgatgatgtgagagtttttcgtcgcaagctggatattatgaaacgtcatgagtttgtgtgggagccttacccatcaaccgttttatcattgttgcctcccgtttgtttagtcggaagtctcgcgtggtacgcggtggtgccactaatttgtttccaagttattgagtggcaccaaccggacagagttttgagacaatttgggatgcaacaaccagttccagagtctccttcacaacccctaaacattcatggcataacattaaaggggaaacatgacgaaaattgggggcaattgttcgccccaatgattcagcagtggaataatcgacatgcatttagggtcgacgcttatccccgacaagaaggcctattgagttttaactcggactacatg

SEQ ID NO: 44945 - DNA, 231 bp, Glycine max
  Peptide Sequence Number=SeqID_136630
atgtgcaaagataagtggacccaaccttggtccatgggctcagaaacctaccctgaggttcatgagaaccctagggccttcttcagcaactctagcccaatcctcttggagcctcttgctcatggctctgcagaagggagaaggaagaaagatgattcaagaccccacttcaaggagaagatgagtcaagaagaagttcaccaccataagaagccatggataagagcttga

SEQ ID NO: 44946 - DNA, 273 bp, Glycine max
  Peptide Sequence Number=SeqID_136631
atggctacaccacccagctcccctcctcctccttctccgactgattcaacatcacattccccttctaccataaagaggacaagaaaagtgacccggctgagatcaatggctactagaccagttaggacaaagagaccccgggtccatgtggatcctgcaactgggaaaaccgacggtccctacagaaaaaagttaagaacatatttggggatcgtcgctcgcaataaggtggatgtcacatacgagaatcgaaaacaagtccctgctacctag

SEQ ID NO: 44947 - DNA, 207 bp, Glycine max
  Peptide Sequence Number=SeqID_136632
atgtcgcaacgtgcacttttgtgggcgaacgagggcgaggctcacgggtgcgctttccaaaggaggaaagatgtgcggagtcgccaccaacgtttatttgtggaaaacatcgggaaaaccgaaggaaaccggttgacaaaagcggggctcttgctcctacgtaccctccatcaaagaggaaatcagacctacgtagttcttccttaa

SEQ ID NO: 44948 - DNA, 717 bp, Glycine max
  Peptide Sequence Number=SeqID_136633
atggggacgaggggttgtattaactataatcccgcacttgccataagacagctagggtaccccatgaggggagcgccaacggaagagagcctctcgcctttccttgtgagagattttggcgtgcaaagtctcaaggttgtagaaagagtccacaaggcgtggagaagtccattgaggaaagataaagaacttaggggcatccgtaatggcatcatcggtggttatcatgaatggctaaaagttcatacgcgagggttagattggctcttcaagttgaaagttgtcaatgaggagaactacgaagctccggaagaggatgaagaaatccaagctctaaaattagagctagggaaggcaagactcgccaaagaaaaattcaagtcagccgctacaaacatctggaaagagtgcaccgagttacgagaggaaaatgcggccactgcaagagcccttgaacaagaaaccaagaaggcccgcaaggaagaacatggtcgagataaattccgaggagctttgtggggtagcaacaatgagctcaagctcccggagggaggaaagagaccagccacgggtacaaggcatgatcttaaaggaagaattagctgcttgcgcaagatccaagaggagtttggctcaacacttggaagccacggagcgaagcatgctagccatcatagggcagtacaaggaagagttgaatcagtctgtgacccatga

SEQ ID NO: 44949 - DNA, 275 bp, Glycine max
  Peptide Sequence Number=SeqID_136634
cccccagacaggcagagggcgagacaccacaacagcctagggatggccagcaacaggcaataggcgcaccgccacccacctccagagcccctcagctcatccacaaaaaggttagagtattgcctacggcacatggccgaccaataggcgaccaattccaaagccaaagtaggacacgcctagttgctcatgatcctgggaatttaaataaaacaagcacaagctcggaaggtagtgaaaataccttagatatgcatgtagtgaaaataccttag

SEQ ID NO: 44950 - DNA, 246 bp, Glycine max
  Peptide Sequence Number=SeqID_136635
atgcatctcggcgctatctcttggatttgttccgtgaggacatccagaattaagattggcactaacgtgcttctcctccattcatccggcatgcgttttgacctcataatttcattaaagagtcaggtgagccagtcaagacctctatctccaagagttttccacacttcaataggtatgttgtctggccccaccgccttcccgttaatcattgttttcaacgcttcctttacttccggtttatga

SEQ ID NO: 44951 - DNA, 488 bp, Glycine max
  Peptide Sequence Number=SeqID_136636
aattgggaggactttcaaatcttcgtggtcaacttgaacttaggaacttggagaatgtttcccaaagtgatgaagcgttggaggcaaggatgatggataaaaaacacattaatagtttacagttggaatggtctagatgtaacaacaacaacaacagtaccaacttccaacttgaaatagatgtgctttgcaagttacagcctcactataacattgaatctttggaaataaaaggttatcaaggaaccagatttccagattggatgggaaattcttcctactgcaatatgacaagtctaaccttaagtgattgtgacaactgtagtatgcttccttcacttggacaactaccttctctcaaggtccttgaaatttcaggattgaataggctgaagactattgatgcaggtttctacaagaatgaagattgtcggatgccctttccctcccttgaatctctgaccattcatcacatgccttgttgggag

SEQ ID NO: 44952 - DNA, 498 bp, Glycine max
  Peptide Sequence Number=SeqID_136637
atgacattgaccatccaagagcttttcttaaggccttaccaggttacatgggatgccaccgtgtttggggtctttaatccagacttcccgctctacataaagcacgaagacctctctaaaatcgcacacggtggtcaatgtctcagcatatcagtgttacagttgtggattcttatgcgagcggggaattcttatatctatggattcctcgagccacagtccattcagaggtctgggcaatcacagtttgagactgaaagttacataaagagttggatgcagagttcaaaacgcaatgtctaccttggagcctacctgaatggcagacactggcagatggtggtcatcgtgcccaaggaacacctagttgtctggttttgttcattgcataacaggccagacaactaccttaaggggataattaacattgctttaaaaggtcttgatgatgctccacagcctaaatcaaaggctcctactaggtggattgtcgtcaag

SEQ ID NO: 44953 - DNA, 412 bp, Glycine max
  Peptide Sequence Number=SeqID_136638
atggccaccgctgaagccttggaacgagaaaccaagaaaggcccgaaaggaagaacacgatgccagcaaagttttgaggggctttatagggcagcaatagtaagctcaagctccgaagagttaagcgagactgaagggaatatgtgggccgtcatcgatgagtgcaaagagaagctaaatctagcggcgactcacgagcaaaggctagaggatgagtacgccaagatatcagcagaaagcgaagcaagggagagggtaattgattcatggcaccaagaggcaacaatgtggacggaccgatttgctcttactttgaacaggagtcaagaacttccccgattgctagccaaggccaaagcaatggcggacacctactccgcccccaagaagatccacggacttctcaactatt

SEQ ID NO: 44954 - DNA, 483 bp, Glycine max
  Peptide Sequence Number=SeqID_136639
gacggtgcgggtgctctgttgagtcgcgttatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaccccgatgagtaggagggcgcggcggtcgctgcaaaacccagggcgcgagcccgggcggagcgggtcgtcggtgcagatcttggtggggacggggggaagcccgtctgatagcgctctgttgcgcgtactccgaaagggaatcggggttaaaattcctgaaccgggacgtggcggcttgacggcaacgttagggagtccggagacgtcggcggtggccccggaaagagttattctttttctgtttaacagcctgcccaccctggtaacggctcagtctggag

SEQ ID NO: 44955 - DNA, 378 bp, Glycine max
  Peptide Sequence Number=SeqID_136640
gagctggtgaggtactttcctcattatcaaggaagagatggaaaaagttcaaaatgtgtgaagtttctgaacggcttgcaacttgaggtgaagcaagttgtgaattaccaaggcccaatgaagaataaaaagaatggacctcaaaatcaggaaaaatcgtacctggcccttcctaagcaatatgattgcccatatcctaagaaggagcataatggtgggggtcttaatgaacaaactagacgtccgaaggacatggtaagtctctttactcttaacggtgttgaagctttgaaatctaaagatataatccaagatcaatggcagcggaatggagaagaaggaaaggtgattggagatgccactttaaggagaaaatga

SEQ ID NO: 44956 - DNA, 507 bp, Glycine max
  Peptide Sequence Number=SeqID_136641
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcatgctggtgcgcatgatccgcacccgtctcccggcagcgatccgggcgaaaatcctgacctggcgcctatggctcatggtcgtcaaacgcttaccttcaataaggttgagttggtcgtagcgtgtttgtgcccactctga

SEQ ID NO: 44957 - DNA, 276 bp, Glycine max
  Peptide Sequence Number=SeqID_136642
atgaaggttcatatcatttggaagcctggggcatatggagagaataagaaggagggtggaacccaagctgtgactgtcgttcctagatggccaaatttcccaccagctcaacaatatcaatacttagccaatatcaccccttctcattactcaccaccctatcagccaagaacacccaatcatccacaaaggccacccctaaatcagccacaaaacccgcctgttgcacatccgataccaaacaccactggtcgaggccgtacccgaatcaaataa

SEQ ID NO: 44958 - DNA, 623 bp, Glycine max
  Peptide Sequence Number=SeqID_136643
tgaagcgttggagaggcttagaggtttattgagaaagactcccaccgagtgggtccctgagccaattaaattgaatatgtttatagatgggctgagaccacaaaccaagcaactgttagatgcttcagttgtaccatctgtggtgaggctcatgaaacaggccaatgtattcccattgaagaaaacactcaagaagttcactatatgggaaatcaacagagacaaggatatactcaaagaggattttcaggcttccagcagtgtccttataaccaacaaggacagtggggatcacacctggcaatcaattcatcaaggaccagggactactaagctggaggagactttgactcagtttatgcaagtaacaatgtcaaatcataaaagcactgagtcagcactaaaagcccttgaggtccatgtgggacaactggccaagcagatagctgacaagtcatccaacagtttcgtggcaaatacagaaaagaatcccaaggaggaatgtaaagctatgatgacaaggagtaagaggtttgtggaggtagaggatgaggatagtgttgtatccaagaagaaagctgttgaaaagaaaggtactgatgaaaagaaagatgatgtgagag

SEQ ID NO: 44959 - DNA, 358 bp, Glycine max
  Peptide Sequence Number=SeqID_136644
accatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtagacagtttctatggggcgtaggcctcccaaatggtaacggaggcgtgcaaag

SEQ ID NO: 44960 - DNA, 75 bp, Glycine max
  Peptide Sequence Number=SeqID_136645
atgaagctcaaagatctagcctccatagaagctccacaagcaagctttcatcactcatacatctacgtgatcaag

SEQ ID NO: 44961 - DNA, 255 bp, Glycine max
  Peptide Sequence Number=SeqID_136646
atgctgatcggcttcattgcgctgatctctgcgctgaacgccctgttcgccgcggtgctgggtatctccttccagggtattctgggctacatcttctatcctgttgcctgggtgatgggtgttccggctcacgaagcgctgcaggtgggcaaaaattgccagcacgctttctccgcgcgcggaaggcatcctgtccgtgttcctggtctccttcgcgaacttctcgtccatcggtattatcgccggggcgattaa

SEQ ID NO: 44962 - DNA, 198 bp, Glycine max
  Peptide Sequence Number=SeqID_136647
atgatggaaccaccaacatcgaacgtccagcaaagattttggggccaaggcaagaaacctaaggcttggtcttgctttcgacggaatgaatccctttggcagccagggaatgatattgatgtgtatctcactcctttgattgaaggcttgagaaaattatgggaagacgaggttgatgtgtgggatgggtgcctgtag

SEQ ID NO: 44963 - DNA, 326 bp, Glycine max
  Peptide Sequence Number=SeqID_136648
aattatcatttagctctacatttctccagcaattatgtggatctggggtgctagctgatggtcgactagctgatctgattcgaagagttgctacttttggcatggtgttaatgaagcttgacttgcgtcaggaatcaagcagacatgctgaaaccattgatgtaattacaaggtatttggatatgggtacgtacagtgaatgggatgaagaaaagaaactggacttcttaactagagagttgaaagggaagagaccactggttcctcccagtatagaggtgagattgttatacatagcaaagctttacaagctctatatccagtag

SEQ ID NO: 44964 - DNA, 468 bp, Glycine max
  Peptide Sequence Number=SeqID_136649
atggccaagttcgatccagaaatagtccttgagttttatgccaatgcttggccaacagaggagggcgtgtgtgacatgagatcctgggtaaggggtcagtggatcccgtttgatgccgacgctatcagccaactcctgggatatccgttggtgttggaagagggccaggaatgtgagtatggccagaggaggaaccggtctgatgggttcgatgaggaggccatcgcccagctgctatgtataccgggacgggattttgcccggactgctgcagggaggcgagtgcgaatcatgcgcaccaacatgaccaccctgacccagatatggatgacgttgctccttagcaacatcctgcccagcgatcataattccgacctccccctgccgaagtgtcagctggtatggcgcctaccaggcaccctttggacccagataagtccaacagagccctgggatttcccgcactga

SEQ ID NO: 44965 - DNA, 312 bp, Glycine max
  Peptide Sequence Number=SeqID_136650
atggtgacaaaaagggttaagaaatatgagaaaatgatgacacatcaatttgtcatgatggttgatcaaccaggtaagtatcgttcgacctggctggatagtgacatttccatggaggtgagggtagatatcactgccatggagttctcattgtttctaacctttctagctagagtattcgacatacgtgaggctgagcagtacgtggaggctcatgtcatccttgagaagtataagtgcttgatcagatcacctcttatacctaacaacgatgaccttatgtatgttccattgatcccgccaagggagtag

SEQ ID NO: 44966 - DNA, 240 bp, Glycine max
  Peptide Sequence Number=SeqID_136651
atgaacatcttgacaacacacgatcaaaggtgggagcaggagttaattctttacaatcaatatgaagaagaaagaactcctaatcttgaaagtgtgtttgaagaattcatggcttaccatgctagctcaaaagctaatcaaaattcaatgaaaaatcatgaaattcattttggggacaagagttacaaccttactatcaaaatgaagcagaaagaggttccaatatggataaactattga

SEQ ID NO: 44967 - DNA, 168 bp, Glycine max
  Peptide Sequence Number=SeqID_136652
atgggaaataatgattcgggaaagagagggattcgaaccctcggtaaacaaaaagcctacatagcagttccaatgctacgccttgaaccactcggccatctctcctacataatgatgtccagaaaccgggtgaatagtgaatcattcatatttttgataaatgcataa

SEQ ID NO: 44968 - DNA, 916 bp, Glycine max
  Peptide Sequence Number=SeqID_136653
gactccacgtccctcgctttctggggctacatgccctccccttcagaggactacacgtccccttgccttcagagggctacacgtgccctcaccttcagatgacttacatggtcctcgacctttagaggctacacgccctcgcctgcaagggctagatgccctcaccttcagaggactacatgtcctcgccttcagaggactacgcgccctcgctttcatggggatacacgccctccccttcagaggactacacgtcctcgccttcagagaggactacatgtcctcaccttcagaggattacacatgctcaccttcagaggactacacattctcgctttcagagggctacacaccgtcaccttcagaggactacacccttgcctttagagggctacatgccctcaccttaaaaggacttcaggtcctcgcctttagaggcctacacaccttcgccgttagaggactaacggtcctggcctttagagggcaacacgccctcaccttaaaaggactacaggtcctcgcctttagaggactacatgtcctcacctttagagtactacacgtcctgaccttcagggggctacacgtcctcaccttaaaaggcctacacgccctcgccgtcagagggctacacaccctcaccttcagaggactactcgtcccttccttcaaaggactacacgtcctcaccttcagaggactacacgtcctcaccttaagagtgctacacgcccttaccttcagaggactacacgtccccgccttcagagggctacatgtcctcacctttagaaggctacacgtcctcgccatcacagggataaatggcctcaccttcagagtactacacgtccttgcttttcgaggactccacgccctcgctttcgtggggctacacgccctcccctctaga

SEQ ID NO: 44969 - DNA, 847 bp, Glycine max
  Peptide Sequence Number=SeqID_136654
atggcccgcacgaagaagacaggggagatgacgactgaggccgcaaaggaaatcgctgagaagattgattcgtttgaggagcaggccacacagggatcgttcgtcccccatggacgtcaggatgttctcgccgctgctattggacgtccagagcaccctggacgtgtccgtgctgctggagccggagtcaccatcaagcaatactttggatcggctccacgggcgtctcgcagcgcttcctccctgcctcctaacgaattacagcagctgacccagcagatcagggaccagctagaggagtccatcatagagaaagtgacgaggcaggtcatggcatccttcagccagcttcagtcacagatgcaatctcagggacttgcagtgcctcctgagcctctggttggtccctcgggtcctcgagtgagcacaaaggggagttgtgctgatccctcaggaaacgatcctgagacgggtgactctgacaagtgtggcttgtacatagaagcagatcctgcccgcctggttgccatgggggagaatgcagatgctccagttcctgtacccactgatgaggtttccttagtggggcaagcacttcacaccttccttgcttggccgacacatctggtcaagtctttttcacagcaggtagctgtgtctccggcaaaaccacctctgaagcccgatccggaggttgataatccgctttatctgatgacattgaccatccaagagcttttcttgaggccttatcaggttagatgggatgccaccgtgttcggggtctttaatccagatttccccctttacataaagcacgaagacctctccgaaatcgcacacggtg

SEQ ID NO: 44970 - DNA, 456 bp, Glycine max
  Peptide Sequence Number=SeqID_136655
atgctttacggtgccctcaccgaacttgatggagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaagccttggctcggatatgccactgaagggcaagcagttggtggtatacccctacaaaaccctttggagggccctcagtatcacccacaactacacctcttgcattccacgacaagtaaagaccctcatgctatggcagaaatgggaaagttggatcatctagaggaaaggctcagggccattgaaggaggtgaagattatgcctttgctaacctagaagagttgttcctagtacccgatatcatcacccttcccaagttcaag

SEQ ID NO: 44971 - DNA, 252 bp, Glycine max
  Peptide Sequence Number=SeqID_136656
atgtcggtctctgcgtgtcaacaggctcgcttgcctctgcacattcacaacttaacagtaaatgaaacttcttttttgggagcgcctcctgttctttcttctgagggtaagggtaaaaaatcttatcctgggtcaaggtttatggccaaagggttagggttttggcttaaaaggcttgcggaaggcaagacatggcgtatgtcagggtacttgcttggcaaactgttagtgcttagctctactgagttttaa

SEQ ID NO: 44972 - DNA, 443 bp, Glycine max
  Peptide Sequence Number=SeqID_136657
atgggtaccgagcgacagcccaaaaacccagcgtcaaattgtttctttacctcttcttttatcttcaaggatgtcacgggcttcattcttctcagtttctgctttaccgggggacactcgggatttaggggtaatctgtgttgtacaatgtcagaactcaaaccgggcatatcttggtacgaccaagctggtggtcggcggtatcaatcagcagggatgttaattcttcgcggacggacgtggtcatacccgtgcctatctttacttccctttttgcactgccagctcccaagtctactagttttgtctcttcaggacgaggccccatttcatggtcctcctaggcgactatcctttccaactccgaggaaagtcccacatcctcgttctcttcgtcttctgtttgattcgtttctagctcgaagtcgatgggcgggtcccag

SEQ ID NO: 44973 - DNA, 129 bp, Glycine max
  Peptide Sequence Number=SeqID_136658
atgtcaattaggacttgtaggaaagcttgggcagagcaaatgagaaaaatgagtgacaaagaaaaaaaatgcttgtgcattgctggttatgggaaaggtagtacatattgggttctcgacatcctctag

SEQ ID NO: 44974 - DNA, 222 bp, Glycine max
  Peptide Sequence Number=SeqID_136659
gtgaaaaataggctaagttatgaagtgccaaaagcgacagttgagcttagctcagtagttgggctaagcgtgcatccaccgctaagtgcagcttcagtgcgcttagcgcaacagaagaatctggtagggcatcaatatcaaggctgcgcgctaagcgtgagatcagttgcgctaagtgcagcaggtgccttcagccaggctaagccccgagactggcactaa

SEQ ID NO: 44975 - DNA, 825 bp, Glycine max
  Peptide Sequence Number=SeqID_136660
atgaatgtcagagccctcatttttgggcagattacttctatcgctaagtctaactcctcaagactcgggtttcctgctcttatcacagctttatgcaggaccaaaggagttgcctccgacaatcttgtctttgaacgtctgagcccggtcattaatttggcctacataaggaagaattgttggaaccctgatgatccaacaattattattaggggggccagaagaccaagggcaaggccagctgaggctccttctacatcaacaactcctcatctagcttctacatcagcagctcctcctccagcttgtattgcagcagctccttctaccctaccacctgcagattttcaacgtttcgaagccatgcttcaaagcatacatcaggggcagattattttgctgcaaagtctccagctggtagcacctccagactccatccctacagtagagcaatttaatgaatgggtagcctggccagggactcagcctcctcacagggacgacgaggatcccgccgctctggtaccacatcagccagtggatgagtcattagagtcttccactcttgagcccttgatcaggaagaggaacgtagttgtaactcaggaagccgcatccactcctgaaaagtctcctgaggccactccagagcctccggcaccaatggcagataccacttctccacaacaggcagcagatccttcaacgcctgaagatcaaaccacaccagtccagtctctgaacgcctctcttgtatatactcctgtactgtatttgactgacgacaaggaggttcagacacaggacacccaggaccaatcatag

SEQ ID NO: 44976 - DNA, 667 bp, Glycine max
  Peptide Sequence Number=SeqID_136661
atggcgaagaaagaaatagagcagcgcgttggcgcgcatcgcggcctcactctactcgcttcacgcgggaagcgtcatttttgtcagatcgtttaccagcgcctggcggtgttcgctgctcatgatgccgtcggcggcatagcgcaccagcgtgccggtcgggccgttatcgagcgcatcgccctgcgccagatgatccagcatccagtcgcgccagcattttcgcagcaccggttcgtcgggcatcgccagcgacagcaccatcagttgccggctttcgtgggtatccgtcagctccgggttggacagatagcgcaaataggcgcggggcggcgataccgtcccggccggcaatcatcgccgccgattcaagcagttgacgatgcaaacggacggggtcttttttacgatgctgggcttccatgttcatggcccggatcataccgaccagacggctcacagattgacagtgaccttcagcagatcaggcagttagcgcgtgcggtaatagtggcctacatcgcacgcgcggggggattaatcgaccagttgcttgacgatgttcatcagagcatggacatcttgcgggcgggtattgccgctttgcggatcgataatggagctgtacacgtgcggcatgatctgcgcgacgccggcctgcaggcag

SEQ ID NO: 44977 - DNA, 175 bp, Glycine max
  Peptide Sequence Number=SeqID_136662
atgagcgaaatcgaagaagtacaggaacaagtgaaggctgatatggaggccatgaaggaacagatgacaacaatgacggaagcaatgatgagcacgagaaagatgaaggaggataacactactacagttgttgctgcgagtactgctactgagatggacccaattcactcggccg

SEQ ID NO: 44978 - DNA, 357 bp, Glycine max
  Peptide Sequence Number=SeqID_136663
atgtctcttggaaatttattttctgaaaatcccctctgggtaatcaattacaagactttatgtaatcaattacagcatcatcaagacatcaagacaccagtggacccgaagaagtccaacagggtcttggagttgtcaagctctaattacgggtctctgtcagttctacggagtacctgtcacctccagcaagggcatcaggtcccccctaccaatcgagctttcatcaagaagttctgcgtctccaggcaggcgcagggcaaaacaccacagcagcctggcgatggccggcagcgggcaatagacacaccgccaccacctctagagttcacctcagcttatccgcaaaaaggttag

SEQ ID NO: 44979 - DNA, 222 bp, Glycine max
  Peptide Sequence Number=SeqID_136664
atggctactagtgacatagccattttgagagaccgagcccatattcccaccaagaagagatgtacaatttgtggtggagctcatgaatctggatgttgtatccctaatgaagagcaaattgcacatgaagtcaattatatggggaatcaacccaaaggaaatttcaataaaagtggatttccaggatttcagaacaaccagcagtatcaacagcagagatag

SEQ ID NO: 44980 - DNA, 267 bp, Glycine max
  Peptide Sequence Number=SeqID_136665
atggaaaataaaaacattgcacaatgtcggccgaaaaacaaacattcttctgccaggatttctggtaagcgcaggccaatttcaaccgaaacacaacggcggttgagttcccacgaaataccacaggcgacctcgatggttaagtggtggctggacagaaatatagaaatggcaataactgaagctacagggctccaaatgaggggattccaaaatgaggtgaaaggtctcgtttttaaagtcaatttaggctcaagaatcacttaa

SEQ ID NO: 44981 - DNA, 732 bp, Glycine max
  Peptide Sequence Number=SeqID_136666
atggagaggagtatgattgataatgtcagtggtggagctcttggtgatatgactcctgttgaggctaggaatttgattgagaagatggcttccaacttccaacaatttagagtccatgaggtggccacggattcatcttcatttgttgaaaataaaaagcttgagggaaaacttgatgccttggtcaacctagtaactcagcttgccatgaatcaaaaatttgcatctgcacctgttgcaagagtctatggtctatgttcttctatagatcaccatacagatctctgtccttctttgcaacaatctggagtcaatgagcaacctgaagcttatgctgcaaacacttataatagaccccctcaacagcaaaaccaacaacagaagaataattatgatctttcaagcaacaaatacaatccaggttggaggaatcatctaaatctgagatgggcaagtcctccacaacaacaacagactatccctcctttccagaatgttgctggtccaagcaagccatatgttcctcctccaatgcagcagcaacaacaacaacaacaacaaagacaacaagcaactaaggccccttctcaaccttccttagagaagttagtgaggaaaatgactatccagaatatgcaatttcagcgagacaagagcctccattcagagtctaacaaatcagatggggcagatggctacttagttgaaccaagctcaatcccaaaattctga

SEQ ID NO: 44982 - DNA, 334 bp, Glycine max
  Peptide Sequence Number=SeqID_136667
gccgcggacgcgccgccacctcatcaggctggtccagccggattgtttgatacggagcagtatttgcggcatttggttcgccagcaggcggccaaccaccgggcacatgtacagactcatgattgtctttatcagatgagtctcagcctgcagagccagggctttacttctttttcgtgccctactccagaccagttcagggcagaggtcacatggcctggagattggcctgaggcccaggcaggagaggcaccagcagaggctcccgacgaggcagatgaggcctgcgaggatgaagagatgaccgatttacttgatttcttaggagggagcg

SEQ ID NO: 44983 - DNA, 276 bp, Glycine max
  Peptide Sequence Number=SeqID_136668
atgatcagtaaacttcaaatgctcataacttttgctacggttgtccgtttgaggcccactatatatcaaaacgctcagaattcaaaggagaatccagataaggggatttggtacacgatttttgtagaagcaaatcttcatggtgaatgtgattcaaagatgatgacaaaggtgatgaacaaaaagctcaaagataaaaaaacatctcaagtgaatcaagaaaaagtcaagagttcaagaatcaagaagaattcaagactcaagaagaaagcctag

SEQ ID NO: 44984 - DNA, 357 bp, Glycine max
  Peptide Sequence Number=SeqID_136669
atgaacccgggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggggagaaatgttaaggcattggaccattaacgatctcttgtttttgaaaggagagaacgttaaggcgttgggaccattaacgatctcttggggtggtcgacaaaaagcggggcttttgctcctacgtatcctcaattgcgatgaggaaatccgacctacgtag

SEQ ID NO: 44985 - DNA, 171 bp, Glycine max
  Peptide Sequence Number=SeqID_136670
atgtcaggaaaagctataagagaaatcttagttaggtggttggatgaccttaggcagaacaacaaggaggaggtgaagcaaaagctaaggagaatgaaactcgagatgtcattgaagatcaaggaggaggtgaaaaagcagttcgacgtcgatttcttggcggtggcttga

SEQ ID NO: 44986 - DNA, 75 bp, Glycine max
  Peptide Sequence Number=SeqID_136671
gaggaagcaactggggcggcaagctcctccacgtttttgaaaaatggttttccgggactttcgcggcttccgtaa

SEQ ID NO: 44987 - DNA, 468 bp, Glycine max
  Peptide Sequence Number=SeqID_136672
atggaacgtgtagtggctgatgtacttagagatcaaaggtatttgggcaacaagggtgacggaggttggaaaaggtcagcattgaatgctgcagccgcagtgaatgttaatgtcacatcagataatgtcaaaatccgtatcaaattatggagatcgtggtatggtatttcgcataaatcggctaaaccgtttcgattcaaggtgcttcaaaattgggatgatatagtggatttgtgtgctaaagatagagccaccggtcatggagctgaaactgctatggatgctgatgaagcgatgagtagagaaacaaatgaagtggaattcatggggttaggtgctactgccatagatttagaagaatcaagctctaatacaaaagaaaaaaggcaaggttcgacttcttctggcacacatcctcacaagagaaagatgggagaaaaagaaggaatagcagtttcttttggataa

SEQ ID NO: 44988 - DNA, 879 bp, Glycine max
  Peptide Sequence Number=SeqID_136673
ggcgcggatctgtgtctgaatgcgcagcaggacatctggctgcgggtggcggagcatccggaaatcctgccgtatgtcggtcaggagattgtgttcagcgacggcaccagcgtgctgggggccgacaataaagcggcagtcagcgtggtgatgacgctggtggagaacctgcgtggcgagcacggtgatgtggtggtggcgtttgtgccggatgaagagatcggcctgcgcggcgccaaggcgctggacctggagacgcgctttaacgtcgatttcgcctggaccatcgactgctgcgagctgggcgaagtggtgtatgagtgcttcaacggcgcctccgctgaaattaccttcaccggcgtaccggcgcatcccatgtcgggcaaaggcgtgctggtgaatccgctgctgatggcgcacgacttcatcgcccgcttcgaccggcttgccacgcctgagcataccgccgggcgcgaaggttatatctggttcaatgatatgcaggccaatgccagccaggcggtattgaaagcgtcgattcgcgatttcgatttaaagggatcgccgcgcactatccgcactggtcacgtcgcgctgaagatcaatgatatctatagcaacatcagtaacgcgattggtgaggaccggcgggcaatcgatctgatttttgctgcgctgcagcaggtgggcgtggaacctaaagtgattccgatgcgcggcggcaccgatgggtctgcgctgtcggccaaagggttactgacgccgaatttcttcaccggcgcgcacaatttccattcgcgctttgaattcctgccgatcccgtcatttgtgaagtcgtatcaggtggcggaagcgctctgttatctggcagcccgataa

SEQ ID NO: 44989 - DNA, 376 bp, Glycine max
  Peptide Sequence Number=SeqID_136674
atgagttcaattattacactcgtctatttaaatggtaagatctacaaaactgatgatggtatcacatttgaaggccctaaaaaagctattcaaataaagcgtggtattagttttgagagtttaaaaaaaaggatacacgacaaggactcattagacgaggatgatgatattgatgaaatatctgacacagatgatgaagctgcccgtttgatcaaacaacttacagttgtgcaatcgggagaaggtggaagtcagactcctttatgggattctgcttctcactatagtaatattaattggagtcatcctgaccaagaagatatttgcggtttagatatgggatcaacttttgatatgggtcaagaattatatgttg

SEQ ID NO: 44990 - DNA, 411 bp, Glycine max
  Peptide Sequence Number=SeqID_136675
atgcgccactaccatatccacagcttgttactctatttcttcgtcattttgaaattcctcttgattttgaatcctatattccaatcaagagatccttttttaattggtgctgctgcaattgcttcttttggttactgcaaagagcgtgatggctcttgggtcaaaaagggcactcaacccgctgatgaagaaggcaacctcccagatgaagataattccactcttcttcgcaggcttatggacaagtttgatggacttcagacttttgttggtgacaagtttgatgccatggaattacaagttgacatgaggttcgatgctatggaatcaagaatcaccagagttgaagaagatgtctctttcatccgaacttgttttgatccaccacctccgcctccttcatcctcttag

SEQ ID NO: 44991 - DNA, 267 bp, Glycine max
  Peptide Sequence Number=SeqID_136676
atggggatacaaaagaattctcaagcggttaaaccctttgaatgcttttgtattagggaatgggaagaatcaaaagaattctcagactgtgtcgttttgaattctttgacaagggagaagggagacacaaaagaattcaggcggttagtcccacaagaagaattcaggcggttagtcattggcgaattctttttggcaaagggagaagagaatgaaaagatgaatagcacaagttttcaaggtttggaaaaccagaaaacttcataa

SEQ ID NO: 44992 - DNA, 192 bp, Glycine max
  Peptide Sequence Number=SeqID_136677
atgtcctttgatcatgctgcccttccagatttagcaacttgcactcttcttcagtttgtcaccaagcattctgactttgtgaagatcactttcttgttcactctctgtcatgtgtcggaatcagaccgacatactaggtacaatcctttccttgctgatgcttctatgagtatgagggacaatcaagactga

SEQ ID NO: 44993 - DNA, 402 bp, Glycine max
  Peptide Sequence Number=SeqID_136678
atggattttccgattcacttactacctgtgggtcagccttgtttagtgcctgggcaggtatctgcggattacattgagtggtttttccgcatatctcaccctgtcatgacaccgacccaggcagctgaccagcagagggatgcaccagctgcagaccctgaggactacatacagccgcccagcccccaggttccagtggcatttgacccccctccatatgtggatgattacgagggatatgaggcgattgcacagaggttggagcgtgtgctcaaccttaggatagtcactgcaggcacagagttatatgacattatgcaggactgcctgacgatcgcgagagggggacccagtgctgatgggacggtcagggctcgtcagagacgccgcacggaccattga

SEQ ID NO: 44994 - DNA, 637 bp, Glycine max
  Peptide Sequence Number=SeqID_136679
atggggtggttggaataccgagaaaatgtttggaggcaaaagcaagaaccttggttggatgggttggtggatctggcagcgattgacgctttcctcgcctatcatgaccacaaggaaagcccggttgtcactatgctagccgacctatacgacaccttcgaccgaagatataagaagagcaatatgaggattatttgctgtactccagctctttatgtatggttggtttcgcacctttttcaccaagaagtgaggcatgcttgcccgctagaatgccaccgttcatgcacagagaaaggaggggtaaattgggaccgactcttagcaaacaaagaaggagcatctgtcaactggttccctcgatggaaagaaggaagaatcggggaagagctcgcgcctgtcatttcacaaggtttcaataagaccaacatggagaaacttcagaaggtccgcaaggcgtgggaggtggtgcaaaagaaggacaaagaactcaggggcagtaacaatgagcccatcggtggctaccgaagaaccgctaaaagggaggaagttgaggcaccggaggaagacgaagaggtgcaggcccttagggcagaactcgagcaagcccaaacagtcaaagaaaagttcaaatcaa

SEQ ID NO: 44995 - DNA, 711 bp, Glycine max
  Peptide Sequence Number=SeqID_136680
atggctatgtttgacccagatatagtcctagaattttatgttaatgcttggcccacagaagagggagtgtgggacatgcaatcatgggagtgcgagtttagtcagagaaggaacagggccgacggatttgacgaggaggccattgcccagctattatgtataccgggtcaggattttgcccggaccactgccgggagacgagtgcggatcatgcgcaccaacatgactaccttgacccagacgtggatgacgttgctgctcagcaacatcctgcccagcgatcataacttcgacctccctctgccgaagtgtcagctggcaccctctagaacccagataagtctaacaggggccctggggtttccacagttgatcacgggcctctaccagtcattcgggggtgatgcgccgcaggccgcacatgcaccgccaccacctcgtcaggctgatcctgctgggtcattaggcatggagcggtatctacagcacttggttcgccagcaggcggccaaccactgggggcagggtttcgctccttttgcgtgccctactccagatcagtttagggatgaggtcgcatggcccggagattggcccgaggcccaggcggaggaggcgcctgcaggagctcccgacgatgcagaggaggcttggatggatgaggagatgacagacttgctcagcttcttgggaggaagcggagccacgtga

SEQ ID NO: 44996 - DNA, 174 bp, Glycine max
  Peptide Sequence Number=SeqID_136681
tggtgggtgtccaagaaaccaactcaatctgatgatatacctcaagcacttgcaacccttaccttagacaacacaattgctgaaacaaaatggacctctgacaccggggcctctaatcacatgacaggaatgagaaacagggaaaccgattatcactgggaggcgcaagggtga

SEQ ID NO: 44997 - DNA, 567 bp, Glycine max
  Peptide Sequence Number=SeqID_136682
atgaagacccctgagaaggcaactgagttgattgaaaacatgtctgctagtgatcatgctattttatgtgatagagtgcatcaacccatcaagaagagcttattggagttatcatttgtgttaccatttgtggtggtgttcatgaatctggccattgtattccttttgaagaacaaacgcaggaagttagttacatgggaaatcaacaaaggcaatgatacaaccaaggaggatctcaggtttccagcaaggtccctacaattaggtggaccttccaacagggcgcctcaacaagggcctaatattttccagaggactaccaaactggaagaaactctggctcaattcatgcaagtgaccatctccaaccataagagtactgagtcagccctgaaaaaccttgagattcaggtgggtcaactggctaagcagttagttgagaagtcatccaacaactttggggcaaatactgagaagaatcccaaagaagagtgtaaagctgttgtaacaagaagcaggaagcttgtggcggctgaggaagaggatgttgttgctttgaaggagcaa

SEQ ID NO: 44998 - DNA, 456 bp, Glycine max
  Peptide Sequence Number=SeqID_136683
atcaactgggcccacttggttcggtaccgaatacataaggcattacgggccaatgcacctctcccttacccacaattgataactttgtttctgcgtcattttcaaattccgcttgatgatgaaccatttgttcaagtcaagcgttcttttgcaattggtgctggtgcagtgacttcctttggttaccgtaaggatcagaatggtcaatggctgaagaaagacgcactccctcctcaagatgagcgtactccttcacctcctcctcagcgagatgattcagcactcatgaatgaagtccttaccgaattaagaggtcttcgttcttatgttggtgaacgtttcgactcattggatacatgttttgccggcatggatattcgcctcacacagcttgaagaggatgtgggttacattcgtcagagtttcgatcttccaccaccacctctaccttcttag

SEQ ID NO: 44999 - DNA, 237 bp, Glycine max
  Peptide Sequence Number=SeqID_136684
atgatgataacaaaagatgatgacaaaggtgatgacaaaaagctcaaagatcaatcaaagaacaactcaagtgaatcaaagatcaatcaaagaacaactcaaaatcaagaagaattcaagactcaagaagaaagtctagagacaagaatcaagattcaaggttcaaagatctcaagaatcaagatcaagattcaagactcaagattcaagaatgaagagaagactcaatcaagataa

SEQ ID NO: 45000 - DNA, 371 bp, Glycine max
  Peptide Sequence Number=SeqID_136685
atggagagaagtatgatagatgctgccagtggtagagcccttggagacatgacccctactgaagccagaaatttaattgagaagatggcttccaactcccaacagcttagcgccaaaaatgatgctatagtcattagaggagtgcatgaactggccttgaatcagaaatctgcacctgttgccagactctgtggtttatgctgctctatcgaccaccatacagatctctgcccttctgtgcagcaacctggagcaattgagcagcctgaagcttatgttgcaaatatttacaatagacctcctcaacctcagcagcaaaatcagccacaacagaacaattatgacctctccgacaacaggtacaatcccgg

SEQ ID NO: 45001 - DNA, 627 bp, Glycine max
  Peptide Sequence Number=SeqID_136686
gttacaggttgtaccatctgtggtgaggctcatgaaatgggccaattgacaagggtatactcaaggaggatttttggcttccaacagggtccctataatcaacaaggacagtggaggacacaccctggcaaccagttcaacaaagaccagagtgggccttcaaacaggccaatccaacaagggcctaacatattccagaggactactaagctggaggagaccttgactcagtttatgcaggtaacaatgtcaaatcataaaagcactgagtcagcactgaagaaccttgaggtccagatgggacaactggccaagcagatagctgacaagtcatccaacaattttgtggcaaatacaaaacagaatcccaaggaggaatgtaaagctgtgatgacaaggagtaagaggtttgtggaagctgaggatgaagaaagtgtagtgcacaaggagaaagcggctgaaaagaaaggtattgaagttaagaaaaatgatgtaagaggtgaaggcaatcacgaaaaagggaaacaaataatgatccagaataaagaattgaaggaccaagaaaaagaaaaagaagtagaaaaagaaatagaaaatgaaaaaaatgaaaaagaagaaaaaaaataa

SEQ ID NO: 45002 - DNA, 942 bp, Glycine max
  Peptide Sequence Number=SeqID_136687
gattcgttcgtcccccatggacgtcaggatgttctggccgctgctattggatgtccagagcaccctggacgtgtccgtgctgctggagctggtgtcaccatcaagcaatactttggatcggctccacggacgtcccgcagcgtttcctccctgcctcctgacgaattacagcagctgacccaacagatcagggaccagctagaggagtccatcacagagaaagtgacgaggcaggtcatggcatccttcagccagcttcagtcacagatgcaatctcaggcacctcctgagcctctggttggtcctggtccctccggtcctcgggtgagcacaaaggggagttgtgttgatccctcaggaaatgatcctgagatgggtgactctgacaggtgcggcttgtacatagaagcagatcctgcccgcatggtttccgtggggagagtttatgagggatcgactcttgttcatagcactcctttgttgcttggccaagtaaaggtgagtgtggacgaggttaaagatgcagatgctccagttcctgtacccactgctgaggtagctgtgtctcggccaaaaccacctccgaagcccgatccggaggtcgatgatccactttatctgatgacattgaccatcccagagcttttcttgaggccttatcaggttagatgggatgccaccgtgttcggggtcgctaatccagatttccccctgtacataaagcacgaagacctctccgaaatcgcacacggtggtcaatgtctcagcatatcagtgttacagttgtggattctgcatctcactgaaacatgtatgcgagcggggaattatgatatctatggattcctcgagcttcagtccattcagaggtctgggcaatcgcagtttgaatctgaaagttacataaagagttggatgcagagttcacaacgcaatgtgtaa

SEQ ID NO: 45003 - DNA, 189 bp, Glycine max
  Peptide Sequence Number=SeqID_136688
atgcactcatcacttgtcattcacagaatatgcagctattcaaagagaagaataaaatgcctaggatcttcttcatcaatggattcctttgcttcttggaagatgaatgatagcggaatggagaaggaagagagagaggagatgccacttcaaggagaagatgagtctagaagaagctcaccaccatag

SEQ ID NO: 45004 - DNA, 582 bp, Glycine max
  Peptide Sequence Number=SeqID_136689
atgcaagctctaacactgaagattgaaacgctcatgggagctcaagctcaagtccctgtcactacacctccattcccaacctgtgatagatgtgggattgtgcctgggctaggagaatgcattgttgattatgaactaaacgttctcttctacgtgactggatgctccactagaatacaagagattggatggccaatacagaagaaaaagagtactggaccagacaacccacattgtcgtccaccctatctctatcgtccattgttcaacaatctaaaatctccaccatggttcaataacatttatgaattacaaatccagataatgcgtgaacttgcttgttggagcagacattgtgaacatatcaattggatgcttccttctatcaacttttgggactttgaacctcttcttagaacagatgaagtggtctggtctagtgcacaccatagagtacatgagacttcctacaacacttgcataagtaacataggacatcttcttctagactcgatagttcttgatcttcatgctcataatcttttcagcaactcccatgtccttcatctcaaattcccataa

SEQ ID NO: 45005 - DNA, 168 bp, Glycine max
  Peptide Sequence Number=SeqID_136690
atgtctaacgtcaagatcataccagtacggaagatcaaagaaaatggacctcttcttccatatgcaactttgacttttatccttcttttggatcttcccagtattcaggatgattgggtgttagaaagcgacgatgcctactgtagacagtttttctcccatgtttaa

SEQ ID NO: 45006 - DNA, 165 bp, Glycine max
  Peptide Sequence Number=SeqID_136691
atggaagaggcagagaaggagatcttggaaacatttaggaaagtagaggagctgggcactaataagcaaaagcttaaaggaagtgaaagaattagtatgggcagaaatgtctcggcattgattggtaaatatgttccccaaatcactgaaaatgtaaagatccag

SEQ ID NO: 45007 - DNA, 303 bp, Glycine max
  Peptide Sequence Number=SeqID_136692
atggtgtatccagcagacggtctttcatcagtaagcgatgtgctagtctttgttggtgaatacctatctggtgttcaagtctccggtccttgtccttctattagtggtggtatcctaagattccgtgtacccgcttgtgtagcctatgcgaagcgaacaagcaagggattgaggcgaaagccgcgttcgcgcattcgtttgtttgggtacaagatcgaaaagaatgcattggatggatgcccgggcattgagaaggaaggacgctttcagaggcgaaaggccatggggagataccgtctgtga

SEQ ID NO: 45008 - DNA, 293 bp, Glycine max
  Peptide Sequence Number=SeqID_136693
atgtcgctgcatgttctttatctttgggcgttttctggatttcccccagggatttcctgtctgttgtatctctcgttacaatctttcaaagaaatgaacgtggattcgaggcttttagtcctcacgggcaggatcaccttgggctaccttctggaatggagacaaagcatggaccggcagaaaccaatcaaggtacttaaggatgaacgcaagcggggatggggtcacgaccgaccgatcgttgcccttctctgtgcgaaaaaaagcagggaatgtcgctgcaaggcagcccc

SEQ ID NO: 45009 - DNA, 273 bp, Glycine max
  Peptide Sequence Number=SeqID_136694
atgacccaagagctggtagcccgcgaagacaccttacggttatctgcacctcgtcattcagtgaccccaagtgtgattgacgagcagaggtcaatgtggtcatctgcgcccttccggagatgtcagcatcttccggtggagactttttcaagtctcacaagttatcaagaactacgtaggtctgagttcctcattggagggatacataggagcaagagcctcgctttttgtcggccacctaagacgaaaagcctgatagcacgcagagactaa

SEQ ID NO: 45010 - DNA, 837 bp, Glycine max
  Peptide Sequence Number=SeqID_136695
atgaggtcctgggtaaggggtcaatggatcccgtttgatgccgatgctatcggccagctcctgggatatccgttagtgctggaagagggccaggagtgcgagtatggccggaggaggaaccggtctgatgggttcgatgaggaggccatcgctcagttgctatgtataccggggcaggattttgctcggactgctgccggaagacgggtgtggatcatgtgcaccaacatgaccaccctgactcagatatggatgactttgctgctcagcaacatcctgcccaccgaccataattccgacctccccctgccgaagtgtcagttggtatggcgcctactaggcaccctttggacccagataagtccaacagggccctggggatttcccgcactgatcacaggactctgccagtcgttcggagtccccgtggcccctaccaaggtgattcggccgcccatcacccgggcttttatgagaagtattgtacccagagacaggcttagggggatgctccacaggccgcgggcgcgccaccaccactcatcaggctggccggctggggcatttgacatggaagcagtatttacggcatttggttcgccagcaggcggccaacctcccgagcacatgtacggacccatgactagccagagcttcgcctctttttcatgccctactccagaccagttcagggcagaggttgcatggcccggagattggcccgagacccaagcaggagaggcacccccagaagctcccggcgatggagaagaagcccacgaggatgaggagatggccgatttgcttgacttcttgggagggagtggagatacgtga

SEQ ID NO: 45011 - DNA, 576 bp, Glycine max
  Peptide Sequence Number=SeqID_136696
atggctacctcatcaaaagaaactgcagcttctggttcaccatctgtcccatcatctccacaccaggaacaacctgaactcaacatccaacccatccaaataattcctggtcaagcctctgtccctgagaaactggttcccagaagaccacagggagtgaagattgctgaaaaccctagccctgcaacgagtcctagggaagtagacacggagatggacaagaaaatacgcagcattgtgagtagcatcttgaaagacgcctctgttcctgaagctgatgaagatgtcccaacatcgtccaacccaaatgtttctgtgcctgatgtcaagaaagatgttccaacatcttccgccccaaatgctgaagcacttccttcatccagtgaagagaatcaccagaggaagatgatcaagccacagaggagacccccggcaccaagggcaccagaacctgctccaggtgacttcattgacctagaagaagtagaatttgatgaggaacccattgccaaaaagttggcacctggcatcgcagaaagattacaaagcagaaagggaaaaaccccccattactag

SEQ ID NO: 45012 - DNA, 99 bp, Glycine max
  Peptide Sequence Number=SeqID_136697
atgggtctgaaggtagaagccaatcaaggtaaaacggtaatgcggccacagtttgcagcggatgtcgtttccttctttcagatgcctcatctaccctaa

SEQ ID NO: 45013 - DNA, 563 bp, Glycine max
  Peptide Sequence Number=SeqID_136698
gtcacaggttgtaccatgtgtggtgaagctcatgagacaagccaatgcatccccactgaagaaaacactcaagaaattcatttcatggggaatcagcaaaggcaagggtacactcaaggagggtttttaggcttccagccaattcaacaagggcctaacatttttcagaggacaactaagttggaagagactttgactcagtttatgcaggtaacgatgtcgaatcataagagtactgagtcaacactaaagaaccttgaagtacagatgggacaactggccaagcagatagctgacaagtcatcaaacaactttggagcaaatacggaaaataatcctaaggaggaatgcaaggctatgatgaccaggagtaaaaggtttgtggaagctaaggatgaagaaaatgtggtagacaaggaacaactgagtgaaaagataggtgctgaggttaagaaaaataatgtgaaggagaagagtataagtggaaaggctgtggaagaaagtgtggaagtaccatatcctgtggtgccttccaagaaagaaaaagatcatgatttggaaag

SEQ ID NO: 45014 - DNA, 443 bp, Glycine max
  Peptide Sequence Number=SeqID_136699
gtttgcatgcatatgttcgttttggcctttatgttcgtttgcatgcatgtcttcaaaagtttcgaatgagaagggacaaattgcattttgctgcagttccagacctgaagatgaaactcattagtcaaagacaaacaaacgaaaggttgtataacttaccaactaccactgaagttgctgccttgattgttggtgatgaacactcagctgataaaagagatattataatagaaaaacagtccggacttctgaagagaatacatgaacttcatcctgcatatttttctttgcaatatccacttttatacccaaaaggagaagatggttacagactaaatatacctcacaaagatcatgccaatatacatgctgcaaagaggaaacaagtcacattgcgtgaatattttgcttaccgcctacagtcaagaactgatgaagcatag

SEQ ID NO: 45015 - DNA, 390 bp, Glycine max
  Peptide Sequence Number=SeqID_136700
atgcaacctccaccccacgagtttggagtcatgcgtagtgattgcttagtgcaattctccattctcaacccctcctttcggagccccatgaactgcgttttcgttcatgcatcctccacccacgagtttggagccatgcgtagtgattgcttagagcaattctccattctctacttttattggagccccatgaattgcgttttcgttcatgcatcctccacccacgagtttggagtcatgcgtagtgattgcttagtgcaattctccattctcaacgctttttctgagccccatgaattgtgttttcgttcatgcatcctcacctacaagtttggagccatgcgtagtgattgcttagtgcaattctccattctctaccctttttcgtag

SEQ ID NO: 45016 - DNA, 522 bp, Glycine max
  Peptide Sequence Number=SeqID_136701
atggccacaatgatggaggccatgatgagcatgaagaagataatggaagccaatgcggttgcaattgccgctaccagcgctgttgctaaggtgaacccgatgcccccatctggcctcaaccaaatgaatcatccaacctcagatatgcacaccttcccgccatatggcttgcctcgtaactatacaccacccaatgtggcgtacactcccagtgagaatgtcaataactccactcctatactctttgagagccaacaacctcaatttgatcatgcacatgtctttcgacccattggggagacacatgaaatgccccaccataatctagacgacttcaagccttgcctcggatatgccagtgaaggccaagtagttggtggtatacccctacaaaacactttggagggccctcagtatcacccacaaccacacctcttgcattccgcagcgggtaaaaaaccctcatgctatggcagaaatgggaaagctggatcatctagaggaaaggctcaaggccattga

SEQ ID NO: 45017 - DNA, 530 bp, Glycine max
  Peptide Sequence Number=SeqID_136702
atggccctaggcaaaccatggagtctcataacttccctgaaaaagagttttgagatgtgggaagcatcatccaccttgtggcatggtataaagtgtagcatcttgctaaacctatccaccaccacaaagatagagtctacacctctttgggttctaggaagcccaaggacaaagtccatactaatgtctacccaaggtgcagaggggatgggtaaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45018 - DNA, 540 bp, Glycine max
  Peptide Sequence Number=SeqID_136703
atggagtggctctggcgccgactgacgcagctcgccgccggaaaagcggataacgcctgtttccgatgccctgacagaatagcgccgttacgcgccagtcgcgcattttctcctctgtggaacaactgcatgataacgattcgtgatgtcgcccgtcaggccggggtttccgttgccaccgtgtcgcgggtgctcaataacagcagtgcagtcacctctgatacccgcgaagccgtgctgcaggcggttgaatcgctcggctaccggccgaatgccaacgcgcaggcgctggcgacccaggtgagtgataccatcggcgtggtggtcatggacgtttccgatcccttctttggtgcgctggttaaagcggtggataccgtggcgcagcgcatgcacaagcacgtgctcatcagcaattcctggcatcaggaagagaaagagcgccatgccattgaggtgctgatccgccagcgctgcaacgcgctggtggtacacgcgaaaacgcttacagacgcggagctggcgcggtttatggaccag

SEQ ID NO: 45019 - DNA, 1992 bp, Glycine max
  Peptide Sequence Number=SeqID_136704
atgtcaaacccagtagtccttctgcttcgtaacggtgctgaatggaaagtgaaatggaaaaaacttgatgttgatgtttggttgatcgatgattggaaggaattcgcagacttttgttgtttggatcaggaccatcttttggtgttcaaatacatggggaagtcacggtttcaggttgtaattttttatcaaaatggcttggaaatgcagtaccctttgatggaagaaacaatagatggtaattctttatgccagcctaagagggcaaaatctcctttaccattttcttcttctattaagaaggtgaagaccaacccaagaaaggaaccttctagttatccaggccatgaccatgatgttaaaactgaacctgcacaatctcaaaggagaaaggttgagttgtctaaaaaattccatgcagatgatcttgatgatgcaaagcccaaaaaaagaggaggaagaagaagaaggatcatgtgttccaattctagggctattaaaagagatgagttgttgcaagatactgagagtagcactgctttagagagagccaaggctttccgcactgataatccctcgttcattcgtgcaatgggaaaatcatacattgaaagaagtgtgctggataataacttgaaaatagggaatgtatgtgtttttgagcaaattaagaaacctggaatttcatttagagttgttatttttcgtgacccagaagaatcaagtcctttcaagtttccagggcttcaaaatattattgctaaaagtggtagtgatggaattccaaaagagcattcagggaggaatgtctttgatgattctgaatcccgtagattcaacaacaacaaagtatcagagaatcacttcaccatctctatcaagccgagtcaactatgtcatatgaacgtaccaaagaaattcatcaaaaaccatgacattgataatacaaaagaagtgacgctgcaagttgggaaaagatcatggaatgtgacgctagactgttacgggagattcacttcgggttggtctgaatttatgagtcaatgtgatttggaggccggtgataggattcctcgaagttttgtgaacaaatgttgggaaggaatatcaaacccagtgctccttctgcttcctaacggtgttgaatggaaagtgaaatggaaaaaacttgatgctgacattttgttgatcgaagattggaaggaatttgcagaattttgttctttggataaagaccatcttttggtgttcgaatacttgaggaagtcacagtttctggttgtaatatttgatcaaaatggcttggaaatggagtaccctttgatgggaggaacattagatggtgatgagaaaggtaattctttatgccagcataagagggcaaaatctcctttaccattttcttcttctattaagaaggtgaaaggaaagacacttactagttatcccagccatggtgtgagaactgaacgtgctcaatctcaaaggacaaaggttgagttttcaaaagaattccttgctgaggatcttgaaagaggtggcagaggaagagggatgatgaatgcaaaaaggagatgctctaactctaatgctttaaaaagtagcactgctttagagagagccaaggctttccgctctgagaatcccttcttcattcattctgaatttcgtggatgcaacaacgaagtgtctgagaatcacttcaccctctcgatcaagccttgtcaattctattgtatgaacgtaccaaagaaattcatcagaaaccatgagatggatggtataaatgaagtgacgctgcaagttgggaagagatcatggaatgtgaagttagactgttacggtaggtttacttcgggtttgcatgactttatgagtcaacataatgtggaggctggagatgttattcactttgagttgatcgataagaagaaatttgtgtttcaagttagagttacgagatgcatcagcatcgattttgagttgctgtaa

SEQ ID NO: 45020 - DNA, 729 bp, Glycine max
  Peptide Sequence Number=SeqID_136705
atgaacaaagaagtgtcagggaatcagttcaccctctctatcaagcctaatccatcgtatcatgagcccataccattagaattgatcagaaatcttggcattgataatgtaaatgatgtgaacttgcatattggggagcgatcatggcctgtgaggtttccaaagcataattatgatgttgctgggaatgtaaaactagagtatgtgggagatgatattgtgattatggaaggaatttcagatgagagaatcgtggaagagatgaagaatgaggaggacagcctgctgagtatatttcatagtgctcataagtggaatgatgaagagtattctggaaatagattggcattggtccagtgcttggggataccgctaaaggcatggaacgaagtatgcttctcaaaattagtatcagagtttgggaagttcatattcgtggataaggtcactgctagtagggagaagattgatgttgcaagggtgatggtccaaatagctacgccatcaacgattatattttgtgacaatgtgaggataaatggaatcatttgtaatgtgagagtggtggaggagaccctacaacaggtggagtcatgtggaagaaggatcatgtatgccaataggagatgctcaaaatcaaaggctgttagaagtgagttgttacaagaagatactgaaggtagcactgctttagacagaaccaactctttccgctctgagaatccataa

SEQ ID NO: 45021 - DNA, 837 bp, Glycine max
  Peptide Sequence Number=SeqID_136706
atgggtagttgtggaagagaaggatcagtgagacaatatgtaagatcgaaggttcctcgtttaaggtggactcctgagctgcaccgttgctttgttcatgctattgatagccttggaggccaccataaggctactccgaagcttgttcttcagttgatggatgttaaagggctcacgatttcacacgtcaagagccatcttcaggagcatgatgatggatgtgttgatgaagggaatgatgttggtgttgagtactcttgttcgaaaccaatgggaagagaatctgattccttcttcggccacagtaatctccctccaaaaagagcaagaatcgagacgaggagttccatctcagagagcctgcagtgcagccaaagattatgtgatgcagttcaaaatccgtactgtttttatgattatctgcaacagaagaagcccatggctgatgagcacaaggagttctcaacatggcagcaggcacaaccccattcccttctgtttccagaatttcccaaccacacttcattcaattctcctaaccaacaatctgatttccttcaggttactaaattaaatgaaggaaagagcacttcacagcctagtaatgtacttgtgaacactactactgagacagctattgcagaagttgaagatgaattgtcattatcgctcacattgccaaatccttcacctcagagttcaggcagtgagataagtgaggcaatctcatcatgccctgggtttggcaacaactacaaggactgctctagttcatccactcacactctcaaagaaagaattaatttggacctatctttagccctatgtggcaattga

SEQ ID NO: 45022 - DNA, 414 bp, Glycine max
  Peptide Sequence Number=SeqID_136707
atgaaagtggacactgacccatttcatattcaggctaactatgtcaagcccgtgcaaatcatgatgatgagggcctcgataggaacatcaaaagtaagcgctcttttgtctgaaaaggagaaacaaaaatttgagaaagaggttatgctatgtcctcgttgtagtgtcgtgtttgacaggtcgatagctaaagcatttgaggcatcagaaattcgaaaaagtttccaaaaagtgccagaaacagaggttaaaaaaagaataaatcctacgtccctcaagcaaatgttccaacaagggaacaaaggatatagttcacattttaaagagtttgaagttaatagttcagcgcttcgaaggggaggagccaccgatggtttgaggaagggatattacgactatcaaaatcctccttag

SEQ ID NO: 45023 - DNA, 573 bp, Glycine max
  Peptide Sequence Number=SeqID_136708
atgtcaccacttttgtcactatcattgtcatcaccactgattgtaactaccaacaccacatcacccccatcgacatcactacaaccacttgtcaccaccattatcaccgtgatcactattggtatctctatcgtcgtcgtcactgttgatgtcatcatccaccacacaaatggatggggactagatggggatggccaggggacgccgttgacttattcgatacaactgactacgacgaggatgacgacttcattttgtggggacgtattggggacaacggtggcctatacgcgcgtccccgcaatcccaggggaaggtttcgttgaaaacattgttggagaggttgagagggaggaatggggccgaagaatttgtttgcggcgagggagaggttggagaggaatgggaggtgggcaacgtgttgacaaagagcatgttggagaggtacaagttggtgtggttgagggcggtgacatggtgacaattgtcataggtgacactgaaccacgagcaataagggatggaggcatttcacaaagagagaacgagtggtgtggtgtcggtaatgactga

SEQ ID NO: 45024 - DNA, 420 bp, Glycine max
  Peptide Sequence Number=SeqID_136709
atgattcagataaggcttgtaggggacatgccaaagaagaaggcaaaggaaaagaagaagggttgcttacatggcttgattctaagaaaagaggaatctgttctctacgtgagctttgggagcatgaacaagaaaattgatgaaggggctactagggtttttctggaagaatttgagaagagagtgcaagaaagcagcaagggttacctaatatggggttgggcaccgcaacttgttatactagagcatcctgtcactggaggtgtggtgactcactgtgggataaacactgtgtttgaaagtgtcatcgcaagtttgccaatggtgacttggcctatttatgcagaccagtttttcaatgagaagttgctggtagatgtgctgagaattggaggcgaaagaatggagaaacttgaatga

SEQ ID NO: 45025 - DNA, 2538 bp, Glycine max
  Peptide Sequence Number=SeqID_136710
atgtcgggagaaagtaagcgtgaagatcccacttcggaaagatgtggtgacaaacgtaaggcagggtggatctcagtgattgaagatgcgaagtcagaatcatcgaagatcattatagctagggactcacagaccagagaacagacgtcagaaggaaacacaagcaaaggaggaaccaaggctgaaggactaagtaatagctttgcaaggcagcccttggccatgggaaaggatagagacaacatcaaggatggtagcagaggctgtgatatttttgaagagaagattcgaagattaccaggtggagaaacatgggatagaaaaatgaaaagaaaacgttccgtgggtactgttgttgccagatccattgatggtgaaggagagctgaaaaaggttatgcatataaggctagctaatgagtcaggtccgcagggttctgatgcccaaggtttgagatcaggatattctggcagtaatagcaagcttgatggtgcttccgtgcctgccacttttacgactgccaataatgagcaagaaaaggtgtcaaggggttcagtggatggatcaaataaggaacgggttgtgcttaaaggaaataagtttaatgttcgcaacaataattatacaggtggtatccatactttgacaaaaggaaaagcttcaaggccacctcgaactggtgctttgatggctggaaactcatcttctgttccttgttcttctgaaatacttgatgctgaggaacaaccttcaaatgtgaacaagcctcattcagtaagtggtactataaatcgtaagcgtcctttgcctgtaggatcatcttcatctcctatggcccaatgggttggacagagaccccaaaaaatttctcgcactcgaagagcaaatgtggtatcccctgtcccaagttctgatgaagtgcatacgtcattagaaggttgttccccttcggatgtcattaccagaaagactactgctgcaactagtggatttcttatttccaatggtgctatcaacggtggcattcacccagggaaaatgaaacatgaaagtgtttcatccccaaccaaattatctgaaagtgaagaatctggtgcaggagaaaatggtgaaagtaaaatggagaaaggattggaaagtaatgaagttgatggaagtgccataaataattcttataatacaagttcctccatgttaacatcgaaaaagaaaaaaatacccaacaaggaagaggttggagatggtctgcgtagacagggaaggggtagtaggggctcttcagttttgaagaatggcatctcaccaatgaaagagaagttagagactccaaccttgatgaagccaattaaaaatatgaagcctgcttctgaaaagaatggaagtaaatcagggcgtcctcctttgaagaaatcatgcgataggaaatctattactcgtattggtcatccatcaactaacaattccccagatattgcagtggaggatgatgatcgtgaggaacttttagctgctgctaactttgctagcaatgccagctttttatacttgccagttgccacatttgatattggctgttctagttcattttggaagaaactggaacctatcttttctcctgtcagcttgaaagacatgtcctacttgaagcagctggttaaaacaacagaggctgatctaagatgtttgtctcagatgctaggcattggaagtgatgcactggatagacttacacatacggaaagccctctgtcacaaagttctatctctagagcaagagagagaagcattgtaaatcaaactgattccaaggagatatcctcaatggatgacatggttggtcaacatctggatgttagtattttgtgccaacaaatggattcagaaggaaacaaacttgtgcctttgtatcaaagagtattgacagctctgatcattgatgaagaaattgttgaagatggaaatatgccttctctttgtgaaagagatgactctcctcaggtggcttgtcactttcaggatgttgagaaccaatccagcatcaggatggattttgaattcaactctgacaaggtttcttgtaatgggaatgctacctttactagttgcacagacatccatgatcaagaacttggtatttttctgcaaatgaatcagggatcattgcatctagaaactgagagggtgtccatgttatctgaaaatggtaatgatgagtcaatgggtatgcatggagtttcttgttcagcatctttcagttgccattttgagcaaatgagtatggaggataaactcttactggagctacagagtgttggcctatatccagaaccagtgcctgatcttgctgatggagattgtgaagctattaatcaagatattattcaattacagaagggactcttccaacaggtcaataaaaagagagaatgctttatgaaacttattcaagcagtagaacaaggcagagaaatggaacaaggagcccttgagcaagttgctatggacaaacttgttgagttggctcataagaaaaagctg

SEQ ID NO: 45026 - DNA, 147 bp, Glycine max
  Peptide Sequence Number=SeqID_136711
atggcgttggaactcctattcgaggagtgtgtggatttcctcgaggcgatgccatggatggaagaggaagataagtccaagcttctgtccaagacactgaaaaagcacaagcttactagacctattgctactaaagagttggaatga

SEQ ID NO: 45027 - DNA, 3801 bp, Glycine max
  Peptide Sequence Number=SeqID_136712
atggaagcgaatctagagaaggtgacgatgaatcaagaggacgacgagttggagtccaaggagagtgtgcttcaaaagtacttcctccaagaatggaacatcgtcaagtcactcctcgacgacatcgtttccaattcccgcgtctccgacccttcctctgtccacagaatcagatccattttggacaagtatcaggagcaaggccaacttctagaaccctaccttgaaaccatagtttgtcctctgatgaacattcttcgctcacgaacacttgaactcggggtagcttctgatgaaattcttgaaataatcaaacctatatgcataattgtatatacgttagtcacggtttgtggctacaaatctgtaatcaagttctttccacatcaagtttccgatctcgaactcgccgtgtctcttttggagaagtgtcaccacacaaattcagggacttcgttaaggcaggaaagcacgggagagatggaagctaaatgcgtgactctgttgtggctctatatacttgtgttggttccttttgacatttccactgttgacaccagcattgcgaacaatgacaatttgactgagtttgagctcagtcctcttgtgttgagaattatagggttttgtaaggattacctctcgactgctgggccaatgcggactatggctggactagtcctctcgaggctacttactcgtccggatatgcctaaagcttttaccagctttgtagagtggacacatacggtcatgtcctctgtaacagaagatttactccatcatttccagttacttggggttgttgaagcactggctgctattttcaaggcaggtagtcggaatctcttgcttgatgcaattcctgttgtttggaataacactacaatgctgtacaagtcctcagatgcagctcgaagtcctttgctccgcaagtatctgatgaagttaacccaacgaattgggcttactgctcttcctcatcgtttgccttcatggcgatatatgggaagagttgccaaactgaatgtttctttgaatacgtccaataaaattgatcagtccaatttaggtgtgaacagccatgattccaactcaaacgaaatgttagacagggaggaagatgaggatatggatgttccagaaaatgttgaagagattattgagatgttgttatctggtttgaaggatatggatactgttgtccgctggtctgcagcaaaaggtattgggcgcataagttcacatcttacatcttccttttctgaggaggttttatcatcagttttggagctgttttcacctggtgagggtgatggttcatggcatggaggctgcttagctttggctgaacttgctcgtagaggcttgctcttacctgctagtcttcccaaagttgttcctgtgattgtgaaggcactacattatgatgttcgaagaggtccacacagtgttgggtctcatgtacgcgatgctgctgcatatgtatgttgggcgtttggacgtgcatattatcatacagatatgaggagcatcttaaaagagtttgccccacacctcctaacagtggcatgctatgaccgtgaggttaactgcagaagagcagcagctgctgcttttcaagagaatgttggaagacaagggaattatccaaatggaattgacatagtgaatactgcagattatttttcactttcttcgcgagtaaactcttatcttcatgttgctgtttccattgctcagtatgaaggatatctttttccatttgtggatgacctgctggatagaaaaatctgtcactgggataaaagcttgcgagaacttgcggcagaggccctatcgtttcttgtaaaatatgaccctcagcattttgcgagcactgtcatggaaaagttaattccttgtactctttcatcggatttatgcatgcgccatggtgcaacgttggcaacaggagaaattgttttagctttacaccaatgcaattttgctcttccctcagataaacagagaagtcttgctggcgttgctcctgctattgagaaagcacggctttatcgtggaaagggaggagagataatgcgtgcagctgtttctcgatttattgaatgcatctccatatataaagtggtattatcagaaaagataaagaaaagcctacttgatactcttaatgagaatttgagacatcctaattctcagatacagaatgcagctgtcaaaggcctgaaacactttatccgtgcatacttgcatgcttcagataataaaggtataagtgatgtgacagcaaagtacctcagtatgttgactgatccaaatgtagctgtaaggagaggatctgcattggcaataggtgttttgccatatgagttattagccagtcaatggagaaatgtgcttttgaagctttgtggctcttgtaaaattgaggaaaaccctgaagacagagatgctgaagcacgagtaaatgctgtcaaagggctcacattagtgtgtgaaacattaattaatggaagagaagatactgctacctcttttgttgaggatgatttttccctgtttattctgataaagaatgaggtgatgataagtttatttaaagctcttgatgattattctgttgataatagaggtgatgtaggttcttgggttcgtgaggctgcattggatggcctagaaaaatgtacatacatgctctgtaagatagacaagtcagtttgtttgtctggaagatcagatggaaatgaaattgaacctattgcatatccttcgattgatagcatgcttaagaacaaccgagagctttttttattcaatgaaaatcttgctaccaatttagttggaggaatttgtaagcaagctgtggagaagatggataaactgagagaagcagcagcaaatgttctctgcagaattttgtacaaccagatgattcatattccatatatacctttccgagaaaagttagaagaaatcattccgaaggaagcagatgcacaatggggtgttccttcctattcttatccacgctttatacagtttcttcaatttgcttgttatagcagagatgtgctatcaggtttagttatatctattggtgggttgcaagattctttgaagagggtatcactcttggcactgttagagtatctagaaggggttgaatatgaagaccctagtacaagaacatctagggtatacatgctatctgctgacatcctgtgggttctccaacaatacaagaaatctgacagagttatcgtacccaccttaaagaccattgagattctgttcagcaaaaagatattccttaatatggaggctcacactccggctttttgtggtgctgttttggattctctgtcatttgaattgaagggatcaaaagacttctctaaattgtatgctggtattgcaatacttggttatgtagcttcagttcaggaacctatcaatatgagggccttttctcaacttcttaactttcttggtcatcgttaccctaagattcgaaaagcttcagctgaacaactgtaccttgtcctcttggaaaatggggatcttgtggctgaagacaagattgataaagcacttgaaattatttctgagacttgctgggatggagatatggattcagctaaacaccaaagattaaaattctctgagattgtaggtctggaggttgggtcacttggcaacaatagtgatggaacatcaaggaaaaccagcagtaagaagcctacagacttggatgaaaatgcatcatattcctcattagttgaggcatccgggttctaa

SEQ ID NO: 45028 - DNA, 285 bp, Glycine max
  Peptide Sequence Number=SeqID_136713
atggttagagtcagaggtttgggtcaaactttagacagagttatcgtaagaacattaggtagagaacctcaagaggcacctactgatgatgtagttagtgatgtcgagggttttccagaacgtcttgagttgaagttgttcttttatggaaggaaggtagagaaatttggcaggtttgctcctcagattgaaggcttagtgactaccataggattaagttctctgatcgcatgttcgttggatactggtgatcggggacttttgtttgcttttgcaaagaggtga

SEQ ID NO: 45029 - DNA, 249 bp, Glycine max
  Peptide Sequence Number=SeqID_136714
atggctagtggagttattttgcggagaagtgttaagcacactttgactgctacttctaccatggaagttgagtttgtctctttctttgaggttacatcacatgccattagagaaagagtaaaagacaagaaagtggtcattgaacgtataagcattgagttgataatcgttgatcctttgactaagggtatgccaccgtttaaattaaaggatcatgtagagagaacgagacttggttccactttatga

SEQ ID NO: 45030 - DNA, 549 bp, Glycine max
  Peptide Sequence Number=SeqID_136715
atgaagctgtctaatagttctccatctatcaaatttgtggttgcaaagaaggctgatagcctttaccccattgtcagtggtgcaagcatagttgcaaaggttattgtaagagtggtttgtgcttatcagtcttcattaacacttggaattgtttacagggagtctgacaatttggatgaagatggtggtggcagcaacaataagaatcgattaagcaatgtgggtttcaccacatccaagagaagtgaagaaatagaatcaagtggtaaaggacgctgtaggttttttcaggctcggaaacttgagcacctcacttatgtggaactatatattattcgaatttcatccttgtataacattttctgtatatacactttcttggatggtactcagtctagcaagatgtgtactagctcacccagacaaattcttggatgtctgaatggagtagttgaattaccgagtgtttccaggtttggatctgaagctggggagcgggataccagttctccccaacagtcctgcacacgtcatttactggctctttag

SEQ ID NO: 45031 - DNA, 229 bp, Glycine max
  Peptide Sequence Number=SeqID_136716
atggtgaagattggaggtggggtcgcacatggtggcaatggactggggaatctcccaaggttggttggtagtgccaatagtaaggattgtgatgtaaacccatttgcacaaggattgaagatggatcttcaaagggttgaatgtaaggtatttggttcgaagtttgaatgtgtttggatgaaaaatgaagatgataacaatggtgttcaagtggaattaaagaatgaag

SEQ ID NO: 45032 - DNA, 4659 bp, Glycine max
  Peptide Sequence Number=SeqID_136717
atgtcggcgatggagaagcacgtcgtgcagatcttcgagcgaaagaagcgaatcatcgaccaatcacgacaacagtgccatctctgggagcaacaccttttccccaaactccgcctcaacggaattccccctccgccatggctctgcaactcttcccgtcacgcagatccacaagggttaagcaaagatgatctcgtttccgaagttctaatttcgcaaccacaatatagagttcctttccccagtgtgtgcagcaatctcgattctgtgtcctatggtgttcagtatccaattggtttgcataatgaaggtcgtgctttagaaaaggagtgtaacacgggagatggggtttcgaattttccagattgtcctgtcaactatgctgtatgtgcctcaagtggtcctcctgaattggattcaggtgctgtatcaccacctcagaatcagattgaaacaagggcctcagacagtcaccacgacccagctccgtctctcgcaaagttgcaaaggtcaaagtcgaggcagaaggctctggagctacgtaatagtgcaaaagcacccagacgattgtcaggagaagatgataatgcctgtgtctgtgctggcacagttacaggttctgcaccctcaactcaagaggcagaacatgcaatggagtcggatgtggtcaaagattttcattccaacatccaaagttgttccatggaagaaatggaagcatgtgtctatgtaactaactactctggccggatgacaagatctaaaagctcatcccagaaattcaactctttgaatgttgctagtccttctgtagcgaaggaagatggccctctgcctaataatttgaatgagtcattcgagatagtcaaccaaccttgttttgcaaatgcaagttgtggcatcaatgaagcaaataaacgagagtatcagagcaaggaagctggaaaaagtgtgtatgatgagagattaacagaatctagaagttctagccaggccagatgtaaccgtgaattgttgaagcttgatagcaccttgggcagtggcaaaggagttgacttctgtgatcatagacaaccaattacacatgctcaactaacagatttaagcaaagcctctgattgtaacaatggaagtggtaggaatacagttaaagatggcaattcctgcctcagcaaacaagaaagtaacattcatggtatgataaagttacttagaggttcctgcccgtcaccaggtcatgatcttatgatgactggtggttttgtaaggtctattgacaaatcagtgccattacctcaaccttcaatttcacagaattcacaggatcttgtgctgtctgttgttgggacattcaatagtcaaaaggatctggacttttctgcgctaaaaccaaacgatcgtttgagtagaagtggttctgaaaagattgaaaaagtactgaagtcttccagatacaatttctgtgagcagagtgctacctgctctgaatctgctggtaagaagtcttggaatgtaccgcctaccaaactggatgctagaaggttatcctcaagtccagagtattccaaattagatacagaaattggcaggaattctgcagacaaggagaacgttgcggcactagctgcttctggaaaaatgagggctgtggttacttctgcaaatgaaggatcattaaggccagtgagttcttccaatttatatggtgggccttcaaatttagaatcagtatatgttgaagcagcggtggatgagaaagtcttggatgttcaagaaaatataccgtatggtgcccttcccactgataatgttgagcacagatctgctgcaattgttggcaaagttgaagctgactttgatggattagttgaaaaagatccttattgtgttatccctaaggttgggcagaatgtatcagtcttgaagccgcccactgattttaccatgtctgtgatgcctaagcaacttgattttgatgatgtagaggagacaagtatgagtggaatttgtagtcctgatttgaaagagggtcaacagggagtgtcaccagaagaacctctgaactctttggaacctgtaaaattacttgaagaggaaacttcttctgtatgccaaagtaagtgcaactccttaggggagatgccttcgctgcaaatgcaggaagtaccgatcagagaagaggagcctcgtatggaatattgtgcaagtcacttagaggaggaagatatagctagggaaacactaagtgccgcgccaccaaacaaagagatgcctatggttcagaatggattctgtattcttacttcttcgttgatgaatcattcttgtccttcacaagttgccggtgaaaattcatcaagaagtttgtcaaaagaagttatgccaaccaaatttgtttcagtaaacagtacactagaaaatgatgaaagtagtgctaagttggcagattcttctgaagcagttacgggaaatgatctgcataaatccacagatgcaaatgttacaaatttcactgttgcgttcccattttctgctcccatggctgatgtgaatgttggtttggcacgacagggccctaatagcattaccttgtgtcaagatggtgacgtgttgcggaagacattgctcagcgaaggaaaaattaccagtttttcacctgatttccagattttcagaagttccactaaaagtttcacttatgatgtggaacattcttgtcctcagcataaaagaaggaagattgaaattgaaacggagagatttcgagccgcctcttcaaacctcttggaaaaaccatgtgattctattgaccaaaggcccgcaagtagaaacttgagtattgaagaagacagccgggagattgccctagaagttcaaaatttgccatctgatccagaggatgatataggacatcaatctattagtaacatcccaacagatgaaatgcaatacaacggggaatgccaaacaatggaagactcttcacttaaagtgcgaaaagaagagaaatgtactttggatggaagagacagaagtgaagacacccttctgttggcagtggcaaatccatcaggttttagtattgactcaacgatgggatgcaccatggatgagaaggtggagtcgtggcatcatcaggtcagttgtggacaggaatgtgcagaacatctgagttgtgttgaaaaaagcacctcaagtagaagagtgtatccaggaggaaatgctaaattctcagatggaatgtctgcttctccaggaatgcaatgcttggatttggttggtacagatgagactataccagagcttgaagggttcattatgcaagcagataatgcacagccatgcattactggagatcaaatggatttggaagagatggatttggaaaagatggatttggaagagatagatcttccaaagccctatcagtctttacctaatggacttctgaagggcttaggtataaggacttcccttcctctaagcgatggaagtccaaggtccctttctgattgccaaccaaattgcaaggaccttccctgcattactgaagaaaatgaaaatgtggacgagattcctggtacattccaaaggggcattggttccgaaggaatggctggtggacgtaaagatattttaagcacagagtttaatctcagtgggacttgcgataaggtaaaaaataagcttgacaagcaggatggcaataggaaaagattcacaagaaaggggaaggagaaccataatatttctcttggagcgaatggtgtcaagaggactgctggatcagtttgcaaaaggccgaagttatctggaaaagatagtatgaaacaaggccccattaacaatattgtatccaacgtttcttcctttattccattagttcaacaaaaacaagcggctgctgttgttacaggcaagagagatgtcaaagtgaaggccctggaggcagctgaggctgccaagcgtatggctgaaaaaaaagagaacgagcgcaagatgaagaaggaggtgttgcgacttgagcgggaaaggttggagctggagctgcagaagaaaaagaaagaggaagaacgaaagaaaaaagaggaacaaatggcagcaaagaagcggcagatggaagatgaagaaaaaaaggagaaagaaaaaaaaaggaagcgagttaatgacaagaagaagcagcagcaagaccatatgaagatacaggccaagaaggaagagataaaaatacaacgccgagctacggatgaagtccaagaaaataagaaaattatagatgaaagagaaaatcataagaatttgtcggtgcaagacaaaagagagtgcaatatggagaaaatttctgaaaccgaaccgttgaccatggtggatttggcaaatgacaaaaaagaatcgcatcctgattattcggaatctgtgaatgattgtgctaataatggacaggtaatggacaatctgattaaagccactgaagatgatgacttgatcataaaagactcacttcaagagcagtcatacgatatctctccatatagaggttcagatgatgaagatgaagacgaggatgaccttccaaataataagttaatcccttcatgggcaaggtttgtgactgttcaagtttttggagcctatctgttttatagcgccattctttaa

SEQ ID NO: 45033 - DNA, 255 bp, Glycine max
  Peptide Sequence Number=SeqID_136718
atggcgtccaaccgaagcagcagctgggctcgcggtgaaggagaaggctcgcggaagaggtatgcaaaggaagaaggagaaggctcgcggaagaaggctcgcggaaggaagaaaagcagaagcaagaagaaggcttatttcaataaattgctgggtgcaccagcaatattgctgggtgcacctagcatatccccaaacaaaatcatagtctcactctcatcagcggggctaccttatattccgggcaattgttaa

SEQ ID NO: 45034 - DNA, 675 bp, Glycine max
  Peptide Sequence Number=SeqID_136719
atgggaaagaaatctttgaagctgccctctcttttcaaaaccaaagaagccccaagaaatcatcatcatccatggcaattcatgccctcttgtggccactcaaagaccctctctttccgtggtggagatgatgacatgttcaagacagttaactctatgttcttcgacccttcagcagagagcactatcgaaactcccaagtcatggttcacaacctcatctgaatctgcaagcatctcaactgagtcagaagactactactactgtgatggggagtctttggagatgttggtacgtggtgtgaggtcagagaggctttttttcgaacctggtgacacaagttccatcttggaaaaggccaaggctagtggatttcccttcaaaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 45035 - DNA, 177 bp, Glycine max
  Peptide Sequence Number=SeqID_136720
atggacgaaggcgccttcgaagaagttccaagcggtgtgcaagagtatgatatcggcgccagtgctgtcggcgttgttgacgatggaaatctggtcggcatgatcgagattgatgaggatacaaacagggcaggcaagacacctatgactatgatgaagccaggtgcctataaatga

SEQ ID NO: 45036 - DNA, 1749 bp, Glycine max
  Peptide Sequence Number=SeqID_136721
atggcaatcaggggtgttgatggatggcgagacatgaagagtctgaccgtcaacgtcatcaccgggaggtggttcgtggtgttcgcctcctttctaatcatggcagccgccggagccacctacatgttcggtctctattccagcgacatcaaaaccaccctcggatacgaccaatccactctgaacctgctcagtttcttcaaggacttgggtagcaacgttggcatcctctcaggcctaatcaatgagctaactccaccctgggttgttctggctattggtgccatcctcaacttctttggctacttcatgatatggctatccgtcactaaaaaaatagcgaaacccaaagtgtggcagatgtgtctctacatctgcataggtgctaactctcagtccttcgccaacaccggttcccttgttacgtgtgtcaagaactttccagaaagccgtggcgctgtgttgggcatcctcaaaggctacgtgggtcttagcggtgcaatcatcacgcaactctaccatgctatttactatgacgacacaaggtctttgattttactcattggttggctccctgcagctatttcctttgctttccttcgaaccattcgctacatgaagcctgttaggaagcctaatgagctcaaggttttctacaactttctctatgtttcgcttggccttgctggctttcttatggtcatgatcattgtacagaacaaagtcgacttcactcagagtgagtttggtgtcagcgctgctattatgctcttcttgctcttcctcccacttactattgtttctgtagaagaatataaggtctggctgagtaaaaggctcgctttggttgacccctccccggtgaaaatagtaaccgatcaggtcatgaaaccgaatgagcctactaacaatggtaacaattcagtttccgatgacacaaagtggtgggaaaatgtctttagcccaccagcaagaggtgaggactatacaatacttcaggcgctattcagcgtcgacatgttaatacttttcatgacttgcatatgtggtgttggaggcacgttgaccgcaatagataatctgggtcagataggaacctcgcttaggtaccccaagaaaactagaagcactttcgtgtccctagtaagcatttggaattatctgggaagggttttctctgggtttgtttctgaatattttctacaaaagtacaagttccctcgtcctcttatgcttactttgactctgctcttgtcatgtgttggtcaccttctgattgcgtttgatgtgccgaatggcctttacgtggcttcggtgattattgggttttgttttggcgcacagtggcctttactttttgccattatatccgagctttttggacttaaatattatgcgactttgtacaattttggaagcgcagctagtccactaggactatatgttcttaatgtgaagatgactgggtatctgtatgacaaagaagccaagaagcaacttgcagcattggggcttaaaagaattgaaggacaggaattgaattgtgttggggtccattgcttcaagttatctttcattattatcacagctgcaactttctttggtgccattgtttcactcatcttggtggctaggacaagaaccttttacaaaagtgacatatacaagagatacaggaatgcagccacggagtcagaaactgaaatggctgagaaagattccaaacatgtggtgccagctcagaagtag

SEQ ID NO: 45037 - DNA, 456 bp, Glycine max
  Peptide Sequence Number=SeqID_136722
atgagggtggcaatagcaatggaaagattggatggagagaaagttggtgaggagatggatttacttgcttatgaagcacacatggcctatttcactggaccaagacataacgtgactggatgggcttatgttgtagggtatgggagtgtacaacagcaaatcatatttcacttgttggctcaacatcctccaacaaaaacatcaacacaaattcaccacctccacaccacaaacccaatcaccatcccaaacccatcgacaacaatcacacatattcaacatggaggtagatgcaaattcaacaagacaacaaattcaaccattgatgggggtgatcaacgcaaggtggtcgacgttacaacacaaatctcgacaggcacgaggttgccaacacaacatggaggcataacacaggacttcaatagaactgttaattgtcattatggctgtgggtag

SEQ ID NO: 45038 - DNA, 450 bp, Glycine max
  Peptide Sequence Number=SeqID_136723
atgaagaacgatgaagaatttccacagaatcacttacggaagcgttacggaagcacttcgactcgatttttcttcacgaaaacgtgttttttgcccaaaatagccgaaatgcatagttcaggggtcatgaatatttttgaaacagccccctcccctatttatagggaaaaagagaggtgtttgccacccagaggcttcttgaggaagatttctaagcgcaccccaattactaagttcaccccccttttcatactttacggaaaagttacggaagccttatggaagtgtttcggatttgattttcatctttttttctcttccctttcaccaatgttaagtgaaatatgcttatccaaggttttcggaaattttacggaagcattacggaagccccagaaaccattttttaacaacgtggaggagcttgtcgtccagttgcttcctccttaa

SEQ ID NO: 45039 - DNA, 162 bp, Glycine max
  Peptide Sequence Number=SeqID_136724
atggtggttcggtgtgatgtggaggttcatggggtcatagtgatgcatgtggtggtggtgggtgattgggtggtgacacgatgttggggtgcaatggttatggaggtttggggagagttggtcatggacatttcctcgagagaggatgaacaagaaaggtga

SEQ ID NO: 45040 - DNA, 885 bp, Glycine max
  Peptide Sequence Number=SeqID_136725
atggtgatgcgcaattcatcaagcactttggtagatacagtgattgaggacacgcacattatcaatggcaagccggtggagattaagcagacgataccgagggaggctgctggctggaactcaaaagactttcgaacgaagaagatttttgtgggtggaattccttcgactgtaactgaaggtagtgtagttcgaaaaatatgtttaaagatgcagcttctaagggtactaccaagtctgcatccgtatgtgatccttttccattgggacgttccccaagccttagaggatgagtatggtggttttttaagtcctcacattgtagatgattttagggactatgctaaactttgcttcaaggaatttgacaatagggtgaaacattggattactttgaatgaactgaggagtgtgagcaagaatggctatgcaaatggcaggattatcccttcatgggctttatgccattttattattcttgctgatcctctttttcttttcctcctcgcttcagaaggacaggatgaatatgaaaatgatgggtttataatggataaggacgaagaggaggatgagaaagaagatagagcagaatccgatgatgagccacagaagaaaaagaagaggaagaaaaaggaggagtatgtccttgatgaagatgattatgaattgctggaggacaataatatcaatattcatcgtcggaaggaaagcaaaaagtttaagcagctgaaaaaaggcaggagggataccgaggaggagccctttgggctgtctgatgaggaggagtttgttggaagtggtaaagttgggcgaactattgaggagaagcttaaatgcagtttatttggtgatgatgaagttatgcccagtgtcagtgattag

SEQ ID NO: 45041 - DNA, 762 bp, Glycine max
  Peptide Sequence Number=SeqID_136726
atggctgaagccacaaaacctatcatcaatgtagacgcttccaaacccacaccaccgaccgcaacctttgccaagtcgttgcctgacgtctcaaaaattgaggtcttgactagccaaaactttcgccgcaggcaagaacgcgttcgtaccttgttggacatgcatggagttgtcttcgctctttccactcccaaacctgatgccgctattgatgctaatcaacttcaacaatgggttcaggctaataagagattcatcatccccaactactaccaatggaccatgaacgaagaaaaagacaccaaggaacaaatcaatgaataccacaagctgctggaagacctgaagcctgaaaatatctctctacttgacgagttcatttctgaactcctgattgagaagttgtcaaagtcttggacaaatagcaaacaacagttaaagcacagacacaaacatatgtcactaccagaccttatcatccacattatcactgaagatacaaataaaaaggaaagtgttgtagcaaggaccaaagtaacgtttgccaaggcaaacacgaaacaagacaaaccgtttcataagaagtatgtttacaaaattgatctcaataacaagaaaaattacaaacataataacttacgtgatgctctttctaatcccatcccacaatgcaagtatagagttatgaaaaatgacaatcctcctaagcttaaggctaacctggttgaaggagatgacattattgttgcggtcatttattaa

SEQ ID NO: 45042 - DNA, 129 bp, Glycine max
  Peptide Sequence Number=SeqID_136727
atggtggcagagggagttgctgttggtcgatgcttcatggtgggaaaagcagctttctcatggatgaatgatcaaacacaaaaaatagatgcaatcaaaatagttgacttttcggtccatgttgcttaa

SEQ ID NO: 45043 - DNA, 1131 bp, Glycine max
  Peptide Sequence Number=SeqID_136728
atggaatcactacttgttgaagacattgtgattgtgggagctggaattgctgggctcgcaacatccttggctcttcataggttgggtgtccaaagtttggtgttagaatattcagatactttgagggtcactggatttgctttaacaacatggactaacgcttggaaagccttggatgctcttggcgtcggagccattcttcgtcaccaacatgtccagctaaaagagaatgtgactacatctttgattatggggcaacaaacatcaagcttgtctttcgagggcacaggaaaacaacagttaatgttggaagcaattgctaacgtgcttccaagtggaaccatcagattcttgtcaaaggttgttgctattgaggaatctggtttctctaagattaagatagtccgtcttgctgatggaacaagcatcaaaaccaaggtattgattgggtgtgatggaataaactccgtggtggcaaagtggttgggcttcaaagaggcctcttttaccgggagatacgtaatcaggggttacaaaaaggtgatggataatcatgggcttgagcccaaattcatgcactactttgggaagggctttcgatctggtgtaatgccatgtgatgacaaaactgtttattggtttctaacttggactcccaccagtgaagagaaggagctagcaaataacccatccaaaatgaagcaattggtgttgagaaaggttgagaagatgccaagcaatgtttgtgttgttggagatgcatttcaccccatggcccctgacctagggcaaggtgggtgttgtgccttggaggatgggattattttagccaggtatctagctgaggccttctccagaaaaacttgcaaacatgttgttaaaaagatgggtgaagagggtaaggccaaggagcaatacaaaaaaattgatgctagcttgaggaaatatgcaaaagagagaagatggagaaacattgatataagtgttacatcttatgttctggggtttgttttgcagggtgatttgaaaatggttgcacattttagggacaaagttttgcctgatttcctagccgaactgctgttgaagaagtcagattttgattgtggaaaacttaacgcctctagttaa

SEQ ID NO: 45044 - DNA, 375 bp, Glycine max
  Peptide Sequence Number=SeqID_136729
atgtcagaaaagttgatattaaccagcatttggttaacattactaggaaaaactccacctgataagtatgtaaagagtaaaatgatttatttaagctggttgcgacaaaattttcagcaacttcatgatgttgatgatattgtcattgcacaatacattaggtgcaacactccaccatctgcatataatctatcaccatcgagctcttgttatcgttcatcattacctactcaaatacatgacatgcgtcataaagatgaggaggatgacgataacaacactaccaacaataacgatgatgatgatgacaacggtggtgatcatgttcctcaacaacaacacacaattacacatgagtatcctgtaacaagatga

SEQ ID NO: 45045 - DNA, 159 bp, Glycine max
  Peptide Sequence Number=SeqID_136730
atggagtggagcctgcggcttaatttgactcaactcgggaaaacttaccaagctaagatatatggtggtgcatggtcgttcttagttggtggagcgatttgtctggtcaattccgataacggacgagacctcgacctgctaactagtagtatttattag

SEQ ID NO: 45046 - DNA, 447 bp, Glycine max
  Peptide Sequence Number=SeqID_136731
atgacttgttgttcccggaggacaaaaggtgcagaagactatgtcagtctctgcatgccatcaagcgttctgtctacagatagcaaaagaatgtttatacggataaccactcgggtatttcccgcgtatcatcgggcccgccgcctctggatgatacaagggtgcagaatgaccaaacttggtttctgcttgtcatcgggcccgccgcctctggatgacaaaagggtgcgaataaccataagaatgaccaaacttggtctcttcttgtcatcgggcccgccgcctctggatgacaaaagggtgcgaataaccataaggtatctccgcgtatcatgggtgcagaatgaccaaacttggtctctgcttgtcatcgggcccgccgcctctggaagacaaaagggtgcgaataaccataaggtatctccgcgtatcatgggtgcagaatga

SEQ ID NO: 45047 - DNA, 789 bp, Glycine max
  Peptide Sequence Number=SeqID_136732
atgaaattagaattatatcagatagatgcatttacagatgagcttttcagaggaaatccggcatgtgttgtaccattaaaagaatggcttccggatgaaactcttcttaagattgctatggaaaacgcggttgccgaaacagcattttttatagacctcggttcaagaatacatcttcgctggtttacccctgaaattgaaatggatttatgcggacatgcaacactggcaacggcccattgtctgatttcagttttaaactataacaggaatgaaattatctttgaaacaaaaagtggcgatttaaaagttacctacagggatgggctatattatcttgattttccttcgagaatgccttccccgtcctctttaccggatttgatttcaaaatcattgaatatccagcctaaagaggtatttaaatccagggattatgttctggtatatgataatgaagatgatatcagaaacatcaaaatcgacaggcaaatctttgatcagatcaatctggacccgggtggcgtgattgtaactgcaaaaggtgaccacagcgatttcgtttcaagatattttacttcgcaggcaagtattcttgaagatcctgtaacaggctcggctcattgctcattaattcctttctggtctgacagattggggaaaaaagatctttttgcaatgcagctttccgaaagattaggaaagttatattgtgaggatcagggtgatcgggtgatcattgccggaaaagcaaaaacgtatgctgccggacatctgtggacggaatga

SEQ ID NO: 45048 - DNA, 197 bp, Glycine max
  Peptide Sequence Number=SeqID_136733
atgggagctggccatgcccgaagtcgttaccttaaccgcaaggagggggatgccgaaggcagggctagtgactggagtgaagtcgtaacaagggctctcagccacatggatagtttaatgtgctcatcggcgcctgaccctgagatgtggatcatccaaggcacattagcatggcgtacttctctgtttgaaccggg

SEQ ID NO: 45049 - DNA, 339 bp, Glycine max
  Peptide Sequence Number=SeqID_136734
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctctttcgctccaagctggactgtatgcacgaaccccccgttcagtccgaccgctgcgcctttatccggtaactatcgtcttgaggtccaacccggaaaagacatgcaaaagcaccactgggcagcagccactggtaattga

SEQ ID NO: 45050 - DNA, 240 bp, Glycine max
  Peptide Sequence Number=SeqID_136735
atggatgtcttgtgtcttgttggaacaagtgtgaaaccaaccaaacacagagggcggatgcaatctaggaatgcgggggcccgaggaattgtctccttcttagatacaacgtctaggggtagcaaagtgccccaacatacgttggtttgtttacagaggggatcaagacagaacccatatgcgatgcatatgcaaaagacgcaatgcgggaatgtacatagtatgacaatattcacataa

SEQ ID NO: 45051 - DNA, 903 bp, Glycine max
  Peptide Sequence Number=SeqID_136736
atgggatcaagtcaaaagccttcgcttaaacagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggaatggggtagtcggagtaccaaggaagtgtttggaggaaagggcaaaaggccttggcaaatcaaggcgactgggctttcttttattgacatcttggcgctctggatctttggagttgtcctctttccgaatatggaagggttagtggacctagcagcgattgacgctttcctcgcctttcatcatggcaaggaaagcccagtcgacgccattttggccatgtatgacacattcgaccggggaggtgaaaagagtggcgcaagaattgtttgttgtgcactggctctctatgtgtggctggtttcacacctttttctccaagaaggaaggaagaatcgggattctatcttcatacgaaggatgtctaaaggttcccttgatggaacaaggggttgtattaattataatcccgtcctcgccataagacagcttggctacctcatgagaggagtgccatcagacgaaagcatcacgcctttcatcgcacggggtttcagtgaccacaacgcgagggtactccaaggagttcgcaaggcatgggatgcggcgtga

SEQ ID NO: 45052 - DNA, 372 bp, Glycine max
  Peptide Sequence Number=SeqID_136737
atggaactccaacgtcttaatcaaaatgaagaaactgacaaaaagaaaagaagtatagcacttaaagcctccttatcaatgcaagaagaaaatgaagaaaagaatcagatgatgaagaagacttctcactatctaagaatcgagagaagtcagaacttcaacaatggaagaagatctcaagaagattctcaagttcttagattctacaaatgcaaccaacttggtcacatcaaagcaaattgtccttcaaatgaagaatggcctgagaaaagcgataagaaaaggtatgatgaaagaaggaccaagaagcgtgcattgcatgggatgacaatgactcattcgacggttccgagaaggagatcaaccttctaa

SEQ ID NO: 45053 - DNA, 414 bp, Glycine max
  Peptide Sequence Number=SeqID_136738
atgaaaatagaaaaacatgtctcctatagtagtcatgactcttgcaagagtttaagcgaagaacttagcgactattatagagggcaccatacgtcacatactaaacatcactcccaaagaagagaaaaagataaaaggcctcaagagggcccacctgggccttctagggggttccaacagaaggcggtgccttctggtggaagcaacccagctcgcctaggcgagctgagcccgcctgggcaagctgagctcgccttggagaactgggcggcaaccacctccctcttttttcctataaataggggaaagaaggcagaggaaaaatgttcagtccttctagtatttaggattctcgcgaaattagtgaggaaaattgtttccgtcgaaaaaatccaagccgaggtgcttccgtaa

SEQ ID NO: 45054 - DNA, 833 bp, Glycine max
  Peptide Sequence Number=SeqID_136739
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgacatcgctctaactttcgatttccacgataatccgaagtccacacccacggtggccaagaatgaaccagtggtcagcgctcccccgctacttttgccccctgccccagctccgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45055 - DNA, 390 bp, Glycine max
  Peptide Sequence Number=SeqID_136740
atgattatgaggggccaagacatttatagtagccaagatgaggctactacttcaccttcctctagtggaagtgaagaagcaaaaggggaagaatctagtgaagaaatctacccccaagaagaaggacaacctttaatggttaaggtggagtgtaaggaggtaagtgtctcctccaagaggtttgctaaaaaggaaagtcatttttcaataaataaaaaaattaaagaaacttcctctcttagacaacctccacatcttctcctttgtaaaaagacacttgttagcactgccacacctcttgggcttgaggttattcctcaagtaaagaagttgttggatgaggatttggtattattaggcacccaacatcttcatgattcgtgtacatag

SEQ ID NO: 45056 - DNA, 141 bp, Glycine max
  Peptide Sequence Number=SeqID_136741
atgtcgcagaacttcacggattgtgctacgatgccttcttttgactttcggcacatcacggaacttcacgaattgcctaacgatgggtgccaagaaaaggggcgaatctgtatctacgcttacccagctcgccagagctag

SEQ ID NO: 45057 - DNA, 384 bp, Glycine max
  Peptide Sequence Number=SeqID_136742
atgcagttatggtcagggattcggcgagaggatttggaccgcgtaaagcaaactcgaaacggcatagtgggcctaccacggaagtacttagaaggcaaggcgagggatatggcgaatcaagaggagtgggtcccatttatagacgtattagcattgctaatctttggggttgtcctcttcccaaacgtggatggtttggtggacctagccgcaattgacgctttccttgcatatcaccatagcaaagagagcccgatggtagctatattggcagacttatttgacacatttgacgaagatgtgaaaagagtagtgcatggatcatctgttgtttacccgctctttatgtatggttggtttcgcacttattccaacaagacataa

SEQ ID NO: 45058 - DNA, 345 bp, Glycine max
  Peptide Sequence Number=SeqID_136743
atggtgttttttgaggtgctccagtggcttctgtttctatcagctgtccctccctgttcagctactgacggggtggtgcgtaacgggcaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtttggtcgtggtaaaacgaagcccagataa

SEQ ID NO: 45059 - DNA, 890 bp, Glycine max
  Peptide Sequence Number=SeqID_136744
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaataaactctccaacaagtttgtccaaaagacgagcactggtacgtggggaagagcagtctacattgtgctttatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45060 - DNA, 159 bp, Glycine max
  Peptide Sequence Number=SeqID_136745
atggggcactgcgcccccaaatgcgcaatattggcgatcagaattgccattccttggattatagggttgaaccaagctcatgcttttacaaaaaggttcatcaagtcaaggttgaaatatggaagtgaccgtccctgcaaaactggggcaaaaggatga

SEQ ID NO: 45061 - DNA, 600 bp, Glycine max
  Peptide Sequence Number=SeqID_136746
atgcacccttttgtcatccaggcagacacagtggtgtccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagacaccttacggttatctgcacccctttgctaggcagacacagttgtgtccgatggcaagcagagaccaagtttggtcattctgcacccaatgatacgcggagataccttacggttatccgcacccctttgctaggcagacacaattgtgtccgatggcacgcagagaccaagtttggtcattctgcacccatgatacgcggagataccttacgagaccaagtttggtcattctgcacacatgatacgcggagataccttacggttatccgcacccctttgccattcagacacagtcgtgtccaatggcacgcagagaccaagtttggtcattctgcacacatgatacgcggagataccttatggttattcgcacccattcttttgctatctgtaagacagaacgcttga

SEQ ID NO: 45062 - DNA, 219 bp, Glycine max
  Peptide Sequence Number=SeqID_136747
atgggtgcaagggataaatcaatcatgcacaagagattcatgcaaaaatcattactcaatgttagtcgttctctcataattaaagatcacactttcactgggttgcggctaatgcgttccttcacaatcaacctgacaaaccaactaacatcttcagtcatgatcataattccatgttctttctcttctaatgactacatgttcattcaaggcatatga

SEQ ID NO: 45063 - DNA, 147 bp, Glycine max
  Peptide Sequence Number=SeqID_136748
atgggggtgcaaatagcaaccaggcccacttgggccctccagaagattcctccagaaggcggttgcttctggaggaagtcaccttgctcgcttggccgttcttcgacgttcttcgttcgttcgtcatcgttcttcggtcttcaacgg

SEQ ID NO: 45064 - DNA, 543 bp, Glycine max
  Peptide Sequence Number=SeqID_136749
atgatacgcggagataccttatggttattcgcacccttttgtcatccagaggcggcgggcccgatgacaagcagagaccaggtttggtcattctgcacccttgtatcatccagaggcggcgggcccgatgatacgcggagataccttatggttatcgcacccttttgtcatccagaggcggcgggcccgatgacaagcagagaccaagtttggtcattctgcacccttgtatcatccagaggcggcgggcccgatgatacgcggagataccttatggttattcgcacccttttgtcatccagaggcggcgggcccgatgacaagcagagaccaaaggcggcgggcccgatgacaagcagagaccaagtttggtcatcctgcacccttgtatcatccagaggcggcgggcccgatgatacgcggagataccttacggttattcgcacccttttgtcatccagaggcggcgggcccgatgacaggcagagaccaagtttggtcattctgcacccttgtatcatccagaggcggcgggcccgatga

SEQ ID NO: 45065 - DNA, 632 bp, Glycine max
  Peptide Sequence Number=SeqID_136750
acattgttgacatcaagttgaataaggggccatttggaagtaagagcaatggtgaggacagttctcactgtgattggtttcaccactggagagtaggtgtcactgtaatcttgaccatatttctggttgaatcctttggcgaccaagcgtgctttatatttgtttatggtaccatccgggttctctttgatcctgaaaatccatttgcacccgatggctcttttatgaggaggaagaggtaccaagctccattccagtggatagatgaaagagcttgctgcacagtggttggttcagtggttgttagattgattgtgggaaagagaggaggtgaaggagaggaagtgggagtggagttaggatcaatggtggaggaagctgtggagggtaaggttggagttggagaggcagaggcactgatgtatggtgaagatgtgtggctgggaaagaattcagagattgaagatgatcctttcttcgtgaaggaagaatggcaggggaaagagatgattgcagccatgctaagaggagctggtcctgttgggaatccattgaagaagggaagattcagaggagagaggaaagaaatggaggatcttgccacgcttgtggaagaatcagaaggctcttga

SEQ ID NO: 45066 - DNA, 225 bp, Glycine max
  Peptide Sequence Number=SeqID_136751
atgtcctcgtgcgtccgcttctcttcgaacaggactgtcgcaacctacccttcggcgggagggcgacgcgtgactcgcgggatgcgtgttccacgaaaggaatacgcgcagagtcgccaccaacgtttatttgaggaaaacgtcggaaaaaccggaaaagacgcgatctacgaacttttaagtgaaaggttcgggagttgtatttacgcacggggaagtgcttag

SEQ ID NO: 45067 - DNA, 329 bp, Glycine max
  Peptide Sequence Number=SeqID_136752
ctgtccctcctgttcagctactgacggggtggtgcgtaacggcaaaagcaccgccggacctcagcgctggcaaagctgcgcaactgttgggaagggcgatcggtgcgggcctcttcgctattacgccagctggcgaaagggggatgtgctgcaaggcgattaagttgggtaacgccagggttttcccagtcacgacgttgcggtttgcgtattgggcgctagcggagtgtatactggcttactatgttggcactgatgagggtgtcagtgaagtgctttcatgtggcaggagaaaaaaggctgcaccggtgcgtcagcagaatatgtga

SEQ ID NO: 45068 - DNA, 297 bp, Glycine max
  Peptide Sequence Number=SeqID_136753
atggtctttggtaatcgattacataggatgtgtaatcgattaccaggcctaaaaaggggaccaggaagtcaagatggcttctgggagcttgggagaccctcgaaggaagaccctgaggaggacccagaggagctacctcctgagcctgttgtggatgctcttgactttctagagcgtgatgaggacccactccctgaggaggattctcccgaggacgtcatgtcggcatctgaggcagactctatggaggagagtggccctagagagatggcgactagtggaggctcttcatcatag

SEQ ID NO: 45069 - DNA, 779 bp, Glycine max
  Peptide Sequence Number=SeqID_136754
ggagttctcttctcatgtggggactacccaaacgttccattgatagggacgaggggttgtatcaattataatcccgcacttgccataagacagttagggtaccccatgaggggagcaccaacggaagagagcctctcgcctttccttgtgagagatttcggcgcgcaaagtcttaaggttgtacaaagagtacacaaggcgtggaaaagcccgttgaagaaggataaagaacttaggggcatccataatggcatcatcggtggttatcatgaagatgaagaagtccaagctctaaaattagagctaggaaaggcaagactcgccaaagaaaaattcaagtcagccgcttacaaacacccggaaagagtgtgcggagttacgagaggaaaaatgcggcttttgcaagagcccttgaacaagaaaccaagagggccccgcaaggaagagcatggccgagataaattccgaggagctttgtggggtagcaacaatgagctcaagctccggagagaggaaagagaccagtcacgagtacatggcatgatcttaaaggaagagttagttgcttgctcaagatccaagaggagtttggctcaacacttagaagccatggagcgaagcatgctagctatcataggacagtacaaggaagagttaaaccagtctttgacccatgaacaaaaactagtagaggatttcgcacaagcgtacgccgaaaaggaagcaagagggagagtgattgatgcattgcatcaagaagcaaccatgtggatggatag

SEQ ID NO: 45070 - DNA, 406 bp, Glycine max
  Peptide Sequence Number=SeqID_136755
ggcgcggcggtcgctgcaaaacccagggcgcgagcccgggcggagcggtcgtcggtgcagatcttggtgggacgggggaagcccgtctgatagcgctctgtgcgcgtactccgaaagggaatcgggttaaaattcctgaaccgggaccctgcccaccctggaaacggcttcaaccgggagggaccgagtgcctccccacgcccggtcgtactcataaccgcatcaggtctcccaagggtgaacagcctctggtcgatggaacaattcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 45071 - DNA, 219 bp, Glycine max
  Peptide Sequence Number=SeqID_136756
atgaggacacgtagccctctaaaggtgagggcgtgcagccctctcaaggcgaggatgtgtagtcctttggaggtgagggcgagcagccctctgttggcgaggatgtgtagtcttcttcaaggtgaggggaatgcagccctttgttggcgaggacgtgtagtcctctcaagggtgagggcgtgcagccctctgttggcgaggacgtgtattcctctaaag

SEQ ID NO: 45072 - DNA, 317 bp, Glycine max
  Peptide Sequence Number=SeqID_136757
atggggatcgcacccacaaagacacctaggggacctgaagaagtccaacagggccctggggtttccagctctggttacgggcctctatcagtcctacagggtgcccggatcgcgcccgcaagacacctagtggacccgaagaaggccaacagggtcttggagttgccagctctaaatacgggtctctatcagtcctacggagtgcctgtcacctccggcaagggcatcaagccccctactaatcgagctttcatcaagaagtactgcgcccccaggcaggcgcaaggcgaaacaccacgacagcattgggatggccg

SEQ ID NO: 45073 - DNA, 417 bp, Glycine max
  Peptide Sequence Number=SeqID_136758
atgacacgcaaaacgaggcaggattttagcgtttcaaagagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 45074 - DNA, 162 bp, Glycine max
  Peptide Sequence Number=SeqID_136759
atgaaggagcttcaccaccaagaatgtgccttggataagaagcttgaaaaggatgctttaatggaggaaaagaaagagagtaggggaaagcacaaaattgaaggaataaaagagggagggaagtggaactttgaaagtatcttccttgagaagctttcttga

SEQ ID NO: 45075 - DNA, 354 bp, Glycine max
  Peptide Sequence Number=SeqID_136760
atgagcaagaggctccaagaggattgggctagagctactgaagaaggccctagggttctcgtgaaccttagggatactaaggccttagctccaaaggtcaagaagaaggaaaaaaagggaaggtgttcctctgagaaagttgtaaagaaggagagtcatttttcaacaaaaggagatattaagagagctcttcttcttaagcaatctttctaccttctcctctcaagggagacttcctttagcattgccacaattcccccacttgagaccattcccctaaaggtccaagaactcttacaggaatttggtgatgtatttcccaaagagatacccccaggggttacctcctcttag

SEQ ID NO: 45076 - DNA, 309 bp, Glycine max
  Peptide Sequence Number=SeqID_136761
atgctgcgcgatacaaaaaacaaaggcaatgccagccaggatccgcaagaaacggcggccgccatacttggctggctggcaaacgagccggaaatgctgggacgctttctggcgttgagcggattacaggccaatatgctgcgccaggccgtcagcgatccaggttttctggcgggactcaccgatttcctgatgagccacgaacccgatctcatggcgttctgcgccgcaactgacacgtcgcccgaaacggtggctgcggcctggcaccacttttccggacccgggctggattcgggtgtgtattaa

SEQ ID NO: 45077 - DNA, 444 bp, Glycine max
  Peptide Sequence Number=SeqID_136762
atggcaaaagaatcctcgtattcccccgaagatagattattacgagctatacttggcattcagaaacgattcgtatatatattttacagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggggtgtgggggttacgcgcagcgggaccgctacacttgccagccgctgatgtccggcggtgcttttgcc

SEQ ID NO: 45078 - DNA, 312 bp, Glycine max
  Peptide Sequence Number=SeqID_136763
atggcgattcaagcagaggaaagtagagctgatcagaaggtgaaagcatttaaaccacagttggctgatgaattggcactggaaccggttgatgattcagttgaacttgaagaaattgttgaggaagcagaaggtgatgaagaaggagagccaccaataagagactgtcaagagaaaataaagaagaaggaagaaaaagaaaaaaaagaagaaataaaagaaaaagaagaaaaaaaaagttcaaaaatgaaaaataaaaagaaaaggtcgttgagtttgaaaagaagaagggaaagagtgaggctaacataa

SEQ ID NO: 45079 - DNA, 483 bp, Glycine max
  Peptide Sequence Number=SeqID_136764
atgacaagcagagaccaagtttggtcattctgtacccttgtatcatccagaggcggcgggcccgatgatacgcggagataccttacggttatccgcacccttttgtcatccagaggcggcgggcccgatgatcgcagagataccaaaggcggcgggcccgatgacaagcagagaccaagtttggtcattctgcaccctttgtatcatccagaggcggcgggcccgatgatacgcggagataccttacggttatccgcacccctttgtcatccagaggcggcgggcccgatgacaagcagagaccaaatttggtcattctgcacccttgtatcatccagaggcggcgggcccgatgatacgcggagataccttacggttatccgcacccttttgtcatccagaggcggcgggcccgatgacaagcagagacaaaatttggtcattctgcacccttgtatcatccagaggcggcgggcccgatga

SEQ ID NO: 45080 - DNA, 354 bp, Glycine max
  Peptide Sequence Number=SeqID_136765
atgtctaaggtttctagagagagaaaggtccaagttccagagaattttgagagattttactgtgggaagatctgtggagaccagagcttgaagcaggagccgggcccattcaacagtggacattggtctaactctaaattccttgatagtatagggctaagttttccgcactatcacgaggaatcgggctgcgataagttagttgtgtatgtgtgtcttaatgcagtcctggttgagtttagtcttacaagaggaatctgcggacgatgcttgatcaggattaggctaaacaatcatgaggaatcagggtttagtatctcaggagacaccataagaacacatgagcattgttag

SEQ ID NO: 45081 - DNA, 440 bp, Glycine max
  Peptide Sequence Number=SeqID_136766
atgggtattaaacattttgaagtgacaaatgaaggtcgcatgctgataaaaaatggtccccggatgaaattagggtttgacaggtcctcttccgttgaggctgaaaagcaacgcaaggatgtctcttacgatgttagagattggatctatgttcatctacaattttatcgacaattatcggtttttggtactacatataccatgctcgccaaacactactatgggctatataagatcattgagcgtgttggggctttacctcccacattccatgatcatcatcccttgatccaaccactcactattctgcaatctaaatgggaccaggctttttctcccccatttagtgggtgctggtacaatggatgggtctatcgcctaaagatgccacttgggaaaggtgggatgagctttcacaatcttttcaccttgaggacaag

SEQ ID NO: 45082 - DNA, 234 bp, Glycine max
  Peptide Sequence Number=SeqID_136767
atggtgaaagttggaacctctttacgtgccgatcaacgtctcattttcgccaaaaagttggcccagggcttcccggtatcaacagggacaccaggatttatttattctgcgaactgtccctcctgttcagctactgacggggtggtgcgtaacggcaaaaagcaccgccggacaatcagcgctggcaagtgtagcggtcccgctgcgcgtaaccaccacaccccccgcgcttaa

SEQ ID NO: 45083 - DNA, 473 bp, Glycine max
  Peptide Sequence Number=SeqID_136768
atgaacgatatcgtcataggcgacagtaagagggctaagagtggtagggggagcaagtttgcccctatcgctattcctatgtacgagtgggcttctgcagaggtcaactcataccctagttggcttcaaactcttgtgtctatcgagggtttgaaggggaggggcgaggttgactttgtgtatatgaacgaagacgtatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 45084 - DNA, 447 bp, Glycine max
  Peptide Sequence Number=SeqID_136769
atgcccatgaagccaaatgaagtgattttgggttcattgctcgcagcttgtaggactcaagggaacattagtttggctgaaaacgtgatgaattatcttattgaattggaccctgggggagattccaattatgtgcttctttctaacatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcatttaagcgcggcggggtgtggtggttacgcgcagcgtga

SEQ ID NO: 45085 - DNA, 444 bp, Glycine max
  Peptide Sequence Number=SeqID_136770
atgaccatgattacgccaagctcgaaattaaccctcactaaagggaacaaaagctgtttctctatccgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 45086 - DNA, 541 bp, Glycine max
  Peptide Sequence Number=SeqID_136771
atggacctcatcaaggccgctggactactgaagacagtcaccaagttgggagactgttatgaaggcctagtcagggaattcattgtcaacattccctctgacatatcaaacagaaaaagtgatgattatcaaagagtgtttgtcagaggaaaacctactgatggagtgatagatattgctgtttctgagcatcaaattgccaaggaaatcactgccaaacaagtccagcattggccaaagaaagggaagctttcagcagggaagctaagtgtgaagtatgcaattctgcacaggattggagctgcaaactgggttcccaccaatcatacttccactgttgccacagaatcatttgctgtcaaattacccattgccttccctactgtattgtgtggcattatgttgagtcaacatccaaatattttaaacaacattgactctgtaatgaagagagaatctcctctatccctgcattacaaactgtttgaggggacacatgtcccagacattgtctcgacatcaggcaaagctgctgcttcag

SEQ ID NO: 45087 - DNA, 188 bp, Glycine max
  Peptide Sequence Number=SeqID_136772
gttgtaaacagtggctgttagatcttcgaactaacactattttagtggatttcctccctggcttggagcccccagatgtaggtcaatcaagaaacacactccaaactcgaaagtggaggaaacatgacagccctagcaataacgttcatggggctccgaaaaagggtgagaatggaggattgccttga

SEQ ID NO: 45088 - DNA, 333 bp, Glycine max
  Peptide Sequence Number=SeqID_136773
atgcagagatttcaagtcatccaaggcacatgtaatcgattaccaatggtggttgtcatcatcaaaaaaggggagaatgtaaatcatgaagattttgatgatatcaagaagaatttgcttgagaaagagggagatgtaaatcatgcaagctttgatggtgtcgagaagaaatcacatgtttgtcatcatcaaaaagggggagaatgtgaatattcactaaagaccaagccttgccttaaaacaaagtgctttcaagacatgcaaggctctggtaatcgattaccaggaagtgtaatcgattaccagaagacagggttgagaaatagctgttga

SEQ ID NO: 45089 - DNA, 318 bp, Glycine max
  Peptide Sequence Number=SeqID_136774
atgactagaggcaatccatctgacttacaaccctttgatcctgagatagataggacatttcatagattagttagagaacatttaataccttttgagcattctgttattggtgattttgagcattatagttttgaacattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgatccatttgcttccaaagtttcatggcctgcag

SEQ ID NO: 45090 - DNA, 375 bp, Glycine max
  Peptide Sequence Number=SeqID_136775
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcggggaccgctacacttgccagcgctga

SEQ ID NO: 45091 - DNA, 318 bp, Glycine max
  Peptide Sequence Number=SeqID_136776
atgttagctatcatcaccaagtaccaagaagaactaaatctagccgcggcccacgagcatagagtggcggacgagtatgcccaagtgtacgcggaaaaggaggctagaggaagggtgatcgactcgctacatcaagaggcaacgatgtggatggaccgatttgcccttaccttgaatgggagtcaagagtttccccgactactagccaaggccaacgcaatggtggacacctactccgcccccgaggagatccacggacttctcggctattgtcagcatattatagatctaatggcccatataattagaaatcgctag

SEQ ID NO: 45092 - DNA, 225 bp, Glycine max
  Peptide Sequence Number=SeqID_136777
atgtcagtgaaaaacctcgtcgggcgcctaggagtacatgacaagacaaaccacacactagcaagccaatcagggtcacaatgttttgcgagaatgctcgaaccatatgggatcaacataggcttaaaggagcactcaaactgggtgatccccaaggcctacactccgaagagtccgtcagggcctctccctcctgattcaggtccaacccaaaaaacattttag

SEQ ID NO: 45093 - DNA, 180 bp, Glycine max
  Peptide Sequence Number=SeqID_136778
atgaacagcagaaaccaatcaaggtacatagggacggatgcgagtgggggtggggtcacgaccgaccgatcattgccccttctctgcgcgaaacaagcagagaacgtcgctgcaaggcagcccagtatcctttgtattcacagtttccttttactatttgtttgttttaaaaataagtaa

SEQ ID NO: 45094 - DNA, 162 bp, Glycine max
  Peptide Sequence Number=SeqID_136779
atgtcggctattgagttttctattcaatccgtgaacgaagtttgcatgatgtcgtcgggcctatttcacgatccgttgtcagctattgagttttctattcaatccctgaatgaaatatgcatgaagtcggttaggaaatgttcgatcggcgccatccgatga

SEQ ID NO: 45095 - DNA, 228 bp, Glycine max
  Peptide Sequence Number=SeqID_136780
atgaaaacgtttcagtttgctcatggaaaacggtgtaacaagggtgaacaatatcccatatcaccagctcaccgtctttcattgccatacgaaattccggatgagcattcatcaggcgggcaagaatgtgaacggtcgggtcataggtacattgagcaactgagtgaaatgcctcaaaatgttctctacgatgccattgggatatatcaacggtggtatatccagtga

SEQ ID NO: 45096 - DNA, 839 bp, Glycine max
  Peptide Sequence Number=SeqID_136781
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagtctccctctgtcacccaggctggagttcagtggcaccatctcagcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45097 - DNA, 588 bp, Glycine max
  Peptide Sequence Number=SeqID_136782
atgaaggttacagctctcaaacaaactggacatgacatgattgcacatgtaggaaaggctagggctgcagttgaagagctgaaaaagtttctggtagctgactcattggaagaaatgaatagaaaactggataagttttacatggtcctcatcctgaggagtctacactctgactttgatcatgtgcgtgatcaagttcttgctggagatcaagttccatcaatggactctctcatcactaggttactttgtgtgcctcatgcgctgaaagaagaaaatccagctgatgtggtggaaacttcaacaatggttgcatctcgtggaagagagggaggccgtaatagtagaggaggccgcaatggaaaaggtggacgtcctcaatgcacatattgcaagaggatgggtcacactcaagagaattgttattccttgcatggatttcctgaaaaagttgccaaggtagctcagacagaaaaatcagagtctaagttctctgatgaagagtaccaagagtatttgaagttgaaatctgagaaatccagcagccagctcaaggaagtggtcaagtctctttgtcttcctcattaa

SEQ ID NO: 45098 - DNA, 387 bp, Glycine max
  Peptide Sequence Number=SeqID_136783
atggtgaaagttggaacctcttacgtgccgatcaacgtctcaggttttcgcaaaagatggcccagctgggcttcccggtggcgcacatcatacatcccaggattatttggggaaggatccgtcaagcttattggcgcaatacctgatgggtttttcgaggctccagtggcgtatcatggtttcatagctgttccctcctgttcagctactgacggggaattgggcgcgtccgctttccagtcggaacctgtcggcaactgcttaatgaacggccaacgcgcgggcgatcgaggcggctttgctattccgggcgctaaagggggagtgtatactggcttactatgtttgagggtgtccagtgaagtgcttcatgtcaggacgttgtaa

SEQ ID NO: 45099 - DNA, 246 bp, Glycine max
  Peptide Sequence Number=SeqID_136784
atggacattgtggtcgctgggacagagttgctaaatagcaacgtcatccatatccacgtaagagtggtcatgttggtgcgcatgatccgcactcgtctttttgcagcggcacgggtgaaatcttgccccggtatgcatagtagatgtgtgatagcctccctctctggatgtgctcacacagttggtcgccctccaatatcagggggtggcccaggaactgataaaaggaaactagtggccccttaa

SEQ ID NO: 45100 - DNA, 183 bp, Glycine max
  Peptide Sequence Number=SeqID_136785
atgttaccaaaattcagcacaagacatgtgaggagatacatggagaaaaatgaagaaacaacaatggaggagaagggctttggctgcttcaaatccaatagtgctcctaggatggttaacctccaagactcaaaattttccttcaagcaatgcaccaatttccttttccaatccttattgtag

SEQ ID NO: 45101 - DNA, 399 bp, Glycine max
  Peptide Sequence Number=SeqID_136786
atgccaaatagtactctaacaggagattctttggtggaagcagtggattataccatcaagacaagagaacagataacaaagttacttcaccataacttgcttcacgcccaggaaagaatgaaacattatgctgatctcagacgagtggacaaggagttcaaatgtggagactgttttgatgatgtcaaaaagaatttgcttgacaaagggggagaatgtggatcgtgcattgtcttgatgatgtcgcaaagaaatcacttgattgtcatcatcaaaaagagggagaatttgatgatgccaaagaagaatcaaacaaggccgcttcaaagaataagcatttgcttcaagattaattcaagaatgcttcaacaaacaaagtcttgtttcaagattcactaa

SEQ ID NO: 45102 - DNA, 408 bp, Glycine max
  Peptide Sequence Number=SeqID_136787
atgggtgaagtagaggaggtacaagagaagatgaaggccgacatggaggccatgaaagagcaaatggccatgatgatggaggccatgatgatcttgaagaagataatggaagctagtgcagttgaagttgccgctaccagcactgttgttaaggtgaatccgatgccccaatctggcctcaaccaaatgaatcatccaacctcagctatggtaggcaaagatttgggaagtatgggcggcccccatgatgtgcaaattcaaaatgtgcacgccttcccaccatgtggcttgcctctcaactatacgccacccaatgtggcgtacactcccaataagaatgtcaataactccactcctatacccattgagagccagcaaccccaagatgatcatgcacatgtctcttaa

SEQ ID NO: 45103 - DNA, 252 bp, Glycine max
  Peptide Sequence Number=SeqID_136788
atgaggggcaccgtgcatgagcctcaagatgaccggcccctctccgatgagtcgatctcttgctttctcataagggtggacccttgggtacttgtacctatcacctttagaggactacacgtcctcgccatcagaggacttcatgtccttgccatcagagggctgcacgccctcacctgcagaggactacctgtcctcgccttgagagggttacacgccctcaccttgggtactagttaccctcaccagtga

SEQ ID NO: 45104 - DNA, 165 bp, Glycine max
  Peptide Sequence Number=SeqID_136789
actcatcttctccttgaagtggcgtctcctctctctctccctttctccattccgctgccattcatattccaagaagcaaaggaatccattgatgaagacgatcctaggcctacaagctccaatggagcttgcatcacgcacactctaaggatgagaagctattaa

SEQ ID NO: 45105 - DNA, 522 bp, Glycine max
  Peptide Sequence Number=SeqID_136790
attcgccgggctgggagaactggcaacgccgctacggaccaccgcagctgaatatcgacgcagggttaaccttcagcgacgagacgcatgcgctacaggcggcggtggcgggacaaggcgtggtgattgccagcgaactgctggcgcgcgatctgttgcagcggggcgtgctggccgcgccgttcgagatgtcgttacccggcgccaactattacctggtagccaccgaagaaaccgcgcagcgccccgatatcattgcgctgcgcgagtggctgctgcggcaaatgacagcaggctaacggcgctcgggggcgatctcccccaggcggatcgccacgccgatcgcctgcgcggtggtggcgggcgccaaggcgttggcgaatgcgccgcaggtggttttacaccgtgcgttcagacaggccgagcatcgcggcgatatccgcctgccgccggccgatggcggtccagctcagcacctcgcgctcacggcgcgacagcctgctctccctcttcgccggccgc

SEQ ID NO: 45106 - DNA, 670 bp, Glycine max
  Peptide Sequence Number=SeqID_136791
ggcgcagggccatgccattcaggtgcggctgtacgctgaggatccggcgaagcagtttcagccgagcgccggactgctcagccacgtgcagttcccgacggcgctcgatcacgctacgctgcgcatcgatagtagcgttgagagcggcatggaggtttcaccgttttacgatccgatgctggcgaagatcctcgtgcatgcggccgatcgccagcgcgcgcttgatggcatgatcgcggcgctggcgcagagtgagctgtatggcatcgagaccaacctgcgctggctgcgtcagctctgtacgctgccggacgtgcagcagggacgcatcattaccgccacgctcggcagcgtggcgtggcagccgccgacgctggatatcctcagcggcggcactctcaccacggtgcaggatgcgccgggccgcgtcggctactggcacgtcggcgtaccgccttccgggccgttcgacagccgcgcctttcagctgggcaatcgcctgctgggcatgcagctttgtgctgagcggcgcgccgctggcggccaccctcgacagccagccgctggcgatgcatcaggtgctgcatgcgcaggccgggcaaaccctgacgctgggcgacgtgcgcgacggctgccgaagctatctgctgctggcgggcgggctgaatag

SEQ ID NO: 45107 - DNA, 387 bp, Glycine max
  Peptide Sequence Number=SeqID_136792
atgaggggccaagacatttatagtagccaagatgaggctactacttcaccttcctctagtgaaagtgaagaagcaaaaggggaagaatctagtgaagaaatctaccccctagaagaaggacaaccattagtggttaaagaaaagtgtaaggagacacttgttaacactgccacacctcttgggcttgaggttattcctcaagtaaaggagttgttggatgaaggggttcccacggactctaagagaataaaggtcattcctgattggccccctccaccaagtgtcgagggaaggagcctagagtatgaagaacctcgggatttgaggtcaaatcctttccaaggtagaggggatgatgcaatcctaccccccaagggtattggatag

SEQ ID NO: 45108 - DNA, 141 bp, Glycine max
  Peptide Sequence Number=SeqID_136793
ggcagaggttgcatggcccggagaattgcccgagcccagcaggagaggccttccagagctcccggcgatggagaagaggcccacgaggacgaggagatggccgatttgcttgacttcttgggagggagtggagatacatga

SEQ ID NO: 45109 - DNA, 471 bp, Glycine max
  Peptide Sequence Number=SeqID_136794
atgatatctgatcagtcatacaaatctatcctcaaatattgcaatttcacagcagaagaaacatctaaaaaatgtgatgatgtttatagttatgcggttaactatgaatttggaaatatagaccagtacatcatctatactcctacgtgcacaacagcacaaaacaataccgtgaggcacctgcgattcaagaatcttcatctgatttctgggtatgatccgtgtactgaaaattatgcagagaaatactataaccttccaaaagtgcagatagcaatgcatgctaatgttaccaacattccttacaaatggactgcttgcagaaaagataaacaaaaacactgtgctttaatttacaacttaaaatcaaaatccaattcttctaaattctatgaaatgacaagttttaacacatggcttgacacaagctccatggagagtactaatcaccatcatgatcagtactcataa

SEQ ID NO: 45110 - DNA, 363 bp, Glycine max
  Peptide Sequence Number=SeqID_136795
atgaatttcgttttcgtttatgtgtcctctaccttcgagtttggagccatgcgtagtgattacttagtgcaattctccattctcaatctttttcggagtcccatgaattgcgttttcgttcaagcgtcctccacccacgactttggagccatgcgtagtgattgcttactgcaattctccattctcaaccctttttcggagcccatgaattgcgttttcattcatgcgtcctccacccacgagtttggagccatgcttagtgattgcttagtgcaattctccattctcaaccctttttcgaacccccatgaattgcgttttcgttcaggcctcctccacccacgagtttggagccatgcgtag

SEQ ID NO: 45111 - DNA, 309 bp, Glycine max
  Peptide Sequence Number=SeqID_136796
aagttccagaaaattgtcaagagaagaagaatcgagagatgtcagaacttcaacaatggaagaagatcacaagaaggctctcaagttcttagatgctacaaatgcaaccaacttggccacatcaaagaaaattgtccttcaaatgaagaatggcccgagagaagcgataagaaaaggaatgatgaaagaaggaccaagaaagcctacattgcatgggatgaaaatgactcatccgacggttcagagaaggagatcaaccttctaaccaaggactatgagagtgatgagaatatctttcaagaagattaa

SEQ ID NO: 45112 - DNA, 282 bp, Glycine max
  Peptide Sequence Number=SeqID_136797
atggaaactacaaactcagaagaagacaatgttaatatgtggtatcttggcacaggctattccaatcacatgactggacataaagagtggtttgtaaacattgatgataaggtgaagagcaagatcaagtttggctactcaatgcagatggaggacagtcaactgaagatgtttgatagcaataagaggttgattctaaaagtccctttgtcaagaaatagaacattcaagattggaattcagattgcagaatttcacctgcttggctgcttctataagtga

SEQ ID NO: 45113 - DNA, 356 bp, Glycine max
  Peptide Sequence Number=SeqID_136798
acttgatttccagctcagtgaatctatcaacaaggctttccttctgcctttgatcaagggaagagaattggatcccttccaaggttatcatagactacttttaattgacattgttgttgaaggtcgttcgggttatagcaactccaggcagtttaaatcagacctcacgaggaaatgggcccttgcagccgatcaggacggtgtcgaggacactgtctgtgacaaatacggcatcagcaaggaaaagtgggcccagttttgccagactcgcagagacccttcttgggaggatgtgcgcatgaaggcacaggccatccaaaagcagaatactgccccccatgttttgtcttgtgggg

SEQ ID NO: 45114 - DNA, 210 bp, Glycine max
  Peptide Sequence Number=SeqID_136799
atgggtaaagcagaggaggtgcaagagaaggtgaaggctgacatggaggccatgaaagagaaaatggccacaatgatggaggccatgatgagcatgaagaagataatggaagtcaatgcggttacaattgccgctaccagcattgttgctaaggtgaacccgacgtccccattcgacatcaaccaaatgaatcatccaacctcaaatatg

SEQ ID NO: 45115 - DNA, 309 bp, Glycine max
  Peptide Sequence Number=SeqID_136800
atgcaaagaagatctactacaagtgatttgatccccatcgatttggagattaacgctacttgcaagaggcgcaacgcagagagaattagaaaatttttacaggacttagaagcagcagcaattctagaagaagaacctcgatctttcgaggtgtcttctagctttcctattccagggcaatctcatacaaatttaattgaagaagttaacatggcagaagagccaaggagagtgaccctagaagattactcaagttcaagtgtgccacaatttttcaccagcattgcacaaccagaggttcaggcataa

SEQ ID NO: 45116 - DNA, 321 bp, Glycine max
  Peptide Sequence Number=SeqID_136801
atgcatgatggaatgcatatgatacagatgcaatctaggaatgcgggggcccgaggaattgtctccttcttagatacaacgtctaggggtagcaaagcgccccaacatacgtttttaagaaggcgacacggaccctccttggtttgtttacagaggggatcaagacagaacccatatgcgatgcatatgcaaaagacgcaatacgggaatgtacatagtatgacaatattcactgaacataagcaaaaggggtatatgatacttatgcatggcagttgtgaaaaatggcacgcaacgtgtttgcttcgtgcccctatttaa

SEQ ID NO: 45117 - DNA, 240 bp, Glycine max
  Peptide Sequence Number=SeqID_136802
atggtttttcacttaaggcttgtaatgagcttcaaaacaaagaaatgggaaactaggctcaaaggggctatcaaaggaattaattcaaggaagcatccacaagaatcaagccaaggatattgtgcaagcattcaaacgggcaaaacacaccaaaagattatgatgatggatggctcgaattctcacaaaggtaaacttatcactttcaaattgagctttcaaaactatcatgacatgtaa

SEQ ID NO: 45118 - DNA, 261 bp, Glycine max
  misc_feature (194)..(194): n is a, c, g, or t
  Peptide Sequence Number=SeqID_136803
atggtgggttacacaccttcaagctttccagatttggtcttcgccagagaaaggatcgacgagggtctgaaaagaggaaaatttaatcatcctgcttgggcgaataagaaaactggggcaaataaagagggtgaggatgagggagaaacccatgctgtgactgccattcatgtacggccaagtttcccaccaanccaacaatgtcattactcaacccttctccttacctactgcccatttatccacaaaggccatccctaa

SEQ ID NO: 45119 - DNA, 463 bp, Glycine max
  Peptide Sequence Number=SeqID_136804
atgggatcaagtcaaaagccttcgcttaaaaagaggttttatcaagtcaaaatcaagagcttagaggtcaccagtttacgaaagttggggcaattaatgggtcaacttcaacggcaagccttccgcaaagcctatgccgttgaggtgcttcatctttggggacttccagctatcaccaatggaattagaccgccaaaggcaagtcgaaaatggggtggtcggaataccgagaaaatatttggagtcctctttccaaatgtggatgggttggtggacctggcagcgatcgacgtttttctcgcctatcataaccacaaggaaagtccggttgtcgctatgctagccgacctatatgacaccttcgaccgaagatgcccgtctatccgctacaaggtcaccgctcgtgcgttgaaaaaggaaaggcgaattgggaccaactcttggctagcatgggggggcgtct

SEQ ID NO: 45120 - DNA, 687 bp, Glycine max
  Peptide Sequence Number=SeqID_136805
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccaattgcatccctttcccagtattatgaccagcccctaaggtgcttcacatttgaggacttccagctagtgttgactgtgaaagagtttgaagaaatcctgggatgcccactgggaggaaggaagccatatcttttctctgggttctatccctccacgacaagagtttccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcacctttcatcatggcaaggaaagcccggtcgtcgccattttggccatgtatgatacgctcgaccggggatgcccgtctatccgctacaaggttaccgctcgtgcgtcgaaaaaggaaaggcgaattgggaccaactcttggctagcatggggggcgtctgttaattggttccctcgctag

SEQ ID NO: 45121 - DNA, 518 bp, Glycine max
  Peptide Sequence Number=SeqID_136806
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaacggtgcgccttatccggtaactatcgtcttgagtccaacccg

SEQ ID NO: 45122 - DNA, 378 bp, Glycine max
  Peptide Sequence Number=SeqID_136807
atggaagagggatgtgttgcttctgtaaatcagatttaccatttagcaggttcaattgcagatgaggaaggtgctgcgggctctggtctcttgttgaaactgcatgttctgcatggtcatttgcctcacaagttctttgatggaaggaatgtatggtctgcttgggccagcaacattttggaaggaaggagcaggctgttgttgttgctgttgagggctagaccatctgagattagggtgattcctccatccagggttgtatctgttgctggagagcataagcttcgggctgctcaattgctccaggttgctgcatggaagggcaaaggtttgtatggtggtcagcagaggagcacaaaccacagactcttgcgacag

SEQ ID NO: 45123 - DNA, 711 bp, Glycine max
  Peptide Sequence Number=SeqID_136808
atgctccaggttcctgtacccactaatgaggtttccttagtggggcaggcacttcacaccttccttgcttggccgacacatctggtcaagtctttatcacagcaggtagctgtgtctccggcaaaaccacctccgaagcccgatccagaggtcgatgatccgctttatctgatgacattgaccatcccaaagcttttcttgaggccttatcaggttagatgggatgccaccgtgttcggggtctttaatccagatttccccctctacataaagcacgaagacctctccgaaatcgcacacggtggtcaatgtctcagcatatcagtgttacagttgtggattctgaatctcactgaaacatgtatgcgagtggggaattctgatatctatggattcctcgagccacagtccattcagaggtctgggcaatcacagtttaagtctgaaagttacataaagagttggatgcagagttcacaacgcgatgtctatcttggagcttacctaaatgggccagacaactaccttaaggggattattaatagtgctatcaagggtcttgatgatgctccacaggctaaatcaaaggcttctgcttggtggattgtcgtcaagtgtaatagacaaaaaggaagtactgagtgcggctactatgtgatgcactggatgtccaccatcattttaggaacttttaggaataattgggaagtg

SEQ ID NO: 45124 - DNA, 369 bp, Glycine max
  Peptide Sequence Number=SeqID_136809
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaactctatcggagcagtcggaggagaaactggaggaatcttagggaactgctcgagatgttgttatcgctgtcggaagacacgtgagtccgcttag

SEQ ID NO: 45125 - DNA, 1338 bp, Glycine max
  Peptide Sequence Number=SeqID_136810
atgtctcttgtacaattttcagatgtttgtggcttattcacgtgtgtgctttctacccatatatttgagaggtttaaggactataatggtaatttcaaggcaatccttagcagagatgtgaagggaatgttgagtctatacgaggcatcatttctaagttatgaaggagaacagattttggatgaggctaaggccttcactagcttccatctaaagggtgccctcaaagaaggtagaagcaatactatgatcttagaacaagtgaatcatgcaatggagcttccacttcatcacagaatccaaaggcttgaagcaaggtggtatattgaatcttatgctaaaagaaaagatgcaaatatggtgctgcttgaagcagcaaaactggatttcaatattgtgcagtcaactctgcaaacagatctccaagaaatgtcaaggtggtggaaagggatgggactagcctcaaagttaagcttcagccgagataggctaatggaatgcttcttttggacggttggaatggtctttgagcctcaattgagtgatcttcgcaaaggtttaacaaaagtggcttccttaattactacaattgatgacgtttatgatgtgtatggaaccttggatgaattagaactttttacagcagcagtagaaagttgggatgttaaagcagttcaagttctaccggattacatgaagatatgctttctagcactctacaacactgtcaatgaatttgcttatgatgcacttaaagagcaaggacaaaatattcttccctacctcaccaaagcatggtctaatatgttgaaagcattcctagaagaagctaagtggtcccgggacaaacacgtgccaaaatttgacgattacctcaataatgcatgggtttcagtctctggggttgttatactgacccatgcctatttcttgctaaatcatagcataacaaaggaggcacttcagtccttggaaaattaccatgccttgctgcggagatcatccactatttttcgactttgcaatgatttgggcacttcaaaggccgagttagagagaggtgaggcagcaagttcgattgtgtgttacatgcgtgaaagtggtgctagtgaagagggtgcttacaaacacatccgcagattacttaatgaaacgtggaagaagatgaacaaagataaagtgtcacagtctcctttcccaaaacctttcatagaaatagctatcaaccttggaagaatttctcagtgcacataccaatacggagatgggcatggagctccagatagcacagtcgagaatcgcatacgatccttgataattgaacccattgccatctag

SEQ ID NO: 45126 - DNA, 212 bp, Glycine max
  Peptide Sequence Number=SeqID_136811
atgaacccaaaagcggttagtcttttaagtccagtgataaaaaccaagaagttatactcacttcttgcaatgaacccaaaagcggttagtcttttgagtctagtgatcaaccaagaagcaaatccgcttcttgaaatgaacccaaaatcggttaatcttttgagtccagtgtttaaccaagaagaccttctcttgaaaaacagtcaccaaga

SEQ ID NO: 45127 - DNA, 437 bp, Glycine max
  Peptide Sequence Number=SeqID_136812
ttagggtaccccatgaggggagcaccgacggaagagagcctctcgcctttccttgtgagagatttcggcgcgcaaagtctcaagattgtacaaagagtccacaaggcgtggaaaagcccgataaggaagaacttaggggcattcgtaatggcatcatcggtggttatcatgaatggctaagagttcatacacgagggttagattggctctccaagttgaaaattatcaacgaggagaacttcgaagctccggaagaggatgaagaagtccaagctctaaaatctgagctaggaaaggcaagactcgccaaagaaaacttcaagtcagccgctacaaacatccggaaagagtgtgccgagttacgagaggaaaatgcgactaccgcaaaagcccttgaacaagaaaccaagagggcccgcaaggaagagcatggctga

SEQ ID NO: 45128 - DNA, 393 bp, Glycine max
  misc_feature (103)..(103): n is a, c, g, or t
  Peptide Sequence Number=SeqID_136813
atggctaaaccaagcagcgccgcaaacgtggcatcagccatcattgggttctgggcctcaaagaagttcccccatagactaaaagcatcaccgggaaggttgncaaggcaaaacccttcaccacacccttccgtcatggtccatgttcatggatttttcaaacttccgttttcacatttaacgatcctaggcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 45129 - DNA, 365 bp, Glycine max
  misc_feature (49)..(49): n is a, c, g, or t
  Peptide Sequence Number=SeqID_136814
cggatgccgggagcagacaagcccgtcagggcgcgtcagcggttgttgncgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccatga

SEQ ID NO: 45130 - DNA, 383 bp, Glycine max
  Peptide Sequence Number=SeqID_136815
agcaacaacttaaaaagaagtctacgtcaaaatcttatggctctcactcttatccaaagaaataccaaggtcaaggcatcttaggggtgataccttctaagcccaaagatgataaggggaagacaatagaaaagcaagcccctaaggctagtatgcaagagaaaactagctctataaagtgctttaaatgtcttcgaagagaacacattacttctcaatgccccaccacaaaaaccatgattacgaggggccaagacatttatagtagctttatagtagctaagatgaggctactacttcaccttcctctagtgaaagtgaaaaagcaaaaggggaagaatctagtgaagaaatctacccccaagaagaaggacaaccattag

SEQ ID NO: 45131 - DNA, 740 bp, Glycine max
  Peptide Sequence Number=SeqID_136816
gctaccagtacgatgatcctacgattgtcggttttagtcacacccattttagtggtaccggtcattccgatcttggtgacatacagattatgccgacccagggcaaaattcaattaaatcctggaacagcagatcgtccacaagatggctacaggtctccctacagccacacgaatgaacgtgctgaagctaattattatagtgttctgttggacaaacatcagattaaagctgagttaacgacgacggcacgtgtgggtatacaccgttatacgttcaaagagtctgatgcgtcgcatctgatagttgatctgactgctgggatctataattatgacggaaaaaatgtttggactgttgttaaagtattgaacgattcaactttggttggataccgccaaacaaatggttggtcaaggacccgcacggtatattttgccattaaaacatcgaaacctttcaagaattacggtgccaaatacgaggatggaaaatctgtatataacggtttctggcgtaagtttgatcagcaaaataatttcccggatctagcagctcacaatatcaagctacatcttgattttgacaccaaatcacaggaatcgatacttttaaaagtcgcattaagcccggtgagtatgaagaatgcactggctaatatgaatgtggaggcgccagactggaactttgatgggtatgtcaagaaaggtcaggaagcttgggaaaaaggagctgcctaa

SEQ ID NO: 45132 - DNA, 432 bp, Glycine max
  Peptide Sequence Number=SeqID_136817
atggcagaagaagatgcactttctcttgacaacattgaaggtggtgtatgtattgagtacaccgatgccggtgtttatggaagacgaaactctggatcaaataaggaagcgttcgaaatgggagaacgacgattaaatttgtcgtggacacattctgaacggcttgttatggaacaatataatgaactgctgcggattttgggtcagtttactcaacatgatttgaaaatggatgaatccattgcagtttcatctataattgataaactgccttcttcttggaaagacttcaagcataccttgaaacataagaaggaagagttgactctggttcaactcggtagtcatttcatgattgaggagtcgctgagggctcaggaaattgacaaagtcaatgataaaaacgtatacagctcctctgccgttaatatg

SEQ ID NO: 45133 - DNA, 639 bp, Glycine max
  Peptide Sequence Number=SeqID_136818
atgcacgtggcgcacggcggggttggcgctgagccgacgggcttgcgacatcagttcgccacgcagttcgggcgggcaattgacggtgatgcaggccgaagccaggccggggtcgcgcccctggtcgatctgcacttgcgacacatcgagcccggcggcgctgaagtccaggcagatctgcttgcgcagggcgcccagttcatcgcgcgggcagatgaccgtcaggcgcgacgtgccgcggcggcggcccatggcggtggcacgatcgacgccggcgcggcgcaggaacaagtcgaagaaacgcatagcgacctccattgcgtaatgggagcggctttcgcgcatacgcgcgcacgcgaggcacacggcgccaggcgaacgggcacggaaagacgtgcgcgcgcgttgacgctgcgactagcggcggttctggcggtttatgttgggaagaatccccgcaagccgtgggcttgcgctgctgcccggcacgagacccggggcgggggatacaaccgcaacctgttcaacaggttgcggcagacggagttctgcgtggacctgtcaaacagcggcgtcgatgcaagatcgactactttcgccggaatcggtattcacgaagactgctcctgggatggataa

SEQ ID NO: 45134 - DNA, 1032 bp, Glycine max
  Peptide Sequence Number=SeqID_136819
atggtggtggtctacgtctgggtggcgatgggctggctggacggcctgaccctcctgcaccggcacgccgcgcgtgatcagctcgcagccttcgtccgtcaccagcgcgtcgtcctcggtgcggatgccgatattccagtaggcctcgggcacgtcgtcggccgggcgcacatagatgccgggctcgatcgtcagcatcatgccggtctccagcgtgcgccacgggcgttcggcgccgggcgccgcgcccggttggcggtagtcgcccacgtcgtgcacgtccagccccagccaatggccggtgcggtgcatgtagaagcggctgtagtcgcccgactcgatcaccccgtccagcgaacccttgagcagtttcaggtccagcatgccctgcgccagcacgcggacggcggcttcgtggccgtcgttccagccgcggccgggcgcggtggcctgcgccgccgcttcctgggccgccaccgtcaggtcgtacagggcgcgctgcgggccgctgtagcggccgttgaccggaaaggtgcgggtgatgtcgctggcatagctatcgacctcgcagccggcgtcgatcagcaccaggtcgccgtcgcgcagcaccgcttcgccggcggggtagtgcagcacgcaggcattggcgccggccgccacgatgctgttgtaggccaccgcctgggcgccatgccggcggaactcgtacagcagttccgcttccagttcgtattcgcgcatgccggcgcgcgtggcccgcatggcgcgcgcatgggcgccggcggagatcttggcggcccgccgcatcgcggcgatttcgctggcgtccttgaccagccgcatctcggccaggattggccggatgtcctgctggcgcgcgggcggctggtggccgccgcggctggcttcgcgcgcggccgccagccagcggtgcacgcggccgtcgccgcgcttgtcgcccgccagcggcgcatacagggtcggctggtcctgcagcagctgcggcaccagttcgtccagagcgtccagcgc

SEQ ID NO: 45135 - DNA, 258 bp, Glycine max
  Peptide Sequence Number=SeqID_136820
atgactcatcaggattttcaagtgcaagccattggtctgtttgctcaagcgacctgtgctcctgagtttggacttccaagatcgttcaatcagagattactcgtccttcacgttggtgggggttccgtaaaacaaagaggacaacccttcccttgtgttcaagaatcccctacaacaagagacccacggtctcttaatcccttttcagaaataagaaaaagagaagaagaaatctctcttaaaagagatggattgtaa

SEQ ID NO: 45136 - DNA, 862 bp, Glycine max
  Peptide Sequence Number=SeqID_136821
atgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgtccaatctgcgcctgcctttatacaattagatacaaaattagccatttttgaaacaggaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggagtaattaatgaacaaaatattgcagaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaag

SEQ ID NO: 45137 - DNA, 522 bp, Glycine max
  Peptide Sequence Number=SeqID_136822
atggaggccgacatggaggccatgaaagagcaaatggccgcaatgatgagcgtgaagaagataatggaagccaatgcggttgcaattgccgctaccagcgttgttgctaagatgaacctgaggtccccatccggcatcaaccaaatgaatcatccaacctcagatatggtaggcaaagatttgggaagtacgggcggcccccatgatgtgcaaattcaaaacgagcacgccttcccgccatatggcttgcctctcaactatacgccacccaatgtggcgtacactcccaataagaatacacatgaaattccccatcacaatctagccgacttcgagccttggctcggatatgccactgaagggcaagcagttggtggtataccccttgaaaacacttcggaaggccctcagtatcacccccagctacacctcttgcattccacaacaagtaaaaacccttgtgctatggcagaaatggaagagttgggatcatttagaggaagactcagggccattgaagag

SEQ ID NO: 45138 - DNA, 528 bp, Glycine max
  Peptide Sequence Number=SeqID_136823
ccaacaaactgcagatatatctgcaaagaatgggaaattgggattgaaattgatacctatgtgaagagagaagaggtggagaagctagacaatgacttcatggcgggagagaaaggaaacaaaataagacaaaagatcgtggagttgaagaagaaggcagaggaagccactacacccagtggttgttcattcatgaacttggacaaattcattaaggaggaaccaatcaaggctacagagaaatctcatcctttctcagtgcttcaacagcagcaaggcatgcacagccaacttggcatgagctccagtggaagtcaaggcctccacatgctgcaaagtgaagccactaatgttggaggcaatgcaaccataggaattggaggagggtttccggactttgtacacatcggtagtggcaagcaagatattggaatctctagtgaaggcagaggaggaaactctagtggccactctggtgatggtggtgagacacttaattaccttaaagctgctggtgatggaaactga

SEQ ID NO: 45139 - DNA, 309 bp, Glycine max
  Peptide Sequence Number=SeqID_136824
atggttctggactttcaacaaacattatcgacaataacgaagtatgcactaacgcaacagtccaaacaaaatgtatgcacaaaacacatgacaactgaaacaacaaaaacaaatgttagaccctcaagtcatagaaatgaaataacatacaaatatgaatctggggatcccacggtcatgtggctccgcatgccaccggactcttgggtcacagtaacaaaaggtggggtggtcgacaaaagcagggcttttgctcctacatatcctcaatttgtgatgaggaactcagacctacgtagttctggataa

SEQ ID NO: 45140 - DNA, 349 bp, Glycine max
  Peptide Sequence Number=SeqID_136825
cttgggaggattgatggggacccggtgttgagagaaacgaggatatgggctacgtgggagtacgtgagctcagttggaggtgggcaaccggggatgagtggtaccttgagatatgtcgcgggggtcaggagaccttggggacgtcaggtggggcgagctcctgacaatcaacagataaaaggaacaaagaccacaaagcaaggaggcttgtgctggctggccagctgtgaattttgtgtgatatatgggttgtggcctctggtaatcgattaccaagggcttgaaaacgaggcctctggtaatcgattactagcttgtgtaatcgattacacagagggatgggtcactg

SEQ ID NO: 45141 - DNA, 156 bp, Glycine max
  Peptide Sequence Number=SeqID_136826
atggttggtccctcaggtcctcgtgtcagcacaaaggagagttgtgttgatccctcagggaacgatcctgagacagtaaaggttggtgttgaggaggttaaagatgcacaggctcccgttcctgtaccccctgatgaggttaccttagtggggtag

SEQ ID NO: 45142 - DNA, 53 bp, Glycine max
  Peptide Sequence Number=SeqID_136827
atggaggagccccggggcattcctgatgcaatcctatctcgcaagggcattgg

SEQ ID NO: 45143 - DNA, 627 bp, Glycine max
  Peptide Sequence Number=SeqID_136828
atgtgcaagtgccgttcacatggaacctttcccctcttcggccttcaaagttctcatttgaatatttgctactaccaccaagatctgcaccgacgaccgctccgcccgggctcgcgccctgggttttgcagcgaccgccgcgcccttcctactcatcggggcttggtccttgccccgacggccggaactcgccccgcgggctccagctatcctgagggaaacttcggagggaaccagctactagacggttcgattagtctttcgcccctataccccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatga

SEQ ID NO: 45144 - DNA, 169 bp, Glycine max
  misc_feature (63)..(63): n is a, c, g, or t
  Peptide Sequence Number=SeqID_136829
ggtccatccttatgagaaagcaagagatcgactcatcgagagagccggtcatcccaaatgggngagatttggacatttagatggggttggaaaacacagattgactgtccttttgaaagagtcacttgaccattttggagtgacggcaatggagtcgtttgatgtttaa

SEQ ID NO: 45145 - DNA, 300 bp, Glycine max
  Peptide Sequence Number=SeqID_136830
atgattatgaggggccaagaaactgaaaaagcaaaaggggaagaatctagtgaagaaatctacccccaagaagaaggacaaccattagtggttaaagagaagtgtaaggaggtaagtgtctcctccaagaggttagctaagaaggaaactcattttacaataaagacaaacattaaagaaacattccctcttagacaacctccatattttctcttttgtaaaaagacacttgctagcattgccacacctcttgggcttgagtttattcctcaagtaaagaagttattggatgagggttag

SEQ ID NO: 45146 - DNA, 162 bp, Glycine max
  Peptide Sequence Number=SeqID_136831
atgttggggaagcttgggaggattgatggggacccggtgttgagagaaacgaggatatgggctacgtgggagtacgtgagctcagttggaggtgggcaacaggggatggtggatatgttcttggtagaaataggaatagtgggggcaagatacgcgggttag

SEQ ID NO: 45147 - DNA, 687 bp, Glycine max
  misc_feature (649)..(649): n is a, c, g, or t
  Peptide Sequence Number=SeqID_136832
atgaggggccaagacatttataatagccaagatgaggctactacttcaccttcctctagtgaaagtgaagaagcgaaaggggaagaatctagtaaagagatctacccccaagaagaaggacaacctttaatggttaaggaggagtgtaaggaggtaagtgtctcctccaagaggttagctaagaagcaaagacattttgaaataaagacaaatattaaaaaaatttcccctcttagacaacctccacattttctcctttgtaaaaagacacttgttagcattgccacacctcttaggcttgagtttattcctcaagtaaaggagttgttggatgagggtttggttcgcaagagcttaaatccttgtgctttgttggtgcccaaaataggtattattaggcaccaaatccctatgataggtggtatgatgaatgtgttgagtggtgcaaccctcttttgtaaaatcactcatgcacccaacatcttcatgatttgtgtacatagggactcattaggtaggaataatcaacatgaaaataaagaaaaaggtatgttttattccattactttccttaactttttaaatagtgatcaagggcttcccatggaccctaagagaataaaggtcattcttgagtggcctactccancatgtctaagggaaatttggggcttcaatgacttttaa

SEQ ID NO: 45148 - DNA, 249 bp, Glycine max
  Peptide Sequence Number=SeqID_136833
atggaggttgaggaatggaaggtggtgacttttgtggcgaaagcggaggcgcataatgtagctccatgtagagcttgtatgccttggatcttcttcatcactagagtccttcgcttcttgaagatcaatggtagcagaaaagagaaggaggaaagggaaatgaaataccggcaagtgcacggggtcatcaagtatttaaaattaaaacagagtgatctgagcatcaaactaaaggaacttgcttattag

SEQ ID NO: 45149 - DNA, 317 bp, Glycine max
  Peptide Sequence Number=SeqID_136834
tcttgggcatcctgattttgagcctcctcctcatctatcagatggaaaaacaagggaatcagagagagcaaccacttctctagataaggaatcagaaagatcagcagcttctctagttggggattcagggggagtagcagcttctccagatggggaatcgaagatgataatcaaaggtggagatgggggaactactttgaaagctggagttgctgcacatgatgtccaacgttatgtcaaggaatcagattgggctgcacaatgcacaaggcaagataaaatgtcaaatgaagaattgaagctgcaggatccacgat

SEQ ID NO: 45150 - DNA, 258 bp, Glycine max
  Peptide Sequence Number=SeqID_136835
atgaagatgctcttgataccacatgatgtaagctcccttagagcttgtttgcctaggatcttcttcatcaatggattcctttgcttcttggaagatgaatggcagaggaatggagaaaggaagagagagaggagatgccacttcaaggagaagatgagtctagaagaagctcaccaccatagtagaccactaatccaagatcaattccaagattctccactaagtgtgcttaggtgtcatgagacatgtaaagcatga

SEQ ID NO: 45151 - DNA, 289 bp, Glycine max
  misc_feature (99)..(99): n is a, c, g, or t
  Peptide Sequence Number=SeqID_136836
ctcccggagacggtcacagcttgtctgtaagcggatgccgggagcagacaagcccgtcagggcgcgtcagcgggtgttggcgggtgtcggggctggctnaactatgcggcatcagagcagattgtactgagagtgcaccatatgcggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtt

SEQ ID NO: 45152 - DNA, 435 bp, Glycine max
  Peptide Sequence Number=SeqID_136837
atggctcccgaagaactgaagcagttgactcaacaaatcagggaccagcaggaggagtcgatcacagaaaaaatccaatcacagggacttgcactacctccggagcttgaggttggtgcctcagctgctcgtgtcaacacaaaggggagttgtgttgatccctcaatgaccgatccagacggtgactcagacaaatgcgggttgtacatcaaagaaaatcctcttcgcctagttgcccttggaagagtttatgagggatccacaatggaacacaacatccctttgttgcttggccaagtgaaggttggtgatgaggaggttaaagatgtagaggctcccgttcctgtacccattgacgaggttattttagtggggcagacacttaacacttcccttgcttggccgacacatctcgcgaagcgtttatcagaccag

SEQ ID NO: 45153 - DNA, 364 bp, Glycine max
  Peptide Sequence Number=SeqID_136838
atgatagatgtttatgctgacacattgtctatggaatttagtgatattgttgttcattttaacattcttgatgccatgaaacatccatctgaggatcattctatttttcgtgttgagataattgatcagatcgttgatgattatatgtttgattttgattctattcttcatgagtcaaaatgcactcaccatgttgcaggaagtacatatacttttgacttgctttatgaagtacaggctgaggaaccttcttcttctcctaccctggttcctcccactgttcagccaccacccacatcagagttgaagcccttaccagcaagtctcaaatgtgcttacttggaggacaaggaaaaatttccca

SEQ ID NO: 45154 - DNA, 526 bp, Glycine max
  Peptide Sequence Number=SeqID_136839
atgtccaaatctggtggatttgggatgaccggccctctcgatgagtcgatctcttgctttctcataagggtggagccttgggtacttgtacctatcacctttagaggactacacgtcctcgccttgagaggactacatgtcctcgccatcagaggactacatgtcctcgccatcaaaggacttcatgtccttgccatcagagggctgcatgccctcacctccagaggactacctgtcctcgccttgagagggctacacgccctcaccttggggctgcacgccctcaccttcagaggactacacgtcctcgccttgagagggctacacgccctcaccttggggctacacgtcctcgccatcagagggctgcacgccctcacctccagaggactacctgtcctcgccttgagagggctacacgccctcaccttgggactacacgtcctcaccatcagagggctgcacgccctcacctctagaggactacatgtcctcgccttgagagggctacacgccctcaccttgg

SEQ ID NO: 45155 - DNA, 306 bp, Glycine max
  Peptide Sequence Number=SeqID_136840
atgggaagaacaaagcaactaagtctcaagctaagcagaaggggaatggtaaaataccatctcaagctgatattaagaaggtggcaaagtgtttcttttgcaagaagaattgccccggattccagaaatggcttgagaagaaagggtatgcaaaacctaaggaaaccagtgggaattgagcaaagcattttatcaggcaataagctaggctcacatgtggaggccattggaactttcatttcaactttaagtagtgactttattttaaaattagaaaggaccttttatgtaccaagtttttcttga

SEQ ID NO: 45156 - DNA, 423 bp, Glycine max
  Peptide Sequence Number=SeqID_136841
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttccagttaccttcggaaaaagagttggtagctcttgatccggcaaacaaaccaccgctggtagcggtgagtcgacctgcaggcatgcaagcttggcactggccgtcgttttacaacgtcgtgactgggaaaaccctggcgttaccaacttaa

SEQ ID NO: 45157 - DNA, 822 bp, Glycine max
  Peptide Sequence Number=SeqID_136842
atgatcgaccctctcaatgagtcaatctcatgctttctcataagggtggacctttgggtactagaacctattgccttcagaggaccaagcgtcctcgccatcagagggctgcacgccctcaacttcagaggactacacgactacacgtcctcgccttcagagggctgcacgccctcacttcataggactacacgtcctcacttcataggactacacgtcctcgccttcagaggactagacgtcctcaccctcagaggactacacgtccttgccatcagagggctacatgccctcaccttcagaggactgcacgtcctcgtcttcggagggctgctcgtcctcaccctcagaggactacacgtcctcgccttcataggactacacgtcctcgccatcaaaggaccacacgtcctcgccatcagaggactacacgtcctcgccaacagagggctgcacgcccttacctttagaggactatacatcctcgccttcagaggactacacatcctcgccatcagaggactacacgtcctcgccattagagggttgcacgccctcgccttcagagggctacacatcctcaccttcatagggctacacgccctcacctttagagaattagacttcctcgccttcagaggactggacgtcctcaccttcagaggactagatgttctcgccttcagagggctgcacgccctcgccttcatagggctacgcgtcctcgccttcatagggttacatgccctcacctttagaggactacacatcctcacctttagagggctacgcgtcctcgccttcgtaggggggatcctctag

SEQ ID NO: 45158 - DNA, 518 bp, Glycine max
  Peptide Sequence Number=SeqID_136843
atggggacaaatcaaattggcaaaaggttttatcaagtcaagattaagggcctagatatcaccagcattaaggagttagggcggttaatgggacctctccaaatgcaagccttccacaaggtgtgcggaaagatcttagatttgaccatagcagagatatccacagaggccattgcatcactcacccaatactatgaccagcccttgagatgcttcacgtttggagacttccaattagtactgaccattgaagaatttgaggagattctaggatgtcctctcgggggaaggaaaccatatcttttctccaggtttcttccctccttgagcaaaattgcagttgtggtcagggattcggcgagaggattggatcgcgtaaagcaaactcgaaacgacatagtgggcctaccacgaaagtacttagaaggaaaggcgagggatatggcgaatcaagaggagtgggtcccgtttatggatgtattagcattgctaatctttggggttgtcctcttccaaag

SEQ ID NO: 45159 - DNA, 150 bp, Glycine max
  Peptide Sequence Number=SeqID_136844
atggtaaacaagcctagtgagttcaacatacataggaaggttgaaaggaattggaaaggaggactgatgccatcccttgaagaatttgagtcaagaagcaaggggccaaccaccttaagagctattggactaagaagcactccaaattga

SEQ ID NO: 45160 - DNA, 891 bp, Glycine max
  Peptide Sequence Number=SeqID_136845
atggggacaaatcaaaacggcaaaaggttttatcaagtcaaggttaaaggtctagatgtcactagcctcaaggaattgggacgattgatgggacccctccaaaggcaagccttccgcaaagtttacgggaagattctagatttgaccgtagcggaggtatttacggaagttgtcgtatccctcgcccaatactatgaccagccgttgagctgtgattggagattcagcaaaagagttggattgcatgaagcaaactcggaacggcgtagtgggctgcctcggaaatacttggaaggcaaggcaagggatatggcaagccaagagaagtgggggccgtttgcggatatattagctttgctgatttttggggttgtcctctttccaaacgtggacggtttggtggacttagccgccattgacgctttcctcgcgtatcaccattgcaaggagagtccagtggtggccatcttggcagatttgtttgatacctttgaccggagatgtgagaaaaatagtgcacggattgtctgttgtttacccgctctctttgtgtggttggtttcacacctattccgacaagacacaagacacccatgtccgcttcaaagctatcgctcatgcgccgaaaaaggaagagtcgattgggaccagcatttggctggaataggaggcaacgcaatcaattggtttcctcgttggaaggaaggcaaggaaggagttctcttctcgtgtggggactaccctaatgttccattgatagggactaggggttgtattaattataatcccgcactcgccataagacagctagggtaccccatgaggggagcgccaaccgaagaaagtctctcgcctttccttgtgagggatctaggtgcgcaaagtctcaag

SEQ ID NO: 45161 - DNA, 49 bp, Glycine max
  Peptide Sequence Number=SeqID_136846
atgaagctccgataccacttgtttggcttctttaaagatcttcattcag

SEQ ID NO: 45162 - DNA, 156 bp, Glycine max
  Peptide Sequence Number=SeqID_136847
atgcttcaagatgagcaaatatacaactcatgcacaagactaacaaaaagcgttgaaggatttgctgcctgctatggagaagtggtatctaccattggtgtcggaggctctggagtggcctcaggagacttttcaggagtggttgcggcttcctaa

SEQ ID NO: 45163 - DNA, 91 bp, Glycine max
  Peptide Sequence Number=SeqID_136848
atggaggtccctgcaactattgttccaccaatagcaaggaataagctagccataacaagagccaaaaaaaggaaggttgctgagtatgaag

SEQ ID NO: 45164 - DNA, 242 bp, Glycine max
  Peptide Sequence Number=SeqID_136849
gccacccaagggatgatcatatccaaactcttcctcagcttgacacaaaagatcttcgaatgaaggttgattcaaattttgaagctgcttggctagccgtgaatgatgcccgtcgaacagcagtttgtaagattctgtggaaacccaattcccagagaaagcgactgtcaatggatggagggcatacgcacgagatatcacatggtgttgtcttcggtccaactatcaaggataagttgtga

SEQ ID NO: 45165 - DNA, 169 bp, Glycine max
  Peptide Sequence Number=SeqID_136850
ggtggagacatggataaccacaaaattgcttgggttagctgggagccagcatgtctatcaaaagaaaaaggaggcctgggaattagagacttgaccaaattcaatcaggcactcctaggaatgtggaagggggatctatttcacccaatgttgttaatgacggatggcg

SEQ ID NO: 45166 - DNA, 302 bp, Glycine max
  Peptide Sequence Number=SeqID_136851
atgtccattcgaagctttggctcaatagctccgatcacgtctataccccacatagagaacgaccaaggtgctgccaagacgttcaaaggtatgggtggagcattggcattatcgacgaaggcctggcacttgtggcatttcctcacatggatgcaacaatcgttctccatagtgagccagatattcccacttaggaaaaagtcggccgccaaccttagcaacgttctcttgtcgttgtcggaggcctcctgtgggcttgccatgacatctaaattcgattgtatgggcaatcctcgtgcggg

SEQ ID NO: 45167 - DNA, 798 bp, Glycine max
  Peptide Sequence Number=SeqID_136852
atggttacttacgaagcagagaaggatgtgagctcaccattgaagactgttgaggaggaaaaggcagctgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcgagataatattaggagacaagtgtttaaacatctccattctacagctatggcttatgtttattcatgattggagtgcgagcattggttatggaccattgtatgggttccttgaacctcagtgtatccacaatgcaagcagtagacgtcaagagtgtgaaaattacattggaaggtggttgaaggaagcaggaaaacaaatttacatagcaccttatttaaaccaggcccattggcagctcgttgtattgtgcccaggcgacaatgtagtggtttggttttgttctttgaagaagaagccggatgctgccatcaagggtgcagtaaacagagggaaaagccacctcagcatgggcctcagtggattgaagcaaaagagtcatgttcaaataggaaattacgagtgtggatactatgttatgcaatggatatggtgcatcgtaagtggtggattgaaggatgactggattcactggttttctgatcgatcaccgctaacagaagagaccatgaccacactccggcataaatgggcggcctattttatccaaatgaagaaatgcgaaccaagaaaaaatttgataacttag

SEQ ID NO: 45168 - DNA, 492 bp, Glycine max
  Peptide Sequence Number=SeqID_136853
atggtcgtttctggtctgtcagtgacgtcggaaagtgttgtaacgtctgagtcaccagatgaaggtgaaacgcaaaacagacccgacccgctcgccccgatcgttgaccccgagaatagtaaaatagtgacgacctttgcagaaaggtgcctgtttgacaatgtggcgatgatcttgggcactgaggcagagctggttgcgaaagataccgaaagctattacagcatcctctttcaagggaagacgacgcgttggattctgcgttatttcgacaataagcaacgcccaaccattttgcttccgcttgagatagacgatgccaggcaggctgagataactcgcgccggcctggagttggcagcaggggggcatatcattatcgaccgcccggaaaatattttgcggctaacggggttgatcgttgattcttaccaatattgtattaatgacgaaaactttaggcagaagagaaaagataagcaggaaagctag

SEQ ID NO: 45169 - DNA, 408 bp, Glycine max
  Peptide Sequence Number=SeqID_136854
atggggcgaagcgggtttgtaaagcctgcagaaacaccggccacgaggggcgggagacgcatgaggagttcatcgattttggcggtcatggaggattgttgctgggtaagacggaggagagcatcctcaagcttatcggaagggttcgaggagttcgacatcaatgaaagcaccaatttgttagaggggaagaacaaagatgctgacttcgagggcagcaacctccagctaaaggggaaaaagagaataacgaaaggaaagtgtgtttccaattctgcccctgctacacgtaatccgctaggtgttgaggaaaaaagcccagagtttcaagaacctcgggatttgaggtcaaatccttttcaagggggagggaatgatgcaatcctaccccgcaagggcattggatag

SEQ ID NO: 45170 - DNA, 249 bp, Glycine max
  Peptide Sequence Number=SeqID_136855
atgatgcaatcctaccctgcaagggcattggatagaagactccaagtagattgggccagagatccaagggaaggccctagggttctcatgagcctcaggtctttgtgtcgcaacctacccttcggcgagagggtgacgcgtgactcgcgggtgcgtgttccaagaaaggagtacgggcggagtcgccaccaacgtttatttgaggaaaacgttgggaaaaccggaaaagacgtgatctacgaactttaa

SEQ ID NO: 45171 - DNA, 409 bp, Glycine max
  Peptide Sequence Number=SeqID_136856
gaatggcacccacaaagacacccagtggacccggagaagtccaacagggccctggggtttccagttctggttacgggcctctgtagtcctacagggtgcccgctccccccgacaaggtcatgtcatcatagggatcgcgcctgcaagacacccagtggacccgaagaagtccaacagggtcttggagttgtcaagctctaattatgggtctcccgtcagttctacggagtacctgttacctccagcaagggcatcaggccccctactaatcgagcttttatcaagaagtactgcatccgcaggcaggcgcaaaggcgaaacaccacagcagcctgaggatggtcggcagcggggcaacagacgcaccgccatcacctctagagttcacctcagctcatccacaaaaagg

SEQ ID NO: 45172 - DNA, 264 bp, Glycine max
  Peptide Sequence Number=SeqID_136857
atggcttattccctagtggatggcacctccctctcaccgcttctcctttgtcttccgctgcatctccatggtggaaaatcaccattaaaggacctcattgaatctcaaagatccagcctccatagaagctccacaagcaagcttccatcaagtggtatcagagcacaagagcttcaagtagagtttgaaccgattaaacttgctatagaagttagatttgattttctatggttcaaatttcttgttcttgttcttgaaccatga

SEQ ID NO: 45173 - DNA, 464 bp, Glycine max
  Peptide Sequence Number=SeqID_136858
atgaggggagtaccgacggaagaaagcatgtctcctttgcttgtaagggatctcggcgcacaaaatttcaaggctatacaaagaatccataaggcatgggaaaccccgttaagtaaagatcaagagcttaggggcattcgtaatggcatcattgcaccggaagaggacgaagaagtccaagctctcaaaagcgagttaggaaaggcgaaacttgccaaggagaagttcaagttggccgctacacacattcggaaggagtgtgccgggttacaggaagagaatgcaattaccgcaagagccctcgaacaagagaccaagagggctcgcaaggaagagtatggccgaaataaatttcgcggagctctatggggtagcaatagtgaactcaagctgcgaagggaagagagggaccagtcgcgagcacatagcatggttctgaaagaggagttagttgcttgttcaag

SEQ ID NO: 45174 - DNA, 249 bp, Glycine max
  Peptide Sequence Number=SeqID_136859
atgttggtgcgcatgattcacacttgtctctttgcagtggcatgggtgaaaccttgccccggtatgcacaatagttgcacgatagcctccctctggttgtgctcgcatagttggccctccttcgagatcaaggggaccttaaattctcttaaggtgtggatatggagcccaatgaaagtgaggacgcgtagccctcaaaaggcaagggagagtgcaaccctccgaaggcgaggacgtgtcgccctctaa

SEQ ID NO: 45175 - DNA, 252 bp, Glycine max
  Peptide Sequence Number=SeqID_136860
atgggagctggccatgcccgaagtcgttaccttaaccgcaaggagggggatgccgaaggcagggctagtgactggagtgaagtcgtaacaaggtcggaacaagttgataggagctacttttttcacccccatccatgtcgccacacgggggcgacatgggatgggggtgaaaaaaggaaagagagggatggggtttctcttgcttttggcatagcgggccccggcgggaggcccgcaacgacgggctattag

SEQ ID NO: 45176 - DNA, 438 bp, Glycine max
  Peptide Sequence Number=SeqID_136861
atggaaacaattctccagaatccacaattgaattctgccgaattctatgttattactgaccttattcctcaaccacaaccatcgtctccacaaccctcatgtccacaactacaactatcgcctcccaaacagttaccgtacaacaacatagacctcaataatccagtatcttcatacaacaaccttgaatcacaagacccctttgacatttatacttcatacacacaaatattatccgagaacgattctttttttcatggccaactgtcgcaacgtgcccttcgcgggcgagcgagggcgaggctcacgggtgcgctttccaaaggaggaaagatgcgcggagtcgccaccaacgtttatttgtggaaaacatcgggaaaaccgaaggaaaccggtcaaaatgaaaattctaagttcgggagttgtatttacgcttga

SEQ ID NO: 45177 - DNA, 297 bp, Glycine max
  Peptide Sequence Number=SeqID_136862
atgtacggcagaggaaaaatgtccttgggactggctcgattcagctgtgacaaggtagctggcctcttcataagagagacatctctgcttccatttggctaccttagattcaaacttgctgatgagaggctaccaaacatcccagcttttagaggtggaccctactggaattccaaggtaagaaaaaggaaattccagctggccacaattaaggtagctagctgcttccctgcaccagtccaaagatttacccaagcacccaaattggcttttagcatagttaatcttgagtcctga

SEQ ID NO: 45178 - DNA, 123 bp, Glycine max
  Peptide Sequence Number=SeqID_136863
atggcgactctttgcaaatccagaagaaggaaatcaagacatttccaaaaggattgcctaaagtgtaagtcttggttcgaaaagaatggtgagcttaatgctcatagattccttacaatctaa

SEQ ID NO: 45179 - DNA, 492 bp, Glycine max
  Peptide Sequence Number=SeqID_136864
atgactagaacacgaggtttaggtcgtgtcataggtagacttgtaggcggagatagacatgatgatcatgatgtagctgatgttcccgagagacgtatgcctattgtctctgcccgtaggcaacgagttcatcagatgactgcggatacacgtgatttggctgaggacgttgctgacatggctgacgatgtccctgatctagctaaggaggcacctgagatgcgtgcggacatagatggtgctgatggtgctgaggggtcagatgctgatgatgctgagggattccctggtggaccacgtgacccttggtgtcacatggggaggaaggtgacactgattgggaggccagtgcctgagattaaagacctggttgatgccacagggattaagtccactgatcgatttttcagttgttactggcgatcctggactgatatccgcatttgtggagaggtgacacggtcgagactagcaccttccaccttccggtag

SEQ ID NO: 45180 - DNA, 914 bp, Glycine max
  Peptide Sequence Number=SeqID_136865
tttcgcacctttttcgccaagaagggaggcatgcttgcccattagaaagcctccgttcatgcacagagaaaggaagggcggattgggatcaactcttagcaagcatagaaggagcatatgtcaactggttccttcgatggaaggaaggaagaaccggagttcttatttcatgcggaggatttccaaatgttcccttgatggggacaaggggttgcatcagctacaatctcattcttgctataagacagcttggcgtaacaatggtcatagcaccactagaggaagagatcgtgcctgtcatttcacgaggtttcaataagaccaatgtggagacacttcaaaaggtccgcatggcatgggaggtgttgcaaaagaaagacaaggaactcagaggcagtaacaatgggcccatcggtggctaccgtgagtggttgaaagcccacgtgcaaggtttggattggctcccaagtctgagaaccactaaaagggaggaagatgaggcaccggaggaagacgaagaggtgcaagcccttaggacagaactcaagcaagctcaaacagtcaaagaaaggttcaaatctgcagctcttaaaatccgaaaggagaatgccgaactgagagatgtaaatatggctaccaccaaggctttggaacaagagaccaaaagggcccgtagggaagaacatggccggaacaagttccgaggggctctgtggagtagtaacaacgaacttaaactccgaaaagaagaaagggaccaatcgcgagtagacggtttgatcttgaatgatgaattgaaggcttgctcgaggtccaagagaagtttgtctcagcggttgtgcaagacagagaccaacatgttagctatcatcgccaagtatcaagaagaactaagccttagccacaacccatga

SEQ ID NO: 45181 - DNA, 426 bp, Glycine max
  Peptide Sequence Number=SeqID_136866
atgaacttaatcattgttatcaaaaagaaaggacacgctttatggcgcccttaccgaactcgtgctagagctagagtaatgggtgaagcagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggtaggcaaagatttgggaagtacggacccccccatgatgtgcaagatcaaaatgagcacgccttcccatcatatggcttgcctcccaactatacaccacccaatgtggcatacactctcaaatgaaaaatctcaataa

SEQ ID NO: 45182 - DNA, 354 bp, Glycine max
  Peptide Sequence Number=SeqID_136867
atggcccaagccgccgtaaagctcccacggtacccaccaatatgcacaacatcacctgagctttttggctcacgccgggggctcttccgactcaacgcttgcccaaccaagggcgctcgtgcccctacagagcggggcccctcagacttcggctctaacccagcctcacccggccaacaatgcccaccttggcgcaggctccaacacggcgaagaacttttcgccaaggcaggctcaagatttcaccccgatcccaatgatgtatggggacttcttgccatctctcatcgccaacaaattggctgtggtgattccgggaaggatcttctagtctccgttctcgaagtggtataa

SEQ ID NO: 45183 - DNA, 178 bp, Glycine max
  Peptide Sequence Number=SeqID_136868
atgatagatctcatccagcgcaagttgctgcagcccagatacgcacactgctatataaacatgaaggctgcacgagttctgtaccaatgtcttgtgagccaccttgatgtcaccctaacatcaagtgttggacctgagtgtgtagagttgatctctattgttcagagagcaatctctg

SEQ ID NO: 45184 - DNA, 363 bp, Glycine max
  Peptide Sequence Number=SeqID_136869
gtgcagcaggattttggctttgtgcagaaaaatgcttgtgtgtggttggctgtggaaagagtagtgcagaatgagttctggatgtttgctaagttttctgccttttgccctgttttcttggctgtgcttgggaggattgatggggacccggtgttgagagaaacgaggatatgggctacgtgggagtacgtgagctcagttggaggtgggcaacagaggatgggtgaaacttcctgcttttactcgttgaccacagagtggtacctggagatatgtcgcgggggtcaggagaccttggggacgtcaggtggggtgctattgcccaaaaccaagcttgaccaatcccgacccaacccgggcata

SEQ ID NO: 45185 - DNA, 81 bp, Glycine max
  Peptide Sequence Number=SeqID_136870
atgaataagaaggttaagtggtggctgcacagaaatatagaaatggcaataacggaagctacagggctccaaatgaggtga

SEQ ID NO: 45186 - DNA, 300 bp, Glycine max
  Peptide Sequence Number=SeqID_136871
atgaaaaaggattgtcatcatcaaaaagggggagattgtggaagcaatgacttccaagattattttgatgatgccaaagaatcaagagctaagcaagtttcaaataatcaggagtcaaaaagcttcaagaatcaagtttcaaagaatcaagattcaagaataatcaagtttcaagattcaagattcaagaaaaatcaagtttcaagaatcaatattcaagaacaatcaagatcaagattcaagactcaaaattcaagaatcaagataagtactaaaaaagcttttcaaaacattgagtag

SEQ ID NO: 45187 - DNA, 342 bp, Glycine max
  Peptide Sequence Number=SeqID_136872
atggtggatattgatgtttctgaggatcaaattgccaaggaaatcactgccaaacgagtccagcattggccaaagaaagggaagctttcagcagggaagctaagtgtgaagtatgcaattctacacaggattggagctgcaaactgggttcccaccaatcatacttccactgttgccacaggggacacatgtcccagacattgtctcgacatcagggaaagctgctgcttcaggtgctgtgtccaaggatgccttgattgcagaactcaaggacacatgcaaggggctggaagcaaccatcaaagccaacacagagaagaagatgggagctggaacggctga

SEQ ID NO: 45188 - DNA, 300 bp, Glycine max
  Peptide Sequence Number=SeqID_136873
atgtatttcacctccctggaagaatcttcttgggctatgcattgtcctatcttgtgtgcttcgctgcagatgtggcatccccctatttgcatggctgaagactccattggagcttgtaggccaaggatcttcttcatcaatggattcctttgcttcttggaagatgaatggcagcggaatggagaaaggaagagagagaggagacgccacttcaaggagaagatgagtctagaagaagctcaccaccataggaggccatggataagagcttggaggaagaaggagatgaataaagggtga

SEQ ID NO: 45189 - DNA, 165 bp, Glycine max
  Peptide Sequence Number=SeqID_136874
atgtccccaatggagtcgccaactgtcataagctaccctttggcgggagggcgacgcgagggctcacgggtgcgccttccatgggaggaaaatgctcggagtcgccaccaacgtttattcgaggaaaacatcaaaaaacttaaacgtgtggtctacgaactttaa

SEQ ID NO: 45190 - DNA, 576 bp, Glycine max
  Peptide Sequence Number=SeqID_136875
atgggtgatcaagaggagacacaggaacagatgaaagccgacatgtcggctttgaaagaacaaatggcttccatgatggaggccatgttaggaatgagacaactcatggagaaaaacgtggccaccgctgccgctgttagttcggctgctgaagcagacccaactctcctagctaccgtgcaccatcctccctcaaacgcggtaggacgagaaatgagcacactagggcacaacagcaaccgccatttgggatacaaccgggtggcttacccttatggattaccgcctaattacacgctgccagtcatgcatgatgatgcgggtcatgtctcttcccccatccttgaaggggagcctcctcgacagcccggcgaggtccatgaagatcatcgagagtatgcccaaggggatgtcgatttctaccccccgatccccgtcgaggggccggcgccgaacacatttcctcagcccaacctcacagcacagccaatattcttgtccacagaaggaccacccccggcggccccacgaacgaaggaaactcgatctcctcgaggagagattgagagctattga

SEQ ID NO: 45191 - DNA, 156 bp, Glycine max
  Peptide Sequence Number=SeqID_136876
atggaccctaagagaataaaggtcattcctgagtggcctactccaccaagtgttgagcaaagaattaatgagtttcaagaacctcgggatttgagttcaaatccttttcaagggggagggaatgatgcaatcctaccccacaagggtattggatag

SEQ ID NO: 45192 - DNA, 141 bp, Glycine max
  Peptide Sequence Number=SeqID_136877
atgaaaggaaaccaacaaagggtccccagtggagtcgccaactgtcgcaacctgcccttcggcgggagggcgacgcgtgactcgcgggatgcgtgttccacgaaaggaatacgcgcggagtcgccaccaacgtttatttga

SEQ ID NO: 45193 - DNA, 303 bp, Glycine max
  Peptide Sequence Number=SeqID_136878
atgatggcacatcagaggccaaggacaaggcttgtagtgagcttcaaaaacaaggaaagggaaacaaggctcaaaagggctatcaaaggaattaattcaagggaaagggaagaatcaaaagaattctcagactgtgtcattttgaattctttgacaagggacaagggagacacaaaagaattcaggtggttagtcctttgttcttttggaaaagggagaagagagacacaaaaagaattcaggcggttagtccttggcgaattctttttggcaaagggagaagggaatgaaaaagatgaatag

SEQ ID NO: 45194 - DNA, 261 bp, Glycine max
  Peptide Sequence Number=SeqID_136879
atgttgcggaaccttatggattacgtaatcatcccttttttgccttccggaacgttacggaactttacagattgggcactaacacttccttttaatttccgacatgtcacggaacttcacggattgtgctacaacacttttcttttggcttctggcatgtctcggaacttcacaaattgcctaatgatgggtgccaaatacctcaaagtgatcaaacgagggtcgcatcccaacaacggatggtccccagatgtaattagg

SEQ ID NO: 45195 - DNA, 180 bp, Glycine max
  Peptide Sequence Number=SeqID_136880
atggctaaggagggtttccaccaacttcagtgttttaaagactccttgacgtttcagattctgaaggctcgcttagcaagagtaagtgacttttggcttagcgagctgggcgtgctaagtgcgagaagagacaaacaactcgttgggcgagctggcggcacgttgggcgcatgcatttga

SEQ ID NO: 45196 - DNA, 177 bp, Glycine max
  Peptide Sequence Number=SeqID_136881
atgtcaggaaaagctataagagaaatcttagttaggttgttggatgaccttgcggaacaacaaggaggaggtgaagcaaaagctaaggagaatgaaacccgagacgttgctgaagatcaaggaggaggtgaaaaagcagttcgacgtcgaaaagtctttggactagacaatatctga

SEQ ID NO: 45197 - DNA, 414 bp, Glycine max
  Peptide Sequence Number=SeqID_136882
atgttggggaagcttgggaggattgatcggggacccggtgttgagagaaacgaggatatgggctacgtgggagtacgtgagctcagttggaggtgggcaataggggatggtgggtttatgctcgcattgtggatgtggaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcaggcttgaaaacgaggtcaagaagctaagggagcttctggtaatcgattaccagggatgtaatcgattaccaggcttaaaaagggaactgggagatgggggaggcctctggtaa

SEQ ID NO: 45198 - DNA, 774 bp, Glycine max
  Peptide Sequence Number=SeqID_136883
atggtagaagtctccacaaaggccattgcctcccttgcccagtattacgatcagccgttgaggtgcttcacctttggggacttccagctatcacctatggtagaagaatttgaagagatcctaggatgccctctagggggaaggaaatcatacctcttctcagggttctatccctcattagctagaatttccaagatagtccaaatctcggcgcaggaattagaccacaggaagcaagtcaaaaattggatggttggtataccgagaaatatttggaggcaaagcaagatcttggcaggagtcctctttccgaatgtggatgggttggtggacctagcaacgatcgacgcttttctcgcctatgataaccacaaggaaagcccggttgtcactatgctagccgacctatatgacaccttcgaccgaagatgcgagaagagcagtacaaggattgtttgctgtactccagctctttatgtatggttggtttcacacctttttcgccaagaggtaaggcatgcttgcccgctagaaagtcaccgctcatgcacagagaaaggagggccgaattgggaccaactcttagcaagcaaaaaaggagtgtctgtcaactggttccctcgatggaaagaaggaagaaccggagttcttatttcgtgcggaggatttccaaatgttcccttgatggggacgaggggtcgcccccagttacaatctcgttcttgctataagacaacttggctaccctatgagaggggcgccactagaggatga

SEQ ID NO: 45199 - DNA, 231 bp, Glycine max
  Peptide Sequence Number=SeqID_136884
atggagatttacgtcgtcttccgcgcagactacatctgtcaagcactaacccgtgaggttagggggcaggcggatataccccaagtggttatccgtataaacattattttgctatctcatgcaaagactaacgtcgtcttctgcaccatttctcaaccagaggcaagtgagcccattgacacttggagatttacgtcgtcctccgtgcagactacctttgtcaagcactaa

SEQ ID NO: 45200 - DNA, 478 bp, Glycine max
  Peptide Sequence Number=SeqID_136885
aggactacacgtcctcgcctttagagggctacacgccctcgccttcagaggactacacgacctcgccttcaaagggctacacgccctccccttcagaggactacatgtgctcgccttcaaagggctacacgtcctcgcctttaaagggctacacgccctcaccttcagaggattacacgtcctcatcttcagaggactacacggccgcaccttcaaagggatactcgccctagccttcagaggactacacgtcctcgccttcagaggagtacacgtcctcccctacagaggactacaagttcttgccatcagatggctacacatcctcacctttagaggactacacgtcctcaccttcagagggctacacgccctcgccttcagaggactacacgtcctcccctttagaggactacacgtcctcgccttgaggactacacgtcctcgccttcagaggactacacatcctcaactttag

SEQ ID NO: 45201 - DNA, 756 bp, Glycine max
  Peptide Sequence Number=SeqID_136886
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcggggcgtaatttttttaaggcagttattgtgcctagaatattttatctgattaataagatgatcttcttgagatcgttttggtctgcgcgtaatctcttgctctga

SEQ ID NO: 45202 - DNA, 354 bp, Glycine max
  Peptide Sequence Number=SeqID_136887
atggcaatccaaggagatgatagtgaagttggaaagaagatggaggaacgtaaacaacagctggcacctaagccaacacttgaacctgtttctgatttggtagaacttgaagagattaataaggagactgaagatgacaaggaggagaagacaccaataaaagtggaagaaaaagaaagaataaaagaagaaaaaaagaaaaagaaaaaaaatatgctgacgaagaagaaccagtacatccacagtgatagaattgtggtggaaggaaattgtagtgttgtgattcaacgcattcttccgcctaagcacaaagatcctggagttgtcacaataccgttggtgaggttgctatag

SEQ ID NO: 45203 - DNA, 280 bp, Glycine max
  Peptide Sequence Number=SeqID_136888
atgaccactcttacacagatatggatgacgttgctacttagcaacattccacccgacgaccacaatgccgatctccctcctgcggaagtattagttgggatcgcgcccacaagacacccagtggacccaaagaagtccaacagggccctggggtttccagctctggttacagacctctgtcattcctatagggtgcccatccccccaacaagggatcgtgcccacaagacacccagtggacccgaagaagtccaacagggccctggggtttccagctctg

SEQ ID NO: 45204 - DNA, 441 bp, Glycine max
  Peptide Sequence Number=SeqID_136889
atgcatagatctcccacgggcaatttagttcctctggacttagaaattgaagctacattgcgaaggaacagggtcgagaggagaatgaaacttctgcaagacagaacagttgcatccattcttgaggaggagactcatttctctgacttattatcacctgattcaccatcatcaagggaatctgccactcaattacctgaagccattaccatggcaataaagcatgaccagaggattgcccttgaggattattcaagtagttcagtaccacaatttttcaccagcattgcacgtcctgaagtacaagctaacaacatcaactatccacattccttaattcatttaatacaggggaacttatttcaaggattacctaatgaagatacttatgcacacttggcaacgttcattgaaatatgtaacactgttaagattgccagt

SEQ ID NO: 45205 - DNA, 191 bp, Glycine max
  Peptide Sequence Number=SeqID_136890
gtggccttgtccgtgctcgtgcgcttagtgcacgtatggaccgcttagcgcacgttagtgatttttggctcaacgcgcttctctcgcttagcggatgggttgaagcggtgcgcttgatgacctggagcagtgcgctcaacgaacctgacaactcatcttcttctggattcttcctcgcgcttagccactga

SEQ ID NO: 45206 - DNA, 807 bp, Glycine max
  Peptide Sequence Number=SeqID_136891
caagattgcagctgtggtcggagatttggcgagagagttggatcatatgaagcaaacccgaaacggcgtagtgggcctaccgcggaaatacttggaaggcaaggcgagggatatggcaagtcaagaaaagtgggtcccgtttgcggatatactagctttgctaatctttgaggttgtcctctttccgaacgtggacggtttggtggacctagctgcaattgatgctttccttgcatatcaccatagcaaggagagcccagtggtggctatcttggcggacttatttgatacatttgaccgaagagtcgattgggaccaacacttggctgggataggaggcagcacaatcaattggtttcctcgatggaaggaaggaaaggagggagttcttttctcatgtggggactaccctaacattccgttgatggggacgaggggttgtattaactataatcccgcacttgccataagacagctagggtaccccatgaggggagcgccaacggaagagagcctctcttgcctttccttagttcatacgcgagggttagattggctctccaagttaaaagttatcgatgaggagaacttcgaagctctggaggaggatgaagaagttcaagctctaaaattagagctagggaaggcaagactcgccaaagaaaaattcaggtcagcagctacaaacatccggaaagagtgcgctgagttacgagaggaaaacgcagccaatgcaagagtccttgaacaagaaaccaaaagggcccgcaaggaggaacatggccgagacaaattccgaggagcttt

SEQ ID NO: 45207 - DNA, 501 bp, Glycine max
  Peptide Sequence Number=SeqID_136892
atgggtgaagtagaggaggtgcaagagcaaataaagaccgacatggaggccatgaaagagcaaatggccacaatgatggaggccatgatgagcataaagaagatactggaggtcaatgcggctgcaatagccgctaccagtaccattgttgaggtggacctgacccctccatatggcctcaaccaaataaatcatccaaccccatatatggtaggtctggaaggcaaagagttgggaggtacgggcgaccctcatttagtgcgaaaaacaagcatgccttcccgccatatggcttgcctcccaattatacaccacccaatgtggcgtacactcccgatgagaatgtcaataaccccactccgatactcattgagagccaataacctcaatctaatcatgcacatgtctctcaacccatgggggagacacatgaaattccccgccacaatctatccaacttcgagccttgcctcggatatgccattgaagggcaagcagttg

SEQ ID NO: 45208 - DNA, 804 bp, Glycine max
  Peptide Sequence Number=SeqID_136893
atggcattgaccaaggcggagatggcggaaaagctgttcgacgaagtcggtctgaacaagcgggaagccaaggaattcgtcgacgcgtttttcgatgtgctgcgtgaagcattggaacagggacgtcaggtgaagcttaaccgcgaactaccgccgatcccggccaagcgctacttcaccatcggtgaagtcagcgagctgtgcgacgtcaagccgcacgtcctgcgctactgggaaaccgagtttcccagccttgagccggccaagcgccgaggcaaccgccgctactaccagcgccatgacgtgctgatggtgcggcagatccgcagcctgctgtacgaacagggctacaccatcggtggtgcacgcctgcgtctggacggccccgatgcccgcgaggaatcggcgctgagcaaccagatcatcaagcagcttgccgcgaccgcgccgtgcgatcgcgtgtcgcagcagtgcggtaccaatgccgtggccgcggcgttcgcgcgccaccatcagcatctcgacgaaggcctcgccgaagaagtggtgatgcatgaccaggtagccgacgaccctgccgtcctgctcggcgacatacacgctgccgtgtgccagccagttgccaatctgcatgatccgctctggatcaatggctgccacgctgtcgagcgcgatcaaggcatccgcgtcctgggggctgccgttacgcaggcgcggagaacgcccacgtctggctcatcgcgggcggagccccctgcagcaacagaccgccacccgatacaaaacaggcgagcaggacgatga

SEQ ID NO: 45209 - DNA, 165 bp, Glycine max
  Peptide Sequence Number=SeqID_136894
atggtggagatggctgtggggtcttatctggagtgtcataggctcctaggctgtagaggccccaccccctccagaggaagaaggctggtctcttggtcaggccacctatgcatcaaactcctccatgcttataatgtgttagacaagtggcctcagatatcttaa

SEQ ID NO: 45210 - DNA, 120 bp, Glycine max
  Peptide Sequence Number=SeqID_136895
atggagaattgtcgaacaacgctaggcaatgacattcgcggggctccagactcgaaggcaatcatgaagtatagctccaaactcgaaggtggaggacacatgaacagcgctaggcaatga

SEQ ID NO: 45211 - DNA, 315 bp, Glycine max
  Peptide Sequence Number=SeqID_136896
cttgggaggattgatggggacccggtgttgagagaaatgaggatatgggctacgtgggagtacgtgagctcagttggagatgaggaagtgttgaagggtgaacttcctgcttttattgttgactacagagtggtacctggagatatgtcgcgggggtcaggagaccttggggacgtcaggcgagctcctggcagtcaacagataaaaggaaaacaagaccacaaagcaaggaggcttgtggtggctgaccagctgcttgaaaacgaggtcaggaagctagggaagcctctggtaatcgattaccaaggggtgtaa

SEQ ID NO: 45212 - DNA, 408 bp, Glycine max
  Peptide Sequence Number=SeqID_136897
atgtataacagtataataacctatattggtctccactgcggtgcacattggcaaatggttgtcattttgcctaaggaaaatattgtcatctggttttgttcattgcataataggccagacaactacctcaaaggaataattaacagtgctttgaaaagacttgacgatactccacaaagtaaatccaaggctagtgctaggtggattgttgttaaaagtaatagacaaaaaggaaacactgagtgtggctattacatgatgcactggaagtccactataatcttaggaagtttcaggaataattggaaaacgtattttaatgatgttagaccattggaagtagagagattgaaggcgcttcgcatccagtgggcaaagtattatttgaaagttaaaaatgaaacttag

SEQ ID NO: 45213 - DNA, 128 bp, Glycine max
  Peptide Sequence Number=SeqID_136898
atgcttatgcgatgcatgatatcaatgcatttacggacacgagagcccgaaaaatcctctcttcttacttgcgcattcggcggtgtcgcaacctacccttttgcggacgagcgaggcgaggctcacgg

SEQ ID NO: 45214 - DNA, 481 bp, Glycine max
  Peptide Sequence Number=SeqID_136899
aaggaactggcataagaagatagcaaatctggtagagggaagtattgatgtggcacttgtacgggagttttatgcaaatgtgtatgatcctaaagacaagtcgccaaaacaggtcaaggaaggagaaagtcttccagcatatgcaagatttgtgttgttaaggccaaaccaacaagagttagaaaagatggatatgaatcatggatccttcatttctagtcagattacactcatagcacaacatgactcctcgaggcttggctttcctgccctaatcattgctttatgtaaagcccagcactatgattccttgacccatgagagactgagtcctaccattaatttggcttatattaagaagaactgttggaatcttgatgatccaacagtaactttcagaggacctaggaaggccaggggtaagagatctgaggccccttccacaacaccatcagaggcaccagcactgtggcgtccctaa

SEQ ID NO: 45215 - DNA, 201 bp, Glycine max
  Peptide Sequence Number=SeqID_136900
atggcttttgggttcaatagagaaaggaccctctctattaacccatctcaaactctcccaccaaagaattaccctcatcttaaaggagattgtaggcagactttgtggaatagtgaccagcaggatcccccccccccccccccctgtgagatagtcctggctttgagggatgaatctgaacagcctcatgtgcaggcatga

SEQ ID NO: 45216 - DNA, 277 bp, Glycine max
  Peptide Sequence Number=SeqID_136901
atgaaaagagaaaagcatgcctcatataataatcataactcttacaaaagcctaagtgaagaacttcctgactattataaaggaaggcataggtcacatcttagacctcactcccataggagagaaaatgaaagaaagcctcaagaggctaacattaacctcccatacttccatgagaaggacaataaagaccaaggtctaggcatcttaggggcagcaccttctaagcccaaagatgataaggggaagacaatagaaaagcaaccccctaaggcta

SEQ ID NO: 45217 - DNA, 459 bp, Glycine max
  Peptide Sequence Number=SeqID_136902
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccttcattggccagaatttctaaaaaagtccaaatctcggcgcaggaattagaccgccaaaggcaagtcgaaaatggggtggtcggaataccgagaaaatatttggagccgacctatatgacaccttcgaccgaagatgtgaagaaagcaatgcaaggattgtttgctgtgctccagctctctatggggggctggtttcacacctttttctccaagaaggtaggcccgtctatccgctacaaggttaccgctcgtgcgtcaaaaaaggaaaggcgaattgggaccaactcttggctagcatag

SEQ ID NO: 45218 - DNA, 183 bp, Glycine max
  Peptide Sequence Number=SeqID_136903
atggtgagtgtgaaagtggagccaggcgcaggcgtagtgattgtagaagcaagactacacgccttgatcatgcaaatcgccacacgctgctgcagaggcgcatacacaccaacacaacacaaccacgccctcacaaaagcagattcttctcaactctcagtcccctcctccgtgaggtcctaa

SEQ ID NO: 45219 - DNA, 465 bp, Glycine max
  Peptide Sequence Number=SeqID_136904
atgaataggattctatctaggaataggaatagtgaggtggatgcgggtgcaacatgtcacgtgagcaaggattgtagtaaagtggggttggtggaactaagagaagagaagaaaatcaacatcagggaagattgtccaaaacagcaacacaaggacattcgtggtgtggctgttgatggtgttgagggagagccagttaacctcactgaacccgttgccgaagcaataggagctgcttttgctgcatggtttagattgttccttatctgcagcaagatgataaacgaagaagaaagccaatctattttggttagtggagaaagtggtgttggtaaaactgaaagtacagaaatgcttatgcattgtcttgcctttttgggagggagagcagcaactgaagagagctttgcacccgatgatctaaacatcaactatggatccaaacaagacgatgatgggccttag

SEQ ID NO: 45220 - DNA, 108 bp, Glycine max
  Peptide Sequence Number=SeqID_136905
atgggcggctccggtagcggtggtatgaggccagagagagagaaagagaattttacaaacgccggttaccttaacttcaccgcttcagttgtggatgatatattttaa

SEQ ID NO: 45221 - DNA, 2502 bp, Glycine max
  Peptide Sequence Number=SeqID_136906
atggcttctgcttgtgtgaccttgaaatccaatacccatttagcaaactctgagaagggctttctaggagaaagaataaaaggtggcttcaacaacagtgccttggtaatgaatcagttggctatacgttctagaagccacaagagggtgaaacatggtgttggtgttgtatctgctgttctcacttcaaacaatgccaaagaatcactgaccttgcaagtgccttcctttttaagaagaagggctgatccaaaaaatgttatttccatcatattgggaggaggacctgggacacaactctttcctctcaccaaacgtgctgccacacctgcggttcctgtgggtggatgctacaggcttatagacatccctatgagcaactgcctcaacagtggcatcaacaaaatatttgtgctgacacagttcaactctgcatccctcaaccgtcacattgcccgcacctattttggaaatggcatcaactttggggatgggattgtggaggttctggcggctactcaaacaccaggagaggctggaaagaattggttccaaggaactgcagatgctgtgaggcaattcacttgggtatttgaggatgccaagaatacaaatgttgagaatgtattgatcttggctggagatcatctatatcgtatggattacatggaccttgtgcagagtcacgttgatagaaatgctgatattacagtttcatgtgctgctgtgggtgacagccgtgcatcagattatggattggttaaagtagatgacagaggccgcatcattcaattttctgaaaaaccaaatggtgatgatctgaaagcaatgcaagcagatacctctcttcttgggttgtctccccaagatgcattgaagtcaccatatattgcatctatgggggtttatgtattcaagacagatgttttactcaatcttctgaaatggagatatcctacctccaatgacttcggatctgaaatcatccctgcagctgtgagggatcacgatgtccaatcgtatttttttgaagactattgggaagacattggaacgataaaatcgttttacgatgctaacttggcccttactgaagagaaagctgcaagaatgttgaaaattgtcaatgtcatttctcagttgattgaaactaatacttatctgctttatggcactctcttgcagagtcacaagtttgaattttatgaccccaagattcccatttacacatctccaggattcttaccaccaacaaagattgacaaatgccagattgtggatgctattatttcccatggatgtttcctgcgagaatgcacagtccaacactccattgtgggtgaacgttcacgtttggattatggtgttgagctcctggacactgtaatgatgggagcagactattaccaaactgaatctgaaattgcttctctgctggcagaggggaaggtcccaattggtattggaaggaataccaaaattagaaactgtattattgacaagaatgctaagatcgggaaagatgtcatcatcgcaaacaaagatgtaagcaatgatcctggcgttcaagaagcagatagaccagaagatggattctacattcgatcaggaatcaccatcataatggagaaggcaaccatagaagatggcactatcacaggtcaaagtcctaagttggcggtgaggggcacaggtggtgagtgtgaggcatatggaaaagtctcggagggtgggttagaagacaagaagcaaaagaaccgcagttctagcctccacaaagatgataaccaaaaccaacacgtgcagattgattctggctttgccctccaacaatttcttgatcacatacccattatttcaatagctggcataaaaaattcacctgttttggaattgaaagctggagacagtataatggatgcaattcatatgttgtacgaaaacgacatcttttctgcagcaattgtggatatgtcagacataaggttttcagatcgttatattggtctcattgattttacaagcatggttctttggtgccttgaggttagcgagtcggctaagtcattcctctatgaaccatttttcccagtaagcatggatgacacggttttgcatgctttgctacttctctctaagcatcgagtgcacgttttgccagtcatacaggaacctgaagctggatttatcggttttgctacacagaatgcagtagtcgagcaccttcttcaatcaagtgaactagagtggtttgataacattgcagataagaacttatcagatttccggattttaactgtggaagaattcattcacatagagactgacaaagtagaaactgaacgagccattgaacatgaccatggggtttttctcacagcaggaagtctccagcttaaaaacagcttcatacccagaatggacttgcccgttgcaaacaaggaaaatgaaacactcaagcaaacaatggagcatacaactgagacagtttcagctttctga

SEQ ID NO: 45222 - DNA, 331 bp, Glycine max
  Peptide Sequence Number=SeqID_136907
atggcacttgtagaaacaaacatgaaaagctctctgcacaatcgcagtaacagcatgcccactgcaccacgccccactgtatcacaagttgaggagcatttgcacaggttgaaggatactgaagccaccacttcttcgttgtcatcttcaataagtcacagactcaacgacttgcaggatttgcaagaaagcactgatgagttgcttcaattgagaatctcccaacaagcattggcacaagaatgcagcagcaaacagattgatgaactattagatgggaagagagatgctgaaatgggatccacaattgagggtggaaaatacctggcat

SEQ ID NO: 45223 - DNA, 1551 bp, Glycine max
  Peptide Sequence Number=SeqID_136908
atggctggtgattcttctgtaatgtccaatggatacagcaagggcagtgtcaatccactaactaacctgcgaaggacttaccaagtgttagtggctgccactcaagattggggcatcggtaaggatgggaaattaccctggagattgcccactgatctcaagttttttaaggacattactgtgaaaacatccgatcctgggaagaagaatgccattgtaatgggaaggaaaacatgggagagtatccctcttgagtacaggcctctttctggtcgccttaatgttgttcttactcgctcaggcagctttgatattgcaacagcagagaatgttgttatatgtggaagcatgtcgtctgcattggaactgttagctgcttctccttactctctgtcaattgagaaagtatttgttataggaggtggtcagatatttagagaggctctcaatgcgcctggatgtgaagctatccacttaacagaaattcagtcaagtattgagtgtgacacttttatgcctccagttgatttcactatgtttcggccatggtactcatcctttcctaaagtggaaaacaacatccgctattgtttcaccacttatgtgcgtgtgcggagttctgctccagagtccccgggtcagaacattgatcaacttcttgataataattctgagtccatgaaatttgaggtcaaggaattttcttttcttcctaaaatgatttctgagagacatgaggagtatctatatcttaagctggttcaagacatcattgctgaaggtacaactaaggatgataggacagggactggtaccttgtcaaaatttggttgccagagagtattttggcgaggggttgttgaagagcttctttggtttatcagtgggtcaacgaatgccaagattttattatatgaacttcattctgaaaacaagtttgtaattggctttacatttttttattgcagtgttggtttgacagagagggaggagggcgacttgggacctgtttatgggtttcaatggaggcactttggtgccagatatactgacatgcatcatgactactccggtcaagggtttgatcagcttttagatgttattaacaagataaagcataatcctgatgatcggcgaattattctctctgcatggaatccatctgatcttaaattaatggcacttccaccctgccacatgtttgcacagttttatgtagcacacggggagttatcatgtcaaatgtatcagcgatctgctgacatgggcctgggcgttccatttaatattgcatcttatgcccttttgacatgcatgattgctcatgtttgtgatctcattccaggtgattttatccatgttattggggatgcacatgtttactgcaatcatgtgaggcctttgcaggagcagctccataaccagccaaaaccttttccaactttggagataaatccaaaaaagaaagatatagattcttttgtggctgctgatttcaagctcataggctatgatcctcaccagaagattgatatgaagctggctgtctaa

SEQ ID NO: 45224 - DNA, 1053 bp, Glycine max
  Peptide Sequence Number=SeqID_136909
atggcagcctcttcattgaaccacaaattccataaccatgctcgttctaatagcttgccctctaagccacaccctctcatcctacaatgcaatgaacgcttatctagactaggggcctatgataccatctcttcttcattgctaaggcaaaatcttactaaccttctagatttgcatgggtgcattgaaaagttggttcaactacccttaactcaacaagcacttgttcaggaatgccaagagaaatgggtggatgatctcttggatggatctctaaggctccttgatgcatgtacggcaaccaaagatgccttacttcacaccaaggagtgcacccgtgagcttcaatcaactataagaagaagaagaggaggtgaagtggaactcacactagaggttaagaaattcttgacctcaaggaaggtggtgcgaaaggccatattcaaagccctggagaatctgaagggtaatgcaaataaaggaaaccttgccatcactaattacaaagactaccaaaccatggcattggtaaacttgttaaaagaagctgaagtgatcactttttccacgtttgagtcattgctgaatttcttttctgggtcaacacaagcaaaacgaattagcagctgggctttggtttcaaagctgatgcacaacaaaagggtaggctacgcacaaggagcagatgagaatgagtttgcaaaagtggatgctgcatttcagttatttgcctttaacatgtcaaccaagtcaaatgatgatatcagtgatttgctaaagaagctagagaacttggggacttgcataccagatcttgaagaaggacttgagtccctgtttaggcgtttgattaaaatcagagttgcacttctcaatatccttaatcactatcagggtaacgctgttttgcgagaatgttctaaccatgccaaagaagagaaggttcaagcagctgatgactcgcttagtgaggtagatccgcttagcgagagacatctgcttagcaagacatccagctcgcttagcggattgggaaaccctagaaaaggataa

SEQ ID NO: 45225 - DNA, 2184 bp, Glycine max
  Peptide Sequence Number=SeqID_136910
atggcaacttactatacgagttcaagtaatgaaaggaacgcagtgcctatgctgtgtcttagggaacctttgcctaattcatatcccgagacaccagttttgccgagcaatatgacattttatatgaactctggatcatattcagaagcactgtctggcaattctcagcagcaaaacaattgctttgtgattccatcaccatcagtaggggcttcacattccactcctgaacaacaagaaatctttgccaatattagtgggttccaaactgggtttcatgatttcagtgcatggagggaaggtagaagtgaaatgttagtcagacaacctatggatggacagaacttacaaggtcatggattatctctcagccttggaacccatataccctcaggaattcatagttcaagttttgattcatttttgggtactaatccttcaatttcgggtaatgaggcctaccaaaatgattcatctagagatgagggtatgagacattctgaaaatcttccacctggcttacctgaagctaatcaagatttggccaaagcggatttttcatttcatggaatgtctggtgttggaaaaacagttcctagctccaaatacctcaagacagtgcaactactacttgatgaagttgttgacatccgaaaagctattaaaagacctgctatgaaaagtcatagcacacatgagaaatctaagaaggactctaaggaggatgatgagcaactagaaaacgacaggccttctgcaaatggagtgcctaattctcaagcttcaactggtaagacctcttgtgagctttcacatgctgaaaaacaagatctgcaccacaagttaacaaagcttttgtcaatgttggacgagactgtagtgtcatcatttgatgtgatagcaggatgtggagcagctaaaccatacacagcccttgctctgcaaaccatttcatgccattttcggtgtttgcgtgatgcaatcactggtcaaatcagtgcaacacaaaagaaccttggagagcaagatgcttctggaagtaacaatggagttggaatggcaagactaaagtatgtggaccaacaaatccgacaacagagggttattcagcagtttggcatgatgcaacatgcatggagaccacaaagggggcttccagaaagctctgtttcaattcttcgcgcttggctttttgagcatttccttcatccctatccaaaggattctgataagatcatgctagcaagacagacaggcttgaccagaagtcaggtgtcaaattggtttataaatgctcgagtgcgtctatggaaacctatgattgaagagatgtacaagcaagataattgtattgctggcatggactcaaattcttcatctgaaaatgtgtccaaggtaacaaaaagttatgtcaagacctccaatgatgtgggtgatgattcgcagcactgtcaaagtccaattgtggccgatacaaatcacagtggtggacaagctaaggacctcagacatgatcaggctcttgatacagaaatgatggcatccattggattagctagtctcataaatggaggttatggggctgaaactgaacataggcgaaatttggatgattgtggtctcttctctaatgacacagttgttcagtctgatggagctactaataagaggtttgtgtcagttggtccaacatgccaaatgccagagtctgagaggttcaagtcaggaagtggagtgtctctaacattgggtttgcagcattgtgaaggaggtaattttttgcctggtaagacccatctcagtttggtttccatgagggaggacgacatctccaaagcgaccgcagcttcaacagttggagtagagacaacagaacttgagtgcattggtgctggaaaccaacaacaaagagcattagcatttagctgcacgacgtcgttctgcggtggtggccgagtatcaaagaaagcgtttcgcatggtcccaatagcagttgcgaagcttgctgaggggatcaatggtgctgatcttcgtaatgttttcactgaagctggtttgttcgccattcgggcacaacgtgattatgtgattgatggagatttcgtgaaggaacttattcaagattctgagtacatggttttcaacttaaatgccagaaaatggtacggtaatacatgtccttag

SEQ ID NO: 45226 - DNA, 243 bp, Glycine max
  Peptide Sequence Number=SeqID_136911
atgacaccatggattggtggatttggtgatgttttctcagtccaaggtttccctaatgagtccttcttcaaggtttttgggtgcattatgtttaagaaaggggaaaaagggatgatggcgatggtagtaggaaagagagaaaatgagcaaagaaaggccacaacaaaggacgtagttggcggtgaaggagggaaggttgtaggtgttgcaattgtggtaggagttatagatgcgacaaaatga

SEQ ID NO: 45227 - DNA, 3270 bp, Glycine max
  Peptide Sequence Number=SeqID_136912
atggcttcttcctcgcgcgcaaggagtagctcaccgttttcttaccgaaaaccttcgactccttactcttccacttcttcgtcctcttccttcaccaacggaaggttaatgcctcgctccagctcttcctccacgtcctcgtttttcaactccggaggccgatccatgactccgagtcgcggtcgcagcgagtcggcgtatcacggctcgcgcggttacgccgcccgttctccggtggcgttcggagctgaggagctgattgcggagccggtggtggattcttcgaggaccggcgatagcatttcggtcacgattcggtttaggccgttgagtgaaagggagtatcagagaggggacgagatcgcatggtatgccgatggcgaaaagattgtcagaaatgagtataatccagctactgcttatgcatttgatagagtttttggaccacataccaattcagacgaagtgtatgaagtggcagcaaaacctgtagtgaaggctgccatggagggggtcaatggaactgtgtttgcctatggtgtgacaagtagtggtaagacacatactatgcatattttcttttcttctagtgttggttatttgtcaaacaagggagaccaaaattctcctggtctcataccactggctataaaggatgttttcagtatgatccaagataccccaggaagagaattcttactccgagtgtcatatttagaaatatacaatgaggtgataaatgatttacttgatccaactggccaaaatttgcgagttagagaagatgcacagggaacttatgtggagggtataaaggaagaagttgttttatctcccggacatgcactttcttttattgctgctggagaagagcatcgtcatgttggatctaacaattttaatctctttagcagccggagtcacacaatatttacactgatgatagagagcagtgctcatggtgatgattatgatggagtcatcttctctcagctaaatttgattgatttggctggatctgagagctcaaaaactgaaacaactggattaagaagaaaggaaggatcttacatcaacaaaagtcttctgacacttggaactgttattggaaaattgagtgaggggaaggcatctcatgttccatatcgagattcaaagctaacccgcctcctgcaatcttctcttggtggacatggccatgtttcacttatatgcacagtaactccagcatccagtaatatggaggaaactcataataccttgaagtttgccagcagggcaaaacgagtagaaatatatgcgtcacgtaataagattattgatgagaaatctctaattaagaaataccagaaagaaatttcattcctcaaactagaacttgatcaactaaggaaggggatgctagttggtgtcaatcatgaggaaattttgaccttaaagcaaaagttagaagaaggtcaagtgaaaatgcaatcaagattggaagaagaggaggaagccaaggctgctcttatgagtaggatccagaggctaaccaaactcattctggtttcctcaaagaatgcaattcctggatatctaactgatgtttccaaccatcagcgaagtcactctgttggcgaggatgatattgaaaatgagagtcagaaagattcttctgcagtgtcatcagatctgtttcatgatgttagacataaaagatcatctagtagatggaatgaagagttctccccagctagcagtactgttactgaatcaacacaagctggtgaactgatcagtagaacaaaattgacagtggactatagagcatgtacactccaatccaagttagagcatcctagggcaggaatttatggtgggatgacaacatctgatcagaaggatcttcttattgaacaagtcaaaatgctagccggcgatattgctttcagtaccagcactctgaagcgcttgatggagcaatcggtacatgaccctgaatgctccaaaattcagattgagaatttggaacgtgagatccaagaaaaaaggaagcaaatgagggtgctagaacaaagattaattgagactgaagaatctcctgtggctaattcatcactagttgaaatgcagcagacagtcacaaagttaatgactcaatgtaatgaaaaggcctttgagttggagctaaaatctgccgacaaccgtgtccttcaggaacagttaaatgataagagttctgaaaacagagagttgcaagaaaaggtgaggcagctagagcagcaactggcagcagttaacagtggtacatcgtcagtgtcttctgaacagtgtgcatcaggagaacacattgatgacatgaaaaagaaaatacaatcccaggaaattgaaaatgaaaagctaaagctagggcaagttcacttgtcagaagagaatagtgggttgcgtgtgcagaatcagaaactctctgaagaagcttcttatgccaaagaactggcctctgcagctgctgtggagctgaaaaatttggctggggaagtgacaaaactttcattgcagaatgcaaagttagaaaaagaattgatggccgcgcgagacctggtcaactctcgtagtgctgtcatgcaaacggttaatggtgtcaaccgcaagtacaacgatccaagagctggaaggaaggggaggatttctagccgtgctagtgaaatttcaggagctggtgtagatgattttgagtcatggagtcttgttgctgatgatttgaagatggaactacaggcaaggaaacaacgagaggcagctctggaagctgcattagccgagaaggaatttgtggaagaacagtaccggaaaaaagctgaagaggccaagaaaagagaagaagccttagagaacgatttagcaaatatgtgggtccttgttgctaagttaaaaaaagaagggggtgctgtcccagaatcaaacatcgataaaaaaaatgatggtgcagagcacataaataatcccaaaattaatgacgttgaaagtaatattgttcccaaggaacagcttttggatgcaccaaaaccagatgatgaaatgcccaaagatgagcccttggttgttcgcctcaagggtcggacacgggtagggattacatggattgcatgctgcccgcttgttggagaaaacttttgtctgttgttcgccatttgtttgacaggtattaatgaataccttggatacttcaaattaaacaaaagaaaaacatttttttcaaaaaggacttttaacatcaagcaaaactaa

SEQ ID NO: 45228 - DNA, 3675 bp, Glycine max
  Peptide Sequence Number=SeqID_136913
gaagaagaagaagagcgacaaggagaagaagaagatggtgatggtggaatggcaatggcagaagacacagaggagaagagtgctgctgtgagtggtgggaagaggaggcgtggggctgggaagaatgctaaggctacagggagagttgcatccaggaaaaagatggaggaggacgtttgtttcatttgcttcgatgggggggatgccccaaggcttaccatccttcctgcgttaatcgtgacgaggccttctttcgagctaaggggaagtggaattgtgggacaaatagattttgatgacagaaacagctgggagtatctcttcaaggactactacatagatataaaaaaaaaactatctctcacatttgatgaactcactcaagctaaaaacccttggaagggatctgatatgcttctttctaaagaggaatcactggatgaaacttttgatgccactaacgatagaggatcagattcagatagctcctatgagaatgcagatttgagtcgttctaaaagaaaaaaggccaagaaacgggggaagtcccgttccaaagaaggagatgacagctcagagtgggcttcaaaagagcttttggagtttgttatgcacatgagaaatggagacaaatctgttttatctcagttcgatgtgcatactcttttgctagagtatatcaaaagaaataagcttcgagatcctcgccgaaaaagtcagattatttgtgatgcaagacttcaaaatctgtttggaaaaccaaaagtgggacattttgaaacgttaaagcttcttgaatcccatttccttctaaaagatgattctcaggctgaagatctgcagggaagtgttgttgacactgaaatgagtcattgggaaggtgatggcaatcccaattcatatacgaaagctggcaaagataagagacgaaagaaccgtaaaaagggtgatgagagaggacttcaaactaatgttgatgattatgcagccattgataaccataatattaatttaatttatctaagacgtaacttggtggaagatctacttgaagatactgagaagttccatgataaagttgttggttcttttgtgagaataagaatttctggtagtggtcagaaacaggatttgtataggttggttcaggttgtaggtacatgcaaagcagcagagccatataaagttggtaaaaggatgacagatatcttgctagaaatcttaaatttaaacaagacagagattgtttcaattgatattatctcaaatcaggagttcacagaggatgaatgcaagcgtctccgccaaagcataaagtgtggcctcataaatcggctaactgtgggtgacattcaggacaaagcattggtgcttcaggaagctagagtaaaagatgataatgttttgctgctccctactacttgtttatgttttgtgttgatccttcactcttctctcacgctcagagaatgtgtagagaaattgcagcttttgaaaacacctgaagaacgtcaacgcaggttggaggaaatcccagaaatacacgtagatccaaacatggatccaagttatgagtctgaagaagacgaaaatgaagtggatgataaaagacaagaaaactacatgagacctagagggtctactgcatttggaaggagggggagagatattgtttctcctagaagtggttctatttcaaatgattcttggagtggaacaaggaattattctaatgtgaatcaggaactaagcagaaatttgtctaataagggattttcaatcaaaggtgataatgcttccaatgctaatgaggcactaaatgatgctcaattgcaccggggaagagatcgggaatcacaactatctaatagctgggagaggcaaaagcaatcttcaaccttggaaagtggtgctaaaaatacccaaccattggtagcatctgagtctttctctgctgctgtatcagaagcttctgcagcaccatcttcagccggaataactcctccagctgtgaaaattaatgaaactgaaaagatgtggcattaccaggatccatctggaaaagttcagggaccattttccatcgtgcaactacgcaaatggagtaacacaggatactttcctgctgatttgaggatttggagaaccactgagaagcaagatgattctatactcttaacagatgccttgacagggaatttttctaaggaaccatcaatggtggataaagctcaatcggtgcatgatttacattacccatcatcatactctaggaagtctccacaacaaggtatagaaggtcaagttggagaaagactgtcattagatcaaaatggtggatcttggaattcacatagtactctgggttctccgggacaaaccacaggaggaagttggagatctaaagataatatgaactctttagctaatagaacttctccattggcagttgaggtccccaagaaccctgcaaatggctggggttctgatgctggtgttaggaatgatgcaacaaatcttccttcacctactccccagactactcctggtggtactatggggctggcttttgaaaataaatggtcaccaacacctgtccagttgcctgggtctctcttaggaaattcattcccaggcagtcacggaggtttgcaggcctctgtggcagtgcacccagagcatgctgtacaaaatgctgaaaaaggctcaagttcacaacctggcattagttcagcttctacagataataccaagttgcatcctcaagcaacagcggtggtacctgttgtggcttcaggggttgacatcaaaatggcaggtgcaaatatgcaaaaccaggttgtgagtagccagaactctcatgctgaagctcaagggtggggttctgctggggttccaaagccagaaccactggcctggggaggtgcatcttctcaaaggatagaaccaaataatcctgctaccatgccttcccagccagcttcccatggcccctggggtgatgcttcatctgtgccaaccactgtctcgtttaacactggaaatccaactgcgagtttacccacacctggatttctgggcatgactgcacctgagccttggagaccaccggcttcaagtagtcagtcaaacatcgcagctccagctccacccaatatgccttggggcatgggcatgtctggaaatcagaatatgaactggggtggggttgtacctgccaacatgaatgtaaactggatgcctacgcaggtgccagcacctggaaattcaaatccaggatgggctgctcctagtcaggggctacctccagtgaatgcaggtggctgggttggacctggtcaaggacgttcccatgtaaatgcaaatgcaggttgggttgggcctggtcaggggctagcacctggaaatgccaatcctggttggactgcaccggttgggaatccaggcatgtggggaagtgagcaaagtcataatggagacaggttccccaaccatggggatcgtggtgcacagggtagagattctggttacggtggtaaatcttggaataggcagtcatcatttggcagaggaggttcttccaggcctccttttgggggacaaagagtagtctgcaagtattatgagagtggacgttgcaggaaggggacttcttgtgactttctacacacttag

SEQ ID NO: 45229 - DNA, 1701 bp, Glycine max
  Peptide Sequence Number=SeqID_136914
gatgtgaaggttccgaaagcgactgacagtaaacaacatggttcgcagggagagtccggtcccactacgcctttgccagacaaaaagctcttgctgtttatccttgacaggcttcaaaattggctatttgatgttctgtactgctcacaaccttcttgcagaaaggacacacatggggtgttctctgagccagtggatccagaagagcttcctgattatcttgacatcattaaacacccgatggattttggaactgtcaggaagaaattggatggggggctatatactgacttggaacattttgagaaagacgtgttcttgatatgctctaatgcaatgcaatataattcctcagataccatttaccatcgacaggcccgagccatgcaagagattgcaaggaaagactttgagaatcttagacaagatagtgatgatgatagtgaaccacagcccaaaattgtgcagagaggaaggccaccaggcaagcactcaagaaagtcactgggactgggtatgcctcctcctgagcgtgttggtcctgaatcttcttctgatgcaactctggcttctggcggggatattgctagtggttccaacggttataatctaagaaaagtacccagcaaatttcagcccacagattcatctgcgagggcctacaacagcacttttaacagtggagggtatgttggctggtctgaatgggagaatgaatttccagcttctgttgtaaaagctgtgctaagatatggaaagaagcagtttgtggttgatgaaaccaggcgtgatacttacaaaaatccagtgactttaggaaatgaacgaccggtgttgtccacagttgaagatgaattcaagcaacttcttgcagtaggtgtacacatgaagcatagctatgcaagaagtctagcccattttgctgcagaccttggtcctgttgtttggaagattgctgcaagtaaaatcagcagtgttttgccagcaggacatgattttggtcctggatgggtaagtgaagatgatggttcgtcacagaggcgacacttcccagtttgtgatgagggtagaacttcagaccctcctgtaccagaggattatagaagtagattttcttctccatctggatcgctcccccttgcaaatagaccattctatcaaagtggagacatggctatagataattaccaaaatgagttgaatccagtaatcaacattcctggtgggtctgaatccataactcctatgaggattcagcaggaatccatggtgcactctgatgattttggttcatgtgatcggttaggttctaatttcccatctcaaatgaagatggtaagacttgctgatctaactgggacttcgagtgctggagttgttcctcaaatgtttgacatggatcccataagcaaccgcattgtgcatacaaatgttgattcttcttttaagggtcagcacttaagcaaattaagtcaattagattctggtaatttattgtcacgggaacctggatttgagccacaaagttggcctcaagggcttgctggaaaatcatcttggcagggattggaagttcccactaaacagaattcttttgctcttgctaatgacttaaatggaaggattggaactacaaactcacccagttccaacgtggaggctggttcccagttgcagcctaatttggcattacagctctga

SEQ ID NO: 45230 - DNA, 420 bp, Glycine max
  Peptide Sequence Number=SeqID_136915
atgggcgaggtatctgaaagtaccatgacgaagaggaagaagaagggacgcccctctcttttggatcttcaaaagcgatctctcaaaaaagaacagcaaaatcaccaccagcagcgacacaattcaaccaacgttgttccccacgacgacgacgaggacgagcgcaaggagaagaagcacaagctcttggttggtctcaattcccatctccaccacccaacattattgcccaattcccaacccttcaattccgatcccaagaggcgcaagattattgaccctctccaaacggggaaaattttatgtggggcactgacactgatgggtggtgcttcttctttctttttggtcctaattttaatctttcattattggctgtacgccagatcgagcccttcgtttatgcacggatatgcataa

SEQ ID NO: 45231 - DNA, 222 bp, Glycine max
  Peptide Sequence Number=SeqID_136916
atggatgagtttgggctgaaaagacaaccgcaagtggtggatggtgaaaatggaattaggaggaagttaaagatgtttttagtatttattaaggaatggaatggagggaatatcatagttgtgattgcgggaatgtttggaaatgaagctggtggcaatggagggactaatgatggtatggttgggatggtaggcaagggtagcagtggcacattcccctga

SEQ ID NO: 45232 - DNA, 1431 bp, Glycine max
  Peptide Sequence Number=SeqID_136917
atggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttgaaggtggcaatcaatggtttcggacgcattggtagaaacttccttcgctgctggcacggccgaaaagactcaccccttgaagtcgttgttgtcaacgacagtggtggtgtcaagaatgcttcgcacctgctgaaatatgattctatgctgggaacctttaaggcagatgtgaaaatactagacaatgaaaccatcactgttgatggtaagtccatcaaggttgtttcaagcagggaccctcttaagcttccatgggctgagcttggaattgacattgttattgagggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctctaacattataagcaacgcttcctgcaccacaaactgtcttgctccctttgtgaagatcctggatgcagagtttggaattgtgaagggaaccatgacaaccacgcattcctacactggagaccagaggcttttggatgcttcacaccgtgacttgagaagagccagggctgcagcacttaacattgtcccaaccagcacaggagctgccaaggccgtgtctctagtgttgccacagctgaagggcaagctcaatggaatagcgctccgtgtgcctacacccaatgtttcagttgttgaccttgttgtgaatgttgagaagaagggtcttactgctgaagatgtgaatgcagcattcagaaaggcagctgaggggccgctcaaaggtgtattggacgtgtgtgatgttccacttgtgtctatcgacttccgctgctctgatgtttcctctactattgactcctccttgactatggtcatgggagatgatatggttaaagtggttgcttggtatgacaatgaatggggttacagtattcaattggttgaattgaagctacttgttataatggatcacgctattgatggttactgtgttggggattgcagccaaagagtggtcgatttggcacatctagtagcaagcaagtggccaggggcacctaaagcggggagtggagacccattggaggatttctgcgagacaaaccctgctgatgaggaatgcaaagtttatgaatag

SEQ ID NO: 45233 - DNA, 789 bp, Glycine max
  Peptide Sequence Number=SeqID_136918
atggcgtccatttcgcggttctgttgtgtgcatatgcgagcgtctctatgcaacttcacagcccagaaaggtccttctccttcactaccctccccattaactcatttttcttctacttccaacatccctcgtcgtttttgttcaggtccatcacctcccacaaccttggacttggagcatcataaaacaacaccatgtttgctttcttccatcgaagaaggacgtgcggttaataggagacaacttattcttcacacgccagtagcagtagctgcatttgcagtcccaaatgcattggcactcaatgatgtgtctgaggatgttcgtgtctacactgacgatgagaacaagttcaagattgagattccccaagagtggcaagtgggaacaggagacggagaatctagtgggtttaaatccataactgctttctacccaacagtggcatccaattccaatgtgagcgttgtgatcacagggctgggaccggatttcactaggatggaatcctttggcaaagttgacgagtttgcccagactctagttagtgggcttgacagaagctggcgaaaacccccgggtgtggctgctaaactcatagattgtaaatcatctgatgctatcgggatggcatcaaatggttggtataacagactgtatacggtgacaggacagtatgtggaagaggaaacagacaagtatgcttcaaaagttcagaagaagtacgtaggtcatgatgattccagatatctagtttatgcgacaacgaagcgtaggtcgttgaagtga

SEQ ID NO: 45234 - DNA, 756 bp, Glycine max
  Peptide Sequence Number=SeqID_136919
atgacttctatagcccagtctaacacttctagacttgggtttcctgctctgatcactgcattatgtagagccagaggggctgtctttgacaaccttacttttgagcgccttagcccgttcattaacttggcctacatcaggaagaactgttggaatctcgaggatctaacagtttctatccgaggggctaggagggcgagggcgaggccagctgagcttccttccacttctgcagctcctactccagcattcacttcagtagctccttctatcccagctcagacagattctcaactctttgaagccatgcatcagagcattcatcagggacagatcattttattacagagtatacagatggtgtcacctccaagatctattccttcagttgagcagttcaggaagatggtagcctggcccgggacccaaacttctcttcacagggaagatgaaggtcccacagcccaggtaccgcagcatgtggaggatgagtcatcagaggcaaccttcccagagccatttgtcataggggaggaggtaggtgagacacaggtgagacaggtagccactaatactcttgagagatcccttgaggcgactttcagagactcctgcataagtggtggacctacgctcacctcagcgtatagcagacccctccactcctattttagagataccagaggacccgaccacaccagtcctggctatggacacttctcctctagctactccagtacttcatctgacagatga

SEQ ID NO: 45235 - DNA, 540 bp, Glycine max
  Peptide Sequence Number=SeqID_136920
atgcgggggtaccgcatggttatccgcaccttttgtcaaccaggggcacacgagcccgttgacgcgctgagactaacatcgtcttctgcaccttttgtcatcctgacccatgaaactaacgccctcttctgcgcctttggtcatccagaaatggcaagtccgatgacatgcgggggtaccgcatggttatccgcaccttttgtcaaccaggggcaaacgagcccgttgacgcgggcaaacgaggccgttgacgcgcagagactaacatcgtcttcctcatcttttgtcatccagggacaacaagtcaggtggcaggtggagataccttatggtcattcgcacctttcatcaaccgaggcaaacgaatttgacggtatcaagatgatgttggggcaattgccataccctaatttcatctggggaccattgtttggtggcatgcaacctccgcttgaccgcctcgagtcgaaaagaagcattgttgcgcaatccgtcaagttccgcaacattccggaagtcaaaaagggcattgttgcataa

SEQ ID NO: 45236 - DNA, 255 bp, Glycine max
  Peptide Sequence Number=SeqID_136921
atgggatcgagtcaggcgccttcgcttaaaaataggttctatcaagtcaagatcaagagcgtaggagtcgccagtctgaaaaagttaagacagctgatgggtcagctccagcgacaagcctttcgcaaagcttatggtaagatctgggacctaatcatcgtagaggtttccacagaggccattgcctccctcgcccaatattatgaccaacctttgaggtgcttcacctttgtggacttccagctaacacccacg

SEQ ID NO: 45237 - DNA, 474 bp, Glycine max
  Peptide Sequence Number=SeqID_136922
atgcaagatgatgcaggtcatatctcttctcccatccttgaaggggagcctcctcgacaacccgacgaggtccacgaagatcatcaagagtgtgcccaaagggatgtcgagttctaccccccgattcccattgaggggccgaaacccaacactttgcctcagcccaacctcacagcacaaccaataatcttgtccacagaaggaccacccccggtgaccgaagaaagaaggaaactcgatctcctcgaggagagtttgagggtggttgaaggctttggtgactatccgttcgcggacatgacaggatctttgcttggtaccagatgttgttattcccccaaaattcaaaggtgccggaacttcgacaagtataaagggacgacttgtcccaagaaccatctcaagatgtactgccgcaagatgggcgtgcactctagggatgagaagctattgatacacttcttttcaagatag

SEQ ID NO: 45238 - DNA, 660 bp, Glycine max
  Peptide Sequence Number=SeqID_136923
atggttagaggaactatatgtggagcaattagacataaattgataccgactcctcagaatttgcaacaggaaattctttggcacttaatcgagatattcagggaggaacagactgttccagcccgataccgtcaagaatttcttacgattgcatggggaacaggttcatcttcgaagtattttttcccttccaatattttttctattggagcttctctgattctttttattgaacataatgatgccaatcgagctttaatgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctg

SEQ ID NO: 45239 - DNA, 193 bp, Glycine max
  Peptide Sequence Number=SeqID_136924
ctctagcttctcatctcaaggaggtgagcttagctattagagagcttctcaaggaagttttctcaaagaagcttctcaaggaagttttctcaagtgaaattctgataccaggggacagatgtcgtaccggatgtcacgacatcacgcttcagaacatgcagattatatgtgtccgtatgaacagattaaacaa

SEQ ID NO: 45240 - DNA, 312 bp, Glycine max
  Peptide Sequence Number=SeqID_136925
atgaagaaaatccagacattgactgcggcgctgttggcaagcgtatttctggcctcgccagcgctatcgtccgaattgcgcatcggcctcaatgacgatgccgatgtgctcgaccccgcgcaatcgcgcacctttgtcggccgcatcgtttacaccgccatgtgcgacaagctggttgatatctcgcaggacatgaagatcgtgccgcagcttgccaccgaatgggcctggtccgaaggcggcaaggttctgaccatgaaaatccgtgatggcgtcaagtttcacgacggtgaaacgcttgatgcggcggct

SEQ ID NO: 45241 - DNA, 570 bp, Glycine max
  Peptide Sequence Number=SeqID_136926
atgaccgaccctctcgatgagtcgatctcttgctttctcataagggtgaacccttgggtactagttaccctcaccttcagaggactacacgtcctcgccttcagagggccgcacgccctcgccttcgtagggctacacaccctcaccttcagaggactacacgtcctcgccttcagagggccgcacgccctcgccttcagaggacttcacgtcctcacctttagaggactacacgttctcaccttcagagggccgcacgccctcgccttcagaggacttcacgtcctcacctttagaggaatacacgtcctcaacttcagaggactacacgtcctcgccgtcaaagggtcatgtaccttcacctttgtagggcgacatgtcctcaccttcagaggactgcatgtcctcaccttcgtagggctacacgccctcgccatcagaggactacatgtcctcaccttcagagggctacacgccctcgccatcagaggactgcatgtcctcaccttcagaggaccacacgtcctcaccttcagagggctacacgccctcgccatcagaggactacat

SEQ ID NO: 45242 - DNA, 171 bp, Glycine max
  Peptide Sequence Number=SeqID_136927
atggggtatttcatcagcagactctccttccctgaaaacaccgagactttttcaagtctcgcaagttatcaagaactacgtaggtctgagttcctcattgggggatacgtaggagcaaaagcctcgcttttgtcgaccacaccgctttctgttaccatgacccaagagctg

SEQ ID NO: 45243 - DNA, 375 bp, Glycine max
  Peptide Sequence Number=SeqID_136928
atggtcattctatgccctttgtcatttaggagcaacaagttgagtgataaacgtgcagagacaaattatggtcattctgcgccctttgtcattcagggacggttccgctggcagggagattcactgtccgaatggtgtttcgctcgaacgaaattagtgtcttatctttacttcccttttatctccaataaaagacaagtaaagaggggcaactgtcataccctaatttcattcggggaccatccgttgttgggatgcgaccctcatttgaccactttgaggtacatggcacccatcgttaggcgattcatgaagctccgtgacatgccggaagtcaaaagaaagcattgttgcacaatccgtaaagttccgtaa

SEQ ID NO: 45244 - DNA, 565 bp, Glycine max
  Peptide Sequence Number=SeqID_136929
agtttatgaggggtcgacaaccatccacaacatccctttgggcaatgatcaagtaagggtcgatgttgaggaagttcgagatgctgatgctcgcatccctgtatccactcaagaggttcaattagtaggacggacccttaacaccttccttgcttgggcgacacatcttgtacaacctttttcagaacaaagacctgagggatcggcgaaacctatagataggtcggaacctaatgacgatcccctataccagatgacattgacgattccacagcttttcctcaagtctatgcagagatttgggcaatcacaaattgaatctaaggattatattaagaaatggatgcagaattcacaaagagatgtctacttaggagcctacttgaatggtgctttgaagggattcaacgatattcaaggaagtaaatccaaggctactgctaaatggattccaattaaatattttaatgatccaagaccaatgaaaccaaagagaataaagacaattcacattcagtggacaagatgttgtctcagaattaaaaatgaaacactaggtgtttaa

SEQ ID NO: 45245 - DNA, 132 bp, Glycine max
  Peptide Sequence Number=SeqID_136930
gtttccttgatcaagaacaaaaataaagggaattggaaaggaggattggtgcaatatcttgaagaatttgagtcaagaagcaaggggccaaccaccttaagagctattggactaagaagcgctgcaaattga

SEQ ID NO: 45246 - DNA, 129 bp, Glycine max
  Peptide Sequence Number=SeqID_136931
atgatgacaatgatagtaaacacattaccagtattctactatgaaaagatggtgggctacacaccttcaagctttgcggatttggtcttcgccgggatttacaagtttatgccacagttacaacgctaa

SEQ ID NO: 45247 - DNA, 261 bp, Glycine max
  Peptide Sequence Number=SeqID_136932
atgggacaccttagtgatcaaggggttcccacggaccctaagagaataaaggtcattcctgaatggcctactccaccaagtgttgagggaaggaatccagagtatgaagaacctcgggatttgaggtcaaatcctctccaaggtggaggggatgatgcaatcctacccccaagggtattggatagaagactccaagaggattgggctagatctactaaagaaggacctacggttctcatgaaccttagggtagatttttga

SEQ ID NO: 45248 - DNA, 225 bp, Glycine max
  Peptide Sequence Number=SeqID_136933
atgtgggagaccagctgtcgcagcctacccttcgacgcgagggctcacgggtgcgtcctccatgggaggaagatgcgcggagtcgccaccaacgtttattcgaggaaaacgtcagaaaaactagaaaggtgtggtctacgaactttaagtgtgaaaggttcgggatttgtatttacgcatggggaaggtattagcaccccaagcgtccgtcacaaaggacgatag

SEQ ID NO: 45249 - DNA, 258 bp, Glycine max
  Peptide Sequence Number=SeqID_136934
atgcccgaagtataccgtcttgcaaaattggaggcagaggaagatgaatcgagtcacatcactcttttacaccaagaggaaccatgggattggatcggtttgctccttaccttgaacgggagtcaagaacttccccgattgctagccaaggccaaagcagtggcggacacctattccgcccccgaggagatccacggacttctcagctattgtcagcatatgatagacttaatggaccatatgattagaaaccgctag

SEQ ID NO: 45250 - DNA, 303 bp, Glycine max
  Peptide Sequence Number=SeqID_136935
atgatgataacaagagatgatgacaaaggtgatgacaaaaagctcaaaggtcaatcaaagaatgagttcaagatattcaagatagaatcaagaacacttcaagattcaagaggaaagttgatttcaagaatcaagaatcaagattcaacagatcaagatttcaagaatcaagattcaacagattacgatttcaagaatcaagaatcaagagatcaagattcaagactcaagattcaaaaatcaagagaagccttactcaagataagtatgaaaaggttttctcaaaaattgagtaacacatga

SEQ ID NO: 45251 - DNA, 279 bp, Glycine max
  Peptide Sequence Number=SeqID_136936
atggcttccatgatggaggccatgttaggaatgaggcaactcagttcggctgccaaagcagatccgactctcctagccactgcgcaccatcctcccccaaatacgctaggacgaggaaggaacacactggggcacaaaaacaacccccatttgggatacaaccgagcggcttacccttatggattgccacctaattactcgccaccagtcatgcaagatgatgcgggtcatatctcttctcccatccttgaaggggagcctcctcaacagcccgaagag

SEQ ID NO: 45252 - DNA, 123 bp, Glycine max
  Peptide Sequence Number=SeqID_136937
atggggaccaccacgggagcttgccacccagctcacccaggcgagcaaggttgcttcctccagaagcaacaaccttctggaggaagaatctggaaggcccaagtgggcctgattgctatttga

SEQ ID NO: 45253 - DNA, 411 bp, Glycine max
  Peptide Sequence Number=SeqID_136938
atgaggggcaccgtgcatgagcctcaagtgaacataggggccgatcaaaaaggaactacactcctcgccaacagagggttgcacgccctcaccttaagaggactgtgtgtcctcactttcagaggactgcatgtcctcaccttcagagggctacacgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacacgtcctcgccaacagagggctgcacgccctcaccttgagaggactacacgtcctcgccaacgtaggggctacacgccctcacctttag

SEQ ID NO: 45254 - DNA, 954 bp, Glycine max
  Peptide Sequence Number=SeqID_136939
cgccagtcgattctgaaatccatcgacgaacagggcaaactcacgcctgaactcgccaccgccatcaacagcacgctgaacaaaaccgagctggaagacctttacctgccgtacaaacagaagcgtcgcacgcgcggacagatcgctattgaagccggtctggaaccgctggccgatacgctgtggcaggacccatcgcaggatcccgagcagctggccgccagctacgttgatgccgacaaaggtgtcgccgacgtgcgcgctgcgctggatggcgcgcgctacatcctgatggagcgctttgccgaagacgcgacgctgctggcgaaagtgcgtgaatatctgtggaagaacgcgcatgtggtttcgcgcgtggtggaaggtaaagaggaagaaggcgcaaaattccgcgactacttcgatcaccacgaagcgctgagcggcgtaccgtcgcaccgtgcgctggcgatgttccgcggccgcaatgaaggcgtgctgcagctgtcgctgaatgccgatccgcagttcgatgaagccccgcgtgaaagctatggcgaaacgctgatcgccgaacacctcaagctgcgcctgaataacgcgccagcggatagctggcgtaaagcggtggtgagctggacctggcgcatcaaagtgctgctgcacctcgaaactgaattgatgggcacccttcgtgaacgcgccgaagatgaagccatcaacgtatttgcccgtaacctgcacgatctgctgatggccgcgcctgcgggcatgcgcgccaccatgggcctcgatccaggcttacgtaccggcgtgaaagttgcggtggtagatgccaccggcaagctggtcgccactgataccatttatccgcacaccggccaggcggcgaaagcggccacggctgtggcggcgctgtgcgccaaacatcaggttgaactggtggcgattggaacg

SEQ ID NO: 45255 - DNA, 252 bp, Glycine max
  Peptide Sequence Number=SeqID_136940
atgcgtcaagctaatgatgttaaagaagcgcttcctgggaggcaacccagttttaatttctgttatctttgtttgtcatgcattatatcatatggaacttgctttacagtctgtacagtggatcctttcgctaagcgcaagcttcgcgctaagcgcatctttagtcatgcgctaagccgagagtctcaagcgcttagcggccaacctttgcatctgaggctgatttggtccgctaagcaaagccaaggctga

SEQ ID NO: 45256 - DNA, 179 bp, Glycine max
  Peptide Sequence Number=SeqID_136941
atgctgacatctccggaaagggcgcagacgaccacattggcctctgcttgtcaatcatacttggggtctctgaatgacaaggtgcagataaccgtaaggtgtctccgcgggctacccgattcttgggtcatggtaacaaaaagcggtgtggtagacaaaagcgaggctcttgctcctac

SEQ ID NO: 45257 - DNA, 93 bp, Glycine max
  Peptide Sequence Number=SeqID_136942
atgaacgaaaaacgcaattcatgggtgtcataccctaatttcgtccggggacctttgctcgatgatgtgcgaccattctttggtcctcgtgag

SEQ ID NO: 45258 - DNA, 273 bp, Glycine max
  Peptide Sequence Number=SeqID_136943
atggtagccataaccctagctgaggttcatcaacctccatttctccaagaatacgactcgaacgcaacgtgtgcttgtcacggagaagcctcggggcgttccattgagcattgtagggctctgaagcgtaaggtgcaaggattttcaactttcaccagaagtgggtgcaagccattggtctgtttgctcaagcgacctgtgctcctgagtttggacttccaagaccgttcaatcagagattattcgtcttgcatattggtggggctgccgtaa

SEQ ID NO: 45259 - DNA, 153 bp, Glycine max
  Peptide Sequence Number=SeqID_136944
atgccttccaaggttattttgatgatggcaaagaatcaagagttaagcaaattccaaagattcaagaatcaagattcaagattcaagattcaagaatcaagtttcattcaagaatcaagtttcaagaatcaagattcaagaatcaagaatcaa

SEQ ID NO: 45260 - DNA, 237 bp, Glycine max
  Peptide Sequence Number=SeqID_136945
atggctggtacattcttccttttgaaacagcaaaatagtttagagattatgagcgggacgccacaattggtggtatcagagcaaaagttggattctagtgaacctgttatggtcttgctgtgtgaatgctgtgtatctctgaaacttggaagtaggtttcggggagtgacgttaagtcacacattgtgtgtatttctgccttcttgtcttgagcatggatgtgtgactgattcatag

SEQ ID NO: 45261 - DNA, 180 bp, Glycine max
  Peptide Sequence Number=SeqID_136946
atggggacaaatcaaaatggcaaaaggttttatcaagtcaaggttaaaagtctagatgtcactagcctcaaggaattgggacgattgatgggacctatccaaaggcaagccttccgcaaagtgtacgggaagattctagatttgaccgcagcggaggaattaatgaaacattgggcttaa

SEQ ID NO: 45262 - DNA, 342 bp, Glycine max
  Peptide Sequence Number=SeqID_136947
atgtctcctcaacctctagaaacctcacaatctctcaaaatctcatccaaagctctgcaagatggcttcctcgtcatgcttagctctctctcagtctcaacacaaccaaaaactctcaaaaaactcaacaacctccccaaaattgagatttcagctttaaataggcaatccttcttctcgcttagcgtaagggttaaaggcggtgcacttagtgagttgacactcgctcaacacctctgtatagctcatccttcttgtagattcttttgcgtgcttaatcagaggatagtgcgcttagtggatggctcacccagtgcgtggcatggctcagcgagttcatga

SEQ ID NO: 45263 - DNA, 382 bp, Glycine max
  Peptide Sequence Number=SeqID_136948
atgactagaggcaatccatatgacttacaaccctttgatcctgagatagataggacatttcatagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctacgaaagcttgtgcatccaataccctgatgaggatgtcccatatgttcttaagactagactgattcatttacttccaaagtttcatggccttgcag

SEQ ID NO: 45264 - DNA, 441 bp, Glycine max
  Peptide Sequence Number=SeqID_136949
atggtggcgcgcgttatgctcaggaacggatttgagcccggaaggggtctaggcaaggactgcctcgggaatgccgacgtggttgatatcaagggaaatccatacaagtatggattagggtatgaacccgggatgccggggaagaggaacgtgccgtcaagatttcgggcagatagggaggaggtggcagcaatagaagaggagttccctcaagacccaccaagttttgtgcaaccatgccaccctgattcccaagaagaggaagaggacgtcctgtcaccagagttggagaggttggtcgctcaggaagaacgtgaaatgaagcctcaccaagaagaaaccgaattggtaaacttggggaccacggtggaaaagaaagaagtgaaggtaggaaccggtatgacccgcgcctatccaccaaggcttgataacccttcttga

SEQ ID NO: 45265 - DNA, 576 bp, Glycine max
  Peptide Sequence Number=SeqID_136950
atggacccttgggtactagttaccctcaccgtcagaggactacacgtcctcgccttgagaggactacacgtcctcaccaccagagggctgcacgccctcacctccagaggactatacggctacacgccctcacctgggttactagttaccctcaccgtcaaaggactacacatcctcgccttgagaggactacacgtcctcaccaccagagggctgcacgccctcacctccagaggactatacgtcctctccttgagagggctacacgccctcaccttgggtactagttaccttcaccttcagaggactacacgtcctcgccttcaaagggtcatgtaccttcaacttcagaggactacacgtcctcgccgtcaggcagacgcagggcgaaacaccacagcaacattgggatggccggtagcgggcaatagacacaccgccaccacctctaaagttcacctcagctcatccataaaaaggttagagtgttgcctacgacacatggccgaccagcaggctaccaaatccaaagccaaaggtaagcaaagtattaggtccgtgaccgacaagtcataa

SEQ ID NO: 45266 - DNA, 219 bp, Glycine max
  Peptide Sequence Number=SeqID_136951
atggccataatgatggaggccatgatgagcgtgaagaagatattggaagccaatgcggttgcaattgccgctaccagcgttgttgctaaggtgaacccgacgtcccatccgggcatcaaccaaatgaatcatccaactcagatatgggcaaaggtgttcctcttcgggcatctcaatttcatcccaattccacacctcctttccatgcatagcggttaa

SEQ ID NO: 45267 - DNA, 327 bp, Glycine max
  Peptide Sequence Number=SeqID_136952
atgagaggccctctcaaagagtcaacctcttgctttcttgtaaggttaaagtcctttggtacttgtacctattggctcgccttcagaggactgcatctcctcaccttcagaggggtacacgccctcgccatcagaggactgcatgtcctcaccttcagagggctacacgccctcgccatcagaggactacacgtcctcacccttcatagggctacacgccctcgccttcagaggactagcatgtcctcaccttcagagggctacacgtccctcacctttagaggaccacacgtcaacttcagagggttggacgcccctcgcctttag

SEQ ID NO: 45268 - DNA, 510 bp, Glycine max
  Peptide Sequence Number=SeqID_136953
atggctacattggctgaagttgcggagacattacaatacatgatgtctcctcaagggaggaatacatggacagttgatgatctcgtgccttatgtagagaaaattacaattttatccgaagagcaggagagaatcattgagcctgtgtcacatggtcctgcatcagagcgtcaatttccagcacaagagtttcacattcttcagtcaagtgttgaaactcagggcataggcagacgcagggaggttgttgaagcggaagaatgttcccaacaaatggcggagcgtggccatggaatgcattacacgccacaaacatttgctcagtatccgacacagatgtatcagtatccttttcaaggtcatcacactgatacttctgcaagtcagcattcgttcggtggtgttgtggaaacacaacctcatttttcatggcccactatgaccccttcacagcaatatcatgacccaaatccaacacctaatgccccattaggaagtgggatcctctag

SEQ ID NO: 45269 - DNA, 402 bp, Glycine max
  Peptide Sequence Number=SeqID_136954
atgtgggctttccttactggtcgtcagatcaactgggctcacttggttcggtaccgaatgcataaggcattacgggccaatgcacctctcccttaccctcaattggtcactctctttctccgtcattttcaaattcctctcgatgatgaaccttttgttcaaaaagatgcacttcctccacaagatgagtgcactccttctcctcctcctcagcgagatgattcagcccttatgactgaagttctttcagagttacggggtcttcgctcttatgttggtgaacattttgattcattggataatcgctttgcaggaatgaatatccgtctcacacagcttgaagaagatgtgggatatattcgtcagagcttcattcttccaccaccaccaccaccttcttag

SEQ ID NO: 45270 - DNA, 86 bp, Glycine max
  Peptide Sequence Number=SeqID_136955
gctacaagagtactcttgatagactcacttatgtgaatgttgaagtgggggccacttcatatgaaattttgggcaaaaatttctag

SEQ ID NO: 45271 - DNA, 429 bp, Glycine max
  Peptide Sequence Number=SeqID_136956
atgtcagccaacgatcatgccattctacaagacagaacccaccaacccacgaagaaaagcatgatagagttatcatcacatgacgctttattggcacaaaacaagttgctttcaaagaaacttgagattttaacagaaacacttggtaaggtgccaactaagttgtctatgggtcaacctacacactcttctattttgcaggttacaggttgtaccatctgtggtgaggctcatcgacaagggtatactcaaggaggattttcaggcttccagcagggttcatataatcaacaaggacagtggaggacacaccctgacaatcagttcaacaaagaccagagtgggccttcaaacaagccaatccaacaaggacctaacatattccaaagaactactaagctggaggagaccttgactcagtttatgcag

SEQ ID NO: 45272 - DNA, 982 bp, Glycine max
  Peptide Sequence Number=SeqID_136957
atggagatggataagaagatccgcagtattgtgagtagaattttgaaagatgcctctgtccctgatgctgataaagatgttccaacatctggcaccccaaatgtttctgtgcctgatgctgataaagatgttccaacatcttccgctccaaatgctgaagccctctcttcacccagtgaagaggaatcaacagaagaagaggatcaagcctcagaggagacccctgcaccacgggcaccaaaacctgctccaggtgacctcattgaccttgaagaagtagaatctgatgaggaacccattgccaacaggttggcacctggcattgcagaaaggttacaaagcagaaaagggaaaacccccattaagaggtctggacgaatcaaaactatggcccagaagaagagcactccaatcactcctaccaaatccagaaggagcaaagtggcaatcccctccaagaagaggaaagaaatttcctcatctgattctgatgatgatgtcgaactagatgtctcgacatcaaagaggactaagaaatctgggagaaaggtgcctggaaatgttcctgatgcaccattggacaacatctctttccactccattggcaatgttgaaaaacttgcggttgaaagagaactgggaagagatgccttggattgcaaggagaccatggacctcatcaaggcagcaggactgctgaagactgtcaccaagttgggagattgctatgaaaagtctagaaaatgtgttagattctcccctgctgtgatcaacaaatacctgggcagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcacaggattggagctgcaaactgggtacccactaatcatacatccactgttgccacag

SEQ ID NO: 45273 - DNA, 330 bp, Glycine max
  Peptide Sequence Number=SeqID_136958
atgagggacgacaagaggtttttgtatgtcattgggatcagggtgaattctggagttggccttgggggaaagttcctcgtcgcgttggaaccggcgccaaagtgggcgttgccgcccgggcgagtcgtggttggagctggagcttggagggcctccctctggatgggtgcgggcgctctaggctatacgggtgctgaattggaagagtccccggcgcgagctgagaagctcggttgctccgatcctcctagcattggaacttatgaaggagacctaatcgaacttccctctcttcaaacctacttcgattctctcccccggcaataccaa

SEQ ID NO: 45274 - DNA, 543 bp, Glycine max
  Peptide Sequence Number=SeqID_136959
atgggggtgcaaatagcaatcaggaccgcttgggccctccagaagattcctccagaaggctgttgcttctggaggaagctaccccgctcgcctgggcgagctggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccccgtcagtagctgaacaggagggacagctgatagaaacagaagccactggagcacctcaaaaacaccatcatacactaaatcagtaa

SEQ ID NO: 45275 - DNA, 535 bp, Glycine max
  Peptide Sequence Number=SeqID_136960
gaagacattactgcctaagaggaaggtagaaatataccatattgagctggacgagtttaaggataaattggagaggcgtaacctccataaacgcctcaccaatttagttgacagcaacatagatctagctttggtgaaggagttttataccaacctttacaacttcaaaggaccttcaccaaagcaagtcagggtcagaggccacgtggtgaagattgatgcagacagcctcaaaacctttctggaaacacttgtggtactagctgagggtgaaaccttactcgcatattccagatactgtaggttgcccactaatatcagagaaattgaggtttccttatgtatcccaagtcaggggtttgttttgaatgttgaaggccaccctgggaagattctcaggaaagatttaacaactcttgctcaggtgtggagtgttctctcgtactccaacctggctcctacttcccatacctcggacctgacagtagatcgagctaggttgatttttggcctagtctctcaaatggacacatga

SEQ ID NO: 45276 - DNA, 612 bp, Glycine max
  Peptide Sequence Number=SeqID_136961
agggttacacgtcctagccttcatagggctatacgccttcaccttcagaggactatacgtcctcgccttcagagggctacacgacctcgctttcagaggactatacctcctcatcttcagaggactacacgttctcaccttcagaggactacagggctacacgtcctcgcctttagacagctacacgccctcgccttcagaggactccacgtccttgctttcagaggactgcatgtccttcccttaaaatgtctacacaccattgccttcagaggattgtacgtcctcctcttcagaggcctacacgcccccgccttcagcgggcttcacatccaccccgttacaggacaactcgtcctcgaaatcagaagactacacgtgcttagagttaaagagctgcacgccctcaccttcagaggagtacacatcctcaccttcataggactacacgtcctctccttcagagggctacacgccctccccttgaaagggctacacgccctcgcgtcagaggactacatgtcctcccctttagaggactacaggggatcctctagagtcgacctgcaggcatgcaagcttggcactggccgtcgttttacaacgtcgtga

SEQ ID NO: 45277 - DNA, 447 bp, Glycine max
  Peptide Sequence Number=SeqID_136962
gccctgggatttcccgctttgatcacaggactctaccagtcgttcggagtcccgtcgcacctagcaaaggtgatccggccacccatcacccaagcttttattgagaagtattgcacgcagagacaggccaagggggatgctccgcaggccgcagatgcgcagtatttgcggcatttggttcgccaacaggcggccaaccaccgagcgcatgtacagacccatgattgtctttaccagttgagcctcagcctacagagccagggttttacttcttttccgtgccctactccggatcagttcagggcagaggtcgcatggcccagagattggcctgaggctcgggcaggagaggcaccagtagaggctcccgacgaggcagatgaggctcgcgaggacgaggagatgaccgatttacttgatttcttaggagggagcggagccacatga

SEQ ID NO: 45278 - DNA, 357 bp, Glycine max
  Peptide Sequence Number=SeqID_136963
atgggtgaagtagaggaggtgcaagagcagatgaaggccgacatggaggccatgaaagagcaaatggccacaatgatggaggccatgatgagaatgaagaagataatggaagccaatgtggttgcagttgccgctaccagcgctgttgctaagcaaagatccacaagggatgtaccctctcttgttctctttgaaaaccctagtggatgtacccttccactagaactaatccacaagaagatgtacccctctcttgttctcagtcaaaccccaagtagatgtaccctctacttgttccacaaaggatgtgccctccaatgtgttaagacaaagatctcaggatgtttaaacctttga

SEQ ID NO: 45279 - DNA, 132 bp, Glycine max
  Peptide Sequence Number=SeqID_136964
tggcgtctcctctctctcttccttctccattccgctgccatttatcttccaagaagcaaaggaatccattgatgaagaagatcctaggcctacaagctccaatggagcttgcatcaagttctttcaaaaggg

SEQ ID NO: 45280 - DNA, 750 bp, Glycine max
  Peptide Sequence Number=SeqID_136965
atggcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttacagagggagtggcaaaggactggttgtattaccttgctccaaggtccatcacgagctgggatgaccttaagagagtattcttagaaaaaaattttcctgcttccaggaccacagccatcaggaaggatatctcaggagtgcatgaggtagctacaaacccatctacatcatctgaaactaagaagcttgaaggaaaactggatgcgttggtcaacttggtaatccagctggccttgaatcagaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagagcaattatgacctttccagcaacagatacaaccctagatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaaca

SEQ ID NO: 45281 - DNA, 585 bp, Glycine max
  Peptide Sequence Number=SeqID_136966
atgggtgaccaagaggaagtacaggaacagatgaaagccgacatgtcggctttgaaagaacaaatggcttccatgatggatgtcatgctaggaatgagacaactaatggagaataacgcggccaccgccgtcgctgttagtttggctgccgaagcagacccatctctcccagctaccacgcaccaccctatcccaaacgtggtaggacgagaaagaagcacactggggcacatcaacaaccccgatctggggtacaaccgagtggcttacccctatggattactacctgattacacaccgccagtcatgcatgacgatgcgggtcatgtccctcccctcatccttgaaggggagccttctcgacagatggacgaggtccacgaggatcgtcgagagcatgctcaaggaaacatcgattcctactccccgttccccgccgagggtccggcacccaacgcactacctcaacccaacctcatgggtgaacctcgaaaccacccaacacagccaatatttttgtccgcaggagggccaacccggcaacagaagaaaagaggaaactcgatctcatcgaggagacattga

SEQ ID NO: 45282 - DNA, 504 bp, Glycine max
  Peptide Sequence Number=SeqID_136967
gtctagaaaggacgccgcagcggaagggtccagtgccacccccgagtttgatagtcaccattttccggagcgccgcgcaccaacagcgcttcgagggccatcaaaggatggtcgttccacagagagaggcgtgtccaactcagggaggatgagtatacggacttgcaggaggagatggactcgcagcattggacgtcgctggggtcagtggattccctttgacgcagatgccctcaaccagttcctgggtgaccctctagatttggaggaaggtcaacagtgtgagttcagccagagaaggaacagagccgatgggttcgatgaagagccattgccccagctattgtgcacactggtgcaggatttcgcccggactgccgcagggaggcgggtgcggatcatgcgtactagcatgaccactttgacccagacatggatgacactgctgctcagcaatgtcttacctagcgatcacaactccgatctccctctacctaagtgcca

SEQ ID NO: 45283 - DNA, 246 bp, Glycine max
  Peptide Sequence Number=SeqID_136968
atgaggaagatgttgctggttgaggtccttgacactgctttcctgacctcaatgactcgaccatctaaggttgggatgattcctccacccagggttgtggctgattttgctgctgaggttgaggagatctattgtagatgtttgcagcataagcttcaggctgttcaattgcttcagattgttgcacagaagggcaaaggtctgtgtggtggtcggcagaggagcataaaccacagagtttggtga

SEQ ID NO: 45284 - DNA, 243 bp, Glycine max
  Peptide Sequence Number=SeqID_136969
atggtaatcgattaccagaggctaatttccatataccacccaagatacatagctggccagccgccacacaagcctccttgcttcgtggactttgttcttttattggttgactgcctggagctcgcctgtttagggcacccgtcatatgtggtactaggtggcgatcaggcgatggcgcaaatcaactctcccattttccacaagtcaggcacaagcataccatccccagttgcctacctttaa

SEQ ID NO: 45285 - DNA, 174 bp, Glycine max
  Peptide Sequence Number=SeqID_136970
atgacgggagatgcatcaaaattcacacatatctctcccaagaaaaacagacatgtgacttatggcgacaacaataaaggtagaattcttggagttggaaaaataggtacaaactcatcttcctccattgagaatgttctacctgttgaaggtctaaagcacagtttgttaagt

SEQ ID NO: 45286 - DNA, 183 bp, Glycine max
  Peptide Sequence Number=SeqID_136971
atggcttctaaaactgtaaatcgagttgactctgttgatgatattgagtttatggaagatgaggaagaagccagggttgaacctaaaccaaatgcaaaggagaacaaaagtgacaatgatgaaaaagagagtaaaaaagttaaggaacacattggtgtctggtttgctgaaacttcatggtga

SEQ ID NO: 45287 - DNA, 327 bp, Glycine max
  Peptide Sequence Number=SeqID_136972
atggctaccatttcattattgagtagatatgggaggtggtgtttagcctcagatgtgcaacaggcgacttttgtggttgatttaggggtggactttgtgcatgattgggtgttcttggctagtagggtgccatgtaggaacgacagtaacaacatgggtttctccctccttcttgatgcaagctccattggagcttgtaggcctaggatcttgtcatcaatggattcctttgcttcttggaagataaatggcagcggaatggagaaggaagagagaaaagagatgccacttcaaggagaagatgagtctagaagagggagagaatga

SEQ ID NO: 45288 - DNA, 471 bp, Glycine max
  Peptide Sequence Number=SeqID_136973
atggacatgttatgttttgagtgcattggacaacacaaaatagaaataccacaagaactacctattcatcttcttgatcagcttcgcaaaactgtccttcatgacccttacaaaaaacaccaagcaaggatcaaactaaagaaaagctactcgcacaggctcggagatgtgtctttctcttctagctggttttatgctgaactgaggcttcctgagatgatagtcgatgagacaacagctgccacatttctcaacttggtagcatatgagatgtgtccagattttagaaacaactatgagatatgttctttcgtggactttatggactcgcttattgaccatcctggggatgtgaaggagctgagatcagcaaagattctccttaatgcccttatgagtaaggaggtggcaaagatcttcaatttcgtaagcacttatttggtgtccaacatgaaagggtattcattgtaa

SEQ ID NO: 45289 - DNA, 318 bp, Glycine max
  Peptide Sequence Number=SeqID_136974
atgggtaatcttgtttttgaaatcgtccgccctgcaccctccccgaggagtatatgcttcaacaaaaatcacacaggggtagatttgatacaatcaaaacctctggaattggcgacttacccattcaatgactttggcaccggacgttcccaaactggaatgtgtattatcgatataggggatctttcaattgagaagatccatcgacctgagacgaagagaaagaaaggaagatctgtttgggaagtaagaagttcccttgacatctcttcatctgtaaagaattgtcgatgtgaaaacacagagacaaaaggctga

SEQ ID NO: 45290 - DNA, 159 bp, Glycine max
  Peptide Sequence Number=SeqID_136975
atgggtgccaagtacctcgaagtggtcaaacgagggtcgcatcccaacaacggatggtccccagacgaaattagggtcgacaaaagacgggctcttgctcctacgtatcctccatcgaagaggaaatcagacctacgcagttcttccaaaaggcagtga

SEQ ID NO: 45291 - DNA, 1201 bp, Glycine max
  Peptide Sequence Number=SeqID_136976
atgggaacaaatcaaaccggcaagaggttctaccaagtcaaggtcaaaagcccagataccaccagcatcaaggaattagggcggttgatggaacccctccaaatgcaagccttccgcaagacttacggaaagatcttagagttgaccatagcagaagtgtccatagaagccattgcatcactcacccaatactacgaccagcctttgaggtgcttcacattcggagacttccaattagtaccaaccattgaagaatttgaagaaattctaggatgtcctctcgggggaagaaaaccatatctttcctccggatggctcccctccttgagcagaattgcaactgtggtcaaggattccgcaagaggtttggaccgcataaaacagactcggaacggcatagcgggcctaccacagaagtacctagaagacaaagcgaggggtatggccaatcagggagaatgggtcccgtttatggatgtgttagctttgctaatttttggggtcgtcctctttccaaacgtggatggtttggtaggcctagcagcaatcgacgctttccttgcctaccaccatagcaaggaaagtccggtggaggtagaacaatcagttggttccccccgatggaaggaaggaaaaggaggagtccttttctcatgtggaagatacccgaacattccgctggtaggaacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcgttcgtaatggcatcattggtgggtaccacgaatggctgaaagttcgcatacgaggtttagattggctcgccaagttaaaagtcgtcagcgaagagaattttgaagcaccggaagaggacgaagaagtccaagctctcaaaagcgagttaggaaaggcaaaactcgccaaggagaagttcaagttggttgctacacacgttcggaaggagtgtgccgggttacgggaagagaatgcaattaccgcaagagcccttgaacaagagaccaagagggctcgcaaggaagagtatggccggaacaaatttcgcggagctctatggg

SEQ ID NO: 45292 - DNA, 81 bp, Glycine max
  Peptide Sequence Number=SeqID_136977
atgggtaagagcttgaaggtaggagaagatgagtggaggaagagggagagaaggaacacgaaattttgtacctcaaatgag

SEQ ID NO: 45293 - DNA, 246 bp, Glycine max
  Peptide Sequence Number=SeqID_136978
atgtcatctattgtttgcggggattgtgcccgcaagacacctagtggacccgaagaaggccaacagggtcttggagttgccagctctaaatacgggtctctgtcagttctagggagtgcctgtcgcccccagcaaggtcatcaggcccccctactaatcgagctttcatcaagaagtactgcgcccccaggcaggcccagggcaaaacaccacagcaacattgggatggccggtagcaggcaatag

SEQ ID NO: 45294 - DNA, 594 bp, Glycine max
  Peptide Sequence Number=SeqID_136979
atgagtcatcattcatctagtgttaatggcaagggtactagtcacaaggaccctctatctagaatcctagatgagttgagttccctcaagttatggaaagaaaaactagaaagaaaagaaaaaggaaaagagatgacctcactccatacgagaagaaaaggaaaagaaagcctcaaggaggctaacattaacctcccatacttccatgggaaggacaatgtagaggctaacttagattgggaaataagggtagagcaacaacttaaaaggaagtctacttcaaaatcttatggctctcactcttatccaaagaaagaccaaggtcaaggcatctttggggggaagacaatcgaaaagcaaccccttaaggctagtatgcaagagaagactagctccatgaagtgctttaaatgtcttggaagaggacacattacttcccaatgcccctccaagaaaaccataattatgaggggccaagacatttatagtagccaagatgaggctactacttcaccttcctctagtaaaaggaagaagcaaaaggggaagaatctagtgaagagatctccccccaagaggaaggacatcctttaa

SEQ ID NO: 45295 - DNA, 183 bp, Glycine max
  Peptide Sequence Number=SeqID_136980
atgagaatcctgaaactggccaaatacagtctaaaggcccaagtggagaaggataaagcccccgagtggagaaggatgaaggcccaagtggagaaggatgaaggccctgaggcagagacactatcaagactattaattgttgctgaaggcccagatgaatttgaaggcccaaatacactataa

SEQ ID NO: 45296 - DNA, 483 bp, Glycine max
  Peptide Sequence Number=SeqID_136981
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggcccccccccccccccccaaaaaagtttgttgccaggattttgccaactttggcttgcgccccgttggctaagtctgtgcctcggtggtggatcatcatgtcataacatggcaagacacaaggcacaagggggaggaggggcttggtcgtccgtccgcccgggcacacacctagttagcaccaggcaggcaaaacgagagagagccgacgaacgggtttgttgtgatttggaggggagggacgaatcaaagcgacaagggctgaatctcagtggatcgtggcagcaaggtcactctgccacttacaataccccgtcgcgtatttaa

SEQ ID NO: 45297 - DNA, 354 bp, Glycine max
  Peptide Sequence Number=SeqID_136982
atggagaatttcactaaacaatctctccgcatagctccaaactcgaaggtgggggacacatggccgaaaacccaattcatggggctccgaaaaaggttgagaatggagaattgcactaagcaatcacctacgcatggcaccaaactcgaaggtggaggacacatgaacgaaaacgcaattcatggggctccgaaaaaggttgagaatggagaattgcacaaagcaatcactacgcatggctccaaactcgaaggtggaggacgcatgaacaaaaacgcaattcatggggctccaaaaagtttgagaatggagaactgcactaagcaatcactacccatggatccaaacttgaag

SEQ ID NO: 45298 - DNA, 300 bp, Glycine max
  Peptide Sequence Number=SeqID_136983
atggttatgggagatttcatcagcggactctccttccccggatacgtaggagcaagagcctcgcttttgtcgaccacaccgccttttgatgccataactcaagagctggtagcccgcggagacaccttacggttatccgcacctcgtcattcagtgaccccaagtgtgattgatgagcagaggccaatgtggtcatctggccttttccggagatgtcagcattttccgatggagacttttcaagtctcacaagttatcaagaactacgtaggtctgaattcctcattggaggatacgtag

SEQ ID NO: 45299 - DNA, 633 bp, Glycine max
  Peptide Sequence Number=SeqID_136984
atgctggatgaaaacaatgttcatgcaaaaagttttaggatggcaagggatagattatcagacactcaagtgcatagtgtcggactcaaattgattgttggtcgagaaaaagatggtcgtacacccaatgaaggtcaaactctattgcattctagaaaactattccagcaatttgttgctgaaggatacacaatgattgaatccgaaagactctcctatgttagaaacaaccaaaagaaactcagagttgataatttctgtagcttgcagcaatcatccgaagctggaaatatagaaggtttaggccaaggcaagaggattatcttaccttcaacctttgttggcagcccacgttacatggatcaactttattttgatggcatagctatatgcagccacgtaggcttcccaaatctttttattacttttacctgcaatccaaattggcctgaaattcataggctcctgacacctttgaatttgacatcaatagataagccagaaataatctcccgcattttcaagcttaaatatgagcaaatgttatcagaccttacaaagaatcacctgctaggcaaagtcgtcgcatgtaagttgatgctaattcctatttgtagtgctacaaatagataa

SEQ ID NO: 45300 - DNA, 306 bp, Glycine max
  Peptide Sequence Number=SeqID_136985
atggaccatttcaagtgcttgaaagaatcaatgacaatgcttacaaagttgagctgcccagtgaatggagaatccaatttgaggacaaatccttctcaagagggacagaatgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 45301 - DNA, 564 bp, Glycine max
  Peptide Sequence Number=SeqID_136986
atggttgagaaaagtatcgttcaagaagccaaggacattcagctcgccatggagctgatttcgctgggagcccgattgcagatgctggagagcgaaacccagctcagccgcgggcgcttgattaaactttacaaggagttacgcggcagcccgccgccaaaaggaatgttaccgttctcaaccgactggtttatgacctgggaacaaaatattcactcgtcgatgttttacaacgcctacctgtttctgatgaaaagcgggcagtgcagcggagtggaggcggtgatcaaagcctatcgcctctatctcgagcagtgcccccagcaggccggcgaggcgccgttgctggcgctgacccgtgcctggacgctggtgcgtttcgtcgacagcggcatgctgcagctctctgcctgcagctgctgcggcggcgcatttatcacccacgcgcaccagccgctgaacggtttcatctgcagtttatgccaacccccatcccgcgccgtaaaaagacgtaaactttcgccgcaactggccgatattattcctcaactgctggacgagcag

SEQ ID NO: 45302 - DNA, 434 bp, Glycine max
  Peptide Sequence Number=SeqID_136987
gccaactaagcggaccatgtctcgctaagccacctatggcttctaggaaacgtaaaagtattggttcaagacccacagcgcaatatgacacaaggagattctcttccttagatgcttggaccagatacacagataatttcttggggagaaacattttaccagagaggaaagtagagatatatcactctgagctagatgagtttaaggctgaattggagaggcgtaatttccataaacgcctcaccaatttagtcgatgggagcatagacctggctttgattgatgctggcaatctcaacatattcttggagacacctgtggtattagttgagggggagaccttacccgcttactccagatactgtaggttgcctacaaactatagagagacagaggctaccttattcatacctggccgagggttcaagatgcaa

SEQ ID NO: 45303 - DNA, 195 bp, Glycine max
  Peptide Sequence Number=SeqID_136988
atggaggattgccttgagggtccgcacttaggcaatcatgaaagcatagctccaaactcaaaggcaatcatgaaacatagctccaaactcaaaggtggaggacacatgaacagcgctaggcataacattcatggggctccgaaaaaggggagaatggaggattgccttgagggtccagcacttaggcaatcatga

SEQ ID NO: 45304 - DNA, 897 bp, Glycine max
  Peptide Sequence Number=SeqID_136989
atggccaagtttgatccagaaatagtccttgaattttatgccaatgcttggccaacagaggagggcgtgcgtgacatgagatcctgggttaggggtcagtggatcccgttcgatgccgacgctatcagccagctcctgggatatccgatggtgttggaagagggccaggaatgcgagtatggccagaggaggaaccggtctgatggattcgatgaggaggccatcgcccagctgctatgtataccggggcaggattttgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctgggccctgggattccccgcactgatcacaggactctgccagtcgttcggagtcccccgttgcacctatcaaaggtgattcggccgcccatcacccaggcttttgttgagaagtactgtacccagagacaggctcagggtgatgctccacaggccgcaggcgggccaccaccacctcatcaggctggccaggctggggcatttgacatggagcagtatttacggcatttggttctccagcaggcggccaaccaccgagcacatgtacagacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccgacgatggaaaagaggcccacgaggatgaggagatggccgatttgcttgacttcttgggagggagtggagatacgtga

SEQ ID NO: 45305 - DNA, 534 bp, Glycine max
  Peptide Sequence Number=SeqID_136990
atgattatgaggggccaagacatttatagtagccaagatgaggctactacttcaccttcctctagtgaaagtgaagaagtaaaaggggaagaatctagtgaagaaatctacccccaagaagaaagacaacctttaatggttaaggaggagtgtaaggaggtaagtgtctcctccaagaggttagctaagaaggaaagtcattttgaaataaagacaaatattaaagaaacttcccctcttggacaacctccacatcttctcctttgtaaaaagacacttgttagcactgtcacacctcttgggcttgaggttattcctcatgtaaaggagttgttggatgagggtttggttcgtgtcaagggaagaagcccaaagtacgaagaacctcaggttttgaggtcaaatccattccaaggtggaggggatgatgcaatcctacccccaagggtattggatagaagactccaagaggattgggatagagctgctaaagaaggccctagggttctcatgaacctcaaggtagatttctga

SEQ ID NO: 45306 - DNA, 96 bp, Glycine max
  Peptide Sequence Number=SeqID_136991
atgacgggagatgcatcaaagtttactcatatttctccaaagaataatggacatgtgatttatggagacaaaaacaaaggagagttgctcatataa

SEQ ID NO: 45307 - DNA, 843 bp, Glycine max
  Peptide Sequence Number=SeqID_136992
gaaaccggcgataacgtggtgattcgtcagtcgcacggcggctccggcaaacaggcgacgtcggttatcaacgggattgaagcggatgtcgtcaccctggcgctggcctacgacgtagacgccattgctgaacgtggtcgtatcgataaaaactggctgaagcgcctgccggataactccgcgccgtatacctcaaccatcgtgttcctcgtccgtaagggcaacccaaaacagatccatgactggaacgacctgattaaacccggcgtatcggtcatcaccccgaacccgaaaagctccggcggcgcccgctggaactatctggcggcatggggctatgccctgcatcagaatcacggcgatcaggcgaaagcgcaggagttcgtgaaagcgctgtataaaaacgttgaagtgctggattccggcgcgcgcggttccaccaacaccttcgtagaacgcgggatcggcgacgtgctgattgcctgggagaacgaagcgctgctggcgacgaaagagctaggcaaggacaagtttgaaatcgtgacgccgagcgagtccattctggccgagccgacggtttccgtcgtcgataaagtggtggataagaaaggcactcgccaggtggcggaagcgtacctgaagtatctctactcgccggaaggccaggagattgcggcgaagaacttctatcgtccgcgcgatcctgatgtggcgaagaaatatgccaacgagttcccgaaactgaagctgtttaccatcgatcaggagttcggcggctggacgaaagcgcagaaggagcacttctccaacggcggtaccttcgaccagattagccagcgttaa

SEQ ID NO: 45308 - DNA, 252 bp, Glycine max
  Peptide Sequence Number=SeqID_136993
atgaatacgagaataaaaatacatgaaacaaaatgtggaccaccacggcaaaataggggagaagcttgccacccagctcgcccaggcgagcaaggttgcttcctccagaagcaacagccttctggaggaatcttctggagggcccaactttcgaagaagttacggaaactcacggattgcgcaaaaacacctcttttcgatttccgccacattacggaatttcacggatcgcgcaagcctgcttccttttga

SEQ ID NO: 45309 - DNA, 78 bp, Glycine max
  Peptide Sequence Number=SeqID_136994
atggagttgccaactatcacaacttacccttcagtattatcaccccatgcgcccatcacaagggatggcagcctctaa

SEQ ID NO: 45310 - DNA, 406 bp, Glycine max
  Peptide Sequence Number=SeqID_136995
atggttcttagggcatctcatgtcaatctcatgattgcatttgccatgcataagcataagtatgccagcttgcaaaagttggggaaagaatgcgctttacggtgcccttaccgaacgcgtgccagagctagagtaatgagtgaaatagagaaggtgcaagagtggatgaaggccgacatggaggccatgaaagagcaaatggccacaatgatggaggccatgaaagagaaaatgcctacaatgatggaggccatgatgagcatgaagaaggtaatggaggtcaatgtggctgcagttgccgctactaacgtctttgttgaggtggacccgactcccccatctggcttcaaccaaatgaattatccaacctcagatatggtaggtcagggaggcaatgagttgggaa

SEQ ID NO: 45311 - DNA, 492 bp, Glycine max
  Peptide Sequence Number=SeqID_136996
atgccaatctccccctgcagatgtatcggttgggatcgcgcccacaagacgcccagtgggcctgaagaagtccaacagggccctggggtttccagctctggttacgggcctctgaatcgcacccacaaagacacccagtggacccggagaagtccaacagggccctggggtttccagctctggttacgggcctctgtagtcctacaggatgcccgttccccctggcaaggtcacatcatcatagggatcgcgcctgcaaaacacccagtggacccgaagaagtccaacagggtcttggattgtcaagctctaattaggggtctctcaagggcatcaggccccctactaatcgagctttcatcaaggagtactgcgtctccaggcagggcgcagggcgaaacaccacagcagcctggggatggccggcagcgggcaacagacgcaccgccatcacctctagagttcacctcagctcatccacaaaaaggttag

SEQ ID NO: 45312 - DNA, 439 bp, Glycine max
  Peptide Sequence Number=SeqID_136997
atgcatagatctcccacaggcaatttagttcctctggacttagaaattaaagctacattgagaaggaacaaggccgagaggagaaggaaacttctgcaagtcaaaacagttgcatccattcttgaggaagaaactcatttttttaattcattatcacctaattcaccatcatcaaaggaatccgctactcaattgcctgaaatcgctagcatggcagacaaacaacaccataggatcacccttaaggattattcaagcagctcagtaccacaattctttactagcactgcacgtcctgaagtgcaagctcacaacatcaactacccgtattctttaattcatttaatacaggagaatttattccaaggattacctaatgaagacccttatgcacatttggcaacgttcattgaaatatgcaacactgtcaagattgccg

SEQ ID NO: 45313 - DNA, 528 bp, Glycine max
  Peptide Sequence Number=SeqID_136998
atgacattgctacttacaacattctgcccagcgaccacattgccaatctccccctgcaaaagtatcagttggtctgtgtcgtcccgacgtggggatcgcacccacaaagacacccagtggacccgaaaaagtaaacagggccctggggtttccagctctggttacgggcctctattagtcctacagggtgcccgtacccccccggcaaggtcacgtcatcatagggatcgcgcctgcaagacacccagtggacccgaagaaagtccaacagggtcttggagttgtcaagctctaattacgggtctctgtcagttctacggagtacctgtcacctccagcaagggcatcagcccccctactaatcgagctttcaatcaagaagtactgcgcccccaggcaggcgcagggcgaagcaccatagcagcattgggatggccggtagcaggcaatagacacaccgccaccacctctaaagttcacctcagctcatccataaaaaggttagagcgttgcctacgacacatgtaa

SEQ ID NO: 45314 - DNA, 153 bp, Glycine max
  Peptide Sequence Number=SeqID_136999
atgggacaccttagtgatcaaggggttcccacggaccctaagagaataaaggtcattcctaattggcccactccaccaagtataagggaaatctggggctgccatgacttaaacttttacaaaaggtgtcgagggaaggagcccagagaatga

SEQ ID NO: 45315 - DNA, 486 bp, Glycine max
  Peptide Sequence Number=SeqID_137000
atgaaggaaaatcattttgcaaaaaaaggtgatattaaaagggcactccttcttaaacaatctttctaccttctcctatcaagggaaacatcccttagcaccgccatacctcttgagcttgaggttattcctcaagtaaaggagttgttggatgaggctttggttcgcaagagcttaaatccttgtgctttgttggtgcctaaaataggtattattaggcaccaaatccctatgataggtggtatgatgaatgtgttgagtggtgcaacactctttcgtaaaatcactcgtgcacccaacatcttcatgatttatgtacatagggactcattggggaataatcaacatggaaataaagaaaaagggatgttttattccattagtttccataactttttaaataatgatcaagggcttcccatggaacctaagagaataaaggtgttgagggaaaaagcccagagtttcaagaacctcgggatttga

SEQ ID NO: 45316 - DNA, 366 bp, Glycine max
  Peptide Sequence Number=SeqID_137001
atggcttctaggaaacgtaaaagtattggttcaagacccacagtgcagtattacacaaggagattctcctccttagatgcttggacccgatacacagacaatgtcttggggataaacattttaccagagaggaaagtagagatatatcacattgagctagatgagtttaaggttgaattggagaggcgtaatttccataaacgcctcaccaatttagctgatgggagcatagacctggctttggtaaaggagttctatgcaaatttatacagttcagaggaccattcaccaaagcagtccagagtcaaaggtcatttggtaaagattgatgctgatagtctcaacacattcctggagacacatgtg

SEQ ID NO: 45317 - DNA, 168 bp, Glycine max
  Peptide Sequence Number=SeqID_137002
gctttccaactagccattgtacctgagattgcgataagtccttcttcttctttggagcttgttcttggtcccaagggaaacggggtagtagattcattctccactccagcagtagcagatgtagaatctgaaaggtgggattcccggttgattggatgcttccgttag

SEQ ID NO: 45318 - DNA, 48 bp, Glycine max
  Peptide Sequence Number=SeqID_137003
atgcagaattgcactaagcaatcactacgcatggctccaaactcgaag

SEQ ID NO: 45319 - DNA, 159 bp, Glycine max
  Peptide Sequence Number=SeqID_137004
atgctcttgataccacatgacgtagctccatgtggagcttgtaggccttggatcttcttaatcaatgaagtcctttgctttttgaacccactaatccaagatcaagtccaagattctccactaagtgtgcttaggtgtcatgaggcatgtaaagcatga

SEQ ID NO: 45320 - DNA, 546 bp, Glycine max
  Peptide Sequence Number=SeqID_137005
atgaccagtagattgttggccggatcattgacctttgataatcgcatcatgcactacattattgttaggattttgcttccccagtcttcaaatttggctcaagcctctgaggaggacttgattttgatgtttaccggtcctcagatcgattgggctcacttggttcggtatcaaatgcataaggcattacgggccaatgcacctctcccttaccctcaattggtcactctgtttctccgtcattttcaaattccgcttgatgatgaaccatttgttcaagtcaagcgtttctttgctattggcactggtgtagtcacttcttttggataccgtaaggatcggaatggtcaatggctgaagaaagatgcacttccttcacaagatgagcgtactccttctcctcctcctcagcgagatgattcagccctcatgactgaagttctttccgagttacggggtcttcgtacttatgttggagaacattttgattcattggataatcgttttgccggaatggatatccgtctcacacaacttgaagaagat

SEQ ID NO: 45321 - DNA, 258 bp, Glycine max
  Peptide Sequence Number=SeqID_137006
atggtgaaagttggaacctcttacgtgccgatcaacgtctctgtttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 45322 - DNA, 283 bp, Glycine max
  Peptide Sequence Number=SeqID_137007
gaacgaggataagggctacgtgggagtatgtgagctcagttggaggtgggcaacaggggatggtgggttatacgtgatttgtggatgtggagaatcgttttgcaccatcgcccgaccgccacctagtaccacatgtaatggagtgatacctggagatatgtcgcgggggtcaggagaccttggggacgtcaggatatggcctctggtaatcgattaccaagggcttagaaatgggactggaagattatggaggcctctggtaatcgattaccagtctgtgtaa

SEQ ID NO: 45323 - DNA, 249 bp, Glycine max
  Peptide Sequence Number=SeqID_137008
gacagagagcttaggggaagcagtaatgggatcatcggcgactatcataagtggctgagagtccggacacaaggattggattggctcccaaatctaaagactgtgagagacgatgaggttaaagcttcggaagaaagtgatgaggggctttatagggcagcaatagtgagctcaagctccgaagaggtgaaaggaatcatcacgggtcaaaggcatgaccttgaaggacgagctaaaggcttgccttag

SEQ ID NO: 45324 - DNA, 363 bp, Glycine max
  Peptide Sequence Number=SeqID_137009
atggataagaccgatgttgtttaccgcgccgactgcccgagccgcatcgtgctcgatcagattgcagataaatggtccatgatggtgctggaagtgctgcgcgagccgcagcgtttcaacgccatcaagcgccgtctggatggtgtcacgcaacgcgtgctgacccagaccctgcgcaaattggaacgtaacggcatggtgcatcgcaaagtgttggacgggcgggtgcttggcgtcgagtattcgctgacgccgctcggcaaatccctgcaggggccgttctcgatactgttcgattggacgttagggaatattgaggcgattcaggagtgccaacgcaagtatgatgagcaggacgagtaa

SEQ ID NO: 45325 - DNA, 417 bp, Glycine max
  Peptide Sequence Number=SeqID_137010
atggatagatctaggttggtttatgggttggtaaccgacatggatatgaacattggcgccttgatctcaggtcaaatctcttttattgctcagagtaactcctctaggctcagatttctagccttgtttactgctctctacagagctaggggggttacttctgatagcttgacctatgagagcctgagcccggccattaatttggcctacattaaaaagaattgtgggaatttgggtgatctgatagttaacttcaaaggggcaaggaaggtaagggctcgaccagctgatgttccctcttcttctactccaccagctccttccacttatgttactcctacaccagctcttccaggcccatctactcagatttctcagcacttagagtctatgcttcagagtttatttcaaggatag

SEQ ID NO: 45326 - DNA, 438 bp, Glycine max
  Peptide Sequence Number=SeqID_137011
atgcagtcccggtttcagtcgcagatgcaatcacagggactcgcacagcctcctgagcttgaggttggtccttcagctgctcgtgtcaacacaaaggagacttgtgttgatccctcggggaacgatccagacacaggtgactcagacaaatgtgggttgtacatcgaagaaaatcctccccgcctggttgccctaggaagagtttatgagggatccacaaccattcacaacattcctttgttgcatgatcaagtgaaggtcggtgttgaggaggttagagatgcaaatgctcccattcttgtacccattgaagaggttaagttagtggggcaggcacttaacacctttcttgcttggtcgacacatctcgtcaagcatttatcagaacaggttatgtgggatgctaccgtgttcggggtgtttaatgaagacttccct

SEQ ID NO: 45327 - DNA, 309 bp, Glycine max
  Peptide Sequence Number=SeqID_137012
atgggtgaagtagaggaggtgcaagagcagatgaaggccaacatagaggccttgaaagagcaaatggccacaatgattaaggccatgatgagcataaaggagataataaaggtcaatgcgactgcaatagccactaccagcaccattgttgagttgggaggtatgggtggcccccattatgtgcaaattcaaaacaagcacgccttcccgccatatggcttgcctcccaactatacaccacccaatgtggcatacactcccattgaggatgtcaataactctactcccatactcattgagagccaataa

SEQ ID NO: 45328 - DNA, 701 bp, Glycine max
  Peptide Sequence Number=SeqID_137013
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatagggctccacaatatagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 45329 - DNA, 231 bp, Glycine max
  Peptide Sequence Number=SeqID_137014
atggtggaagaacaaaatgacaaaacgaccctcacttcaaacgaggatattccagtgaaaggtcttccggagaaaagggatggttgtgacaagaaggaagtgtcgctagaggaagcaagcgagtttctccgcattattcagcaaagcgagttcaaggttattgagcagctcaacaaaaccccggccagggtctctcttttagaactacttatgagctctgagcctcattga

SEQ ID NO: 45330 - DNA, 423 bp, Glycine max
  Peptide Sequence Number=SeqID_137015
atggatttcctctggcgcgaagagcgtcctgaggtaaccaaaaaggtgacctgggccgcgagcctgggcgatcgcagcgaaaacgctgactaccagtacaacaagaagcggctgcgcgaaattgaccgccgggtacgctatctgacgaaatgcctcgaaaatctaaaaattgtcgattattccccgcagcaggagggcaaagtgttcttcggcgcgtgggtggagattgaaaacgacgacggtgacaccctgcgctttcgcattgtcggctacgatgaaatttttggtcgtaaggattacatctccatcgactcgccgatggcccgcgcgctgctgaaaaaggaagtgggggagctggccgtcgtgcagaccccagccggtgaagccagctggtacgttaatgagatcgtctacgtaaaatag

SEQ ID NO: 45331 - DNA, 300 bp, Glycine max
  Peptide Sequence Number=SeqID_137016
atgataaatgctttagaaaaaggatactatgccaatggaaccacaaccaaagtaaagaaaattatagaagatgtagcagctagtgaatgtggtcgtgattgcaaccgcacctctccaaaggatgttcccaaagaagtcatcgaaaatgaatccgtcaaacaacaaacacaagtgaaagctatgatggagagcgtaacccaaagcatagtaaaacaacttcaatcgttgataccgccaaaacaaccaattctctcatctgaagagtgtggggataacttccatacctcttggaggaagtag

SEQ ID NO: 45332 - DNA, 246 bp, Glycine max
  Peptide Sequence Number=SeqID_137017
atgcattcaaataaacatcacagacacaactcagtggtttctggaatcaatgtggatattgtcgcaacatgcccttttgcgggcgagcgagggcgaggctcacgggtgcgctttccaaaggaggaaagatgcgcggagtcgccaccaacgtttatttgtgaaaaacgtcggaaaaaccgaaggaaaccggtgatcgaggccgtacccgaatcaaataaacatgaaaatgcagtaactaggaagtga

SEQ ID NO: 45333 - DNA, 192 bp, Glycine max
  Peptide Sequence Number=SeqID_137018
atgaagaaagttggaacctcttacgtgccgatcaacgtctcatcttcaccacaagttggcccagggcctcccgccgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 45334 - DNA, 763 bp, Glycine max
  Peptide Sequence Number=SeqID_137019
cgaactccattcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgctagtcggacgggaagtggctgaggagcaaaaggaggaatccgcccgaggagggggctcgcccacactgggactgagacacggcccagactcctacgggaggcagcagtggggaattttccgcaatgggcgaaagcctgacggagcaatgccgcgtgaaggtagaaggcctacggttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagg

SEQ ID NO: 45335 - DNA, 261 bp, Glycine max
  Peptide Sequence Number=SeqID_137020
atgatgacaaggagtaaaaggtttgtggaggctgaggataaggatagtgttgtacaaaagaagaaaactgctgacaagaaaggtactgattgcaagaaaaatgaggtgagagaatcaaagaatgagttcaagattgaatcaagaacacttcaaagttcaaaaggaaatttgaattcaagaatcaagaatcaagtttcaagattcaagttccaagaatcaagatcaagattcaagaatcaagaaaagactcaatcaagataa

SEQ ID NO: 45336 - DNA, 351 bp, Glycine max
  Peptide Sequence Number=SeqID_137021
atgtattattccattactttccttaactttttaaatagtgatcaagggcttcccatgaaccctaagagaataaaggtcattcctgagtggcctactccaccaagtataaggggaatttggggcttcaatatcttaacaaacttttacaaaaagtttgtcccatatttttctatacttgtagcaccactcattgagttggtgtttgaggaaagaatccatgagtttcaagaacctctggatttgaggtcaaatccttttcaagggggagggaatgatgcaatcctacccccccaagggcattgtatagaagactccaagaagattgggccaaaaatgcaagagaaggcctag

SEQ ID NO: 45337 - DNA, 141 bp, Glycine max
  Peptide Sequence Number=SeqID_137022
atgaagggaaaccaacaaagggtccccagtggagtcgccaactgtcgcaacctacccttcggcgggagggcgacgcgagactcgcgggatgcgtgttccacgaaaggagtacgcgcggagtcgccaccaacgtttatttga

SEQ ID NO: 45338 - DNA, 404 bp, Glycine max
  Peptide Sequence Number=SeqID_137023
aaaccgacaagaggaagcgaagcatagcactcaaagcctcctcctcaatacaacaagaagaagaagatgaagaagacttctcactctttgtgaagaagtttcacggattggtcaagaagagaagaatcgagtggcgtcaaaatttcaaccatggaaaaagattccaagaagactctacaactcttagatgctacaagcgcaaccaacttggtctcatcaaagcaaattgcccctcaaacaagcaatggcctgagaagaatgagaagaaaagtcatgaagaaagaagattcaagaaggcgtatattgcatgggatgacaatgactcatccgatggttcggagaaggagattaaccttctatacaaggactatgagagcaataagaacatctctcaagaagattaa

SEQ ID NO: 45339 - DNA, 1809 bp, Glycine max
  Peptide Sequence Number=SeqID_137024
atgatcaaatgtgcacatgcattcaccactgtttcggaaggctatctggaagagctttttataagtttccgcggacttgaaagtctggttcgcgaagaattcggaaaagcatacggaatcatcaatggtattgatactgaagtatggaatcctgagactgatcctatgctggattataactttagtatcgaagatgccgtagaacagaagaaaaagagtaaagccaaactttgcaaagagtatggtctgaagccggaacttcctttgtttgcatttattggaaggtttgcaaccgaaaaaggagccgatctgctgcccgatgttgtatggagaagtataagacagagctatggtgctttaaatgtcatcattctgggctccggtaacagatatatagaagataagttaaaagaatacgaacatttgtacagtaattttgctcttgatctggggtataaagaatatctgtcccataaaatatatgcttcagcagactttttgctgatgccttcaagggtggagccatgcggattgaatcagatgtattccatgagatacgggacggttcccattgtaagatacaccggtggattgaaagatactgtgcaggatatatctacaggaggggcgggattaaatttttcctatccgggagttgatgatgtaattcacgcgatgaacagagggatgcatatatattatcaaaaaggtgtgatggaggaccttatcactgccaatatgcaatttgatttcgcctgggagaagtctgcggagaataaaggatttgtagatattttagctgccgaacagaatgttgaaaatgagagttggtaccagggtacagcagatgcggttcgtcagtcgatgaaacaccttgaaaaatatgattatgattatattcttatcctttcaggagatcaactttatcagatggacttcagggaaatgctggattatcatattaaaaaaggaggggatgtaactattgcgactattcctgtaaatgccaaggatgcaacaggatttggtattttgaaatccgatgatgaagggaatattacttcatttgttgaaaaaccagggatggatattttaggagattggaagtctgaagtttctgatcataacaaacatgaagggaaagaattccttgcatctatggggatttatattttcacaaagagtattcttaaaaagatgtttgatgaaggtgcgggggatgatttcgggaaagatattattcctaattcaataggaaaatatgctacattaagttatcagtatgaaggatactggactgatattggaacaattgagtctttttacgaggctaatattgatctttgtcaggattttccacagtttaatttattttcatcgtcaccgatttatacgagagccagaatgctacctccatccaaaattaacggatcttacgttagtaaagctgtttttggagatggatgtattattatggcggacaaaattgaaaattcagtgatcggaaacaggacccgtatcgataaaggaagtacgatcgtaaattcttatgtaatgggatcggatttctatcagaatactactgaaattgtcatgaatgaccggaatggtcgtcctaacatgggaatagggaaatactgttatatcgaaaaagcaattctggataaaaattgctatatcggagataatgtaaggattatcggagggaagcacttacaggatggcgactttggaacccactccgtgcaggatggtattgttgtggtgaaaaaaggagctatattgcctccgggaactcatattggataa

SEQ ID NO: 45340 - DNA, 883 bp, Glycine max
  Peptide Sequence Number=SeqID_137025
atgtttggagatacctgtggtgctttgttctcaaacaatgaagaagtgaaaaatctgttattgcaaacaggtgacagaaccaatcaaaggctgtggaatcttcccttgtgggatgtatggaaagaagacatacaatctgatgtagcagatcttaaaaacatttccttgaagccgattggtgattgtattgtagcggccaaatttctggaacaatttatagaaaatcatccgaagtgggctcacctggatattgcgggagtcgctttcgggagtgttggttatgccaaagaaaaagccgcaacaggttttggaggctatgatttcatggacgaaatgaagatgctcggtaataaaataatcctgattacatccgaaaatatcagagaaaagaactggccgtggcatgcgatcgatgagacccgaaaaattgatgctgtcgttgctctcgatgattatgacgttgaaaaagcagcactgatcagggagactttccgtatcccagggatgggacaaactacccaccgctatttcagggataaactggcaatgagacaaaaagccaaagattcgggtatcaacgtgccggaatttacagcagtctttaacaatgatgaggttaatacttttattgaaaacgttcctgctccgtgggtgttaaagccccgttccgaagcttctgcatcggggataaagaaaatcacttctaaggaacagctttgggaagccttaaatgagttgggagaagaacgccatctttttttactggaaagctttaaacccggagatgttttccatgtagacagccttacttttgataaagaagtggtgtttacatcagcatctcaatatctagccccgccgatgcaggtttcccatgaaggag

SEQ ID NO: 45341 - DNA, 530 bp, Glycine max
  Peptide Sequence Number=SeqID_137026
cctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaacccaagcgcgggtaaacggcgggacgaaaccacagccaagggaacgggcttggcggaatcagcggggaaagaagaccctgttgagcttgactctagtccgactttcggggcactgcccctctttttggacccaaggtcggcttcggccggtcgatccgggcggaagacattgtcag

SEQ ID NO: 45342 - DNA, 324 bp, Glycine max
  Peptide Sequence Number=SeqID_137027
atggcgcctaccaggcaccctctggacccggataagtccaacagggccctgggatttcccgctttgatcacaggactctgccagttgttcggagtccccgtcgcacctagcaagttgagcctcagcctgcagagccagggttttacttctttttcgtgccctacaccggatcagttcagggtagaggtcgcatggcccggagattggcctgaggcccaggcaggaggggcgccagcagaggctcccgacgaggcagatgaggcccgcgaggacgaggagataaccgatttacttgatttcttaggagggggcggagccacatga

SEQ ID NO: 45343 - DNA, 917 bp, Glycine max
  Peptide Sequence Number=SeqID_137028
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataccggaggtaaacatttggtacccaaaaacacaaagatgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45344 - DNA, 845 bp, Glycine max
  Peptide Sequence Number=SeqID_137029
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgactaagtccaatgcttcaagtgatggaatgggatctggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45345 - DNA, 459 bp, Glycine max
  Peptide Sequence Number=SeqID_137030
gacaaagaaccaaagcaagttagggttcgagggcacctgattaagttcgatgcggactccctcaacaccttcttgaagactccagtggtcttggagcaaggggagagcttaccttcttactctaggttctacaggttaaggccagaccctcaagagctggcagcttggctgtgtatccctggaaggggatgtgttcttaatgtcgagggcttgccgtggaagctcttgaggaaggatcttacaactctggcgcaaacctggagtgttttatcttattttaacttagccccgacttcacatacttctgatcttaatcttgacagggctaggttagtttatgggctagtaatgaagatggacatgaacataggagcacttatatctagacaaatctcactcattgctcagtccaactcctcaaggcttggatttccaggcctcatcactgccttgtgctag

SEQ ID NO: 45346 - DNA, 291 bp, Glycine max
  Peptide Sequence Number=SeqID_137031
atggtgaaagttggaacctcttacgtgccgatcaacgtctcatttttgccaaaagttggcccagggcttcccggtatcaacagggacaccaggatttatttattctgcgaagtgatcttccgtcacagccaacttactgatttagtgtatgatggtgtttttgaggtgctccagtggcttctgtttctatcagctgtccctcctgttcagctactgacggggtggtgcgtaacggcaaaagcaccgccggaatcaagcttatcgataccgtcgacctcgagggggggcccg

SEQ ID NO: 45347 - DNA, 189 bp, Glycine max
  Peptide Sequence Number=SeqID_137032
atgaggccagacaactaccttaaaggaataattaatagtgctttgaaagaacttgaggatactccacaacctaaattcaaggctggtgctaggtggattgttgttaaatattttaatgatgttagaccattggaagcagagagattgaaggcacttcgcatccagtggacaactaccttaaaggaataa

SEQ ID NO: 45348 - DNA, 147 bp, Glycine max
  Peptide Sequence Number=SeqID_137033
atggcaggggaaaatgggagaacagccaggaaaccacattacaagcgaaacctcaaagagagttgggcttcgtccttaaaaggaaacaacaccagaaaatctagccttccatggaattcaaacagaaaaatgcaaaatgaaacatga

SEQ ID NO: 45349 - DNA, 235 bp, Glycine max
  Peptide Sequence Number=SeqID_137034
gccttatcaggttacatgggatgccactgtgttcggcgtctttaatccagatttcccgctctacataaagcacgaagacctctctgaaatcgaacaccgtggtcaatgtctcagcatatcagtgttacagttgccagacaactaccttaaggggattattaacagtgctttaaaaggtcttgatgatgctccacagcctaaatcaaaggctcctgctaggtggattgtcgtcaag

SEQ ID NO: 45350 - DNA, 854 bp, Glycine max
  Peptide Sequence Number=SeqID_137035
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcacttgtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45351 - DNA, 243 bp, Glycine max
  Peptide Sequence Number=SeqID_137036
atgtgggcattggaacgctgcacgactttggctccaaagagaactcctcctataatagaaaacaaaccactcggacacagtatggcgtggtgcgcagtggtgccactcatttgtttccatgttgtagaggggcaccaaccggatagagtgttgcgacaatttggaatgcaacaacctattccgagagtctccttcgcaaccacggaatgtccatgggctaacattgaaaggcaaacaagatga

SEQ ID NO: 45352 - DNA, 165 bp, Glycine max
  Peptide Sequence Number=SeqID_137037
atggcagaatcgtcaaagaaacgtaagggttcatccgcctccgcctcggcttcaagagatcatcgttccgaaaccaacagcgcatccacagcaccaattccaccctccttatcttcttccacactattttcttccgaagaacagcagaaatggatagcactttga

SEQ ID NO: 45353 - DNA, 135 bp, Glycine max
  Peptide Sequence Number=SeqID_137038
atgccaacaactcagaatattgctgctgggaaggtgccacctgtggctatcatcatctctcatcagaatcttggaggtgatctcttctcattcatcagtatctacccaatgaacattggctcaacttctttatga

SEQ ID NO: 45354 - DNA, 156 bp, Glycine max
  Peptide Sequence Number=SeqID_137039
atgcatattcatggtgaagaccacaatggcaaaggagatggaaatgatgaagactttcacattgatgaaacaaaaacaagtgttgatctgccaagagagtggagaacttctagataccatcctcttgacaacattattggtgatatatctaaaggg

SEQ ID NO: 45355 - DNA, 333 bp, Glycine max
  Peptide Sequence Number=SeqID_137040
atggctgaagagctaagaagagtagccctggaggattattcaagttctacttatcaacagcagagacagtggcaaaatcaccctggtaaccaattcaacagagaccagggtggttcatctacaaggccacaacagcaggtgccaagtctctatgacaaaaccactaagttagaagagactctagctcaattcatgcaagtgtcaatgtctaaccaaaagagcactgagtctgcaattaagaatctggaagtccaggtgggccagcttgcaaagcaattagctgaaagatcatcaaacatctttacaacaaacacagtaggctgtgatgactag

SEQ ID NO: 45356 - DNA, 492 bp, Glycine max
  Peptide Sequence Number=SeqID_137041
atgggtgaccaagaggaagtacaggaacagatgaaagtcgacatgttggctttgaaagagaaaatggcttccatcatggatgccatgccaggaatgagacaactaatggagaataacgcagccaccgccaccgttgttagttcggctgccgaagcagatccaactctcctagctatcgcgcaccaccctatcccaaacgtggtaggacgagaaagaagcgcactggggtacatcagcaacccccatccgggatacaaccgagtggcttacccctatggattaccacctaattacacgccaccagtcatacgtgatgacacgggtcatgtccttaaccccatccttgaaggggagcctcctcgacagtcggatgaggttcacgaggatcgtcaagagcatgcccagggagacatcgaatcctactccccgttccccgtcgaggggccagcacccaacacactacctcagcccaacctcacgggagaaccttga

SEQ ID NO: 45357 - DNA, 96 bp, Glycine max
  Peptide Sequence Number=SeqID_137042
atctcccataggcaatttagttcctctggacttcgagattgaggttatgttgagaaggaacagagctgagaggagaagaaaattactgcaagatag

SEQ ID NO: 45358 - DNA, 800 bp, Glycine max
  Peptide Sequence Number=SeqID_137043
gacttacctcagccatcgccgccgactggccccgccaggtgaccgacagccgcggtgtgcataccctggagagcaagccgacgcgcattgtctccaccagcgtgaccttaaccggctccctgctggcgattgacgccccggttgtcgccagcggtgcaaccgcgcccaacaaccgcgtggcggacgcgcagggattcctgcgccagtggggtgatattgcgaaacagcgtaaggtcgcgcggttgtacatcggtgagccgagcgccgaagcggtggcagcccagatgccggacctgattttgatcagcgccaccggcggggattccgccctggcgctgtacgaccagctctccgccatcgccccgacgcttgtcatcaactacgacgacaaaagctggcaggaactgctgacgcagctcggtactattacgggtcaggaaaagcaggccgctgcgcgtattgccgcatttgataaacagcttgcgcaggtaaagcagcagatgacactgccgccgcagccggtgaacgccatcgtctacaccgccgccgcgcacagcgccaatttgtggaccgcggaatcggcccagggcaagcttttgcaccagctgggctttacgctggcagacttgcctgccgggctgcatacctcaaaaagccagggcaaacgccacgacattattcagttagggggtgaaagcctggcgacggggctcaacggcgaagggctgtttgtgtttgccggggacgagaaagacgtggaggcgatttacgccaacccgctgctggcgcatctgccagcg

SEQ ID NO: 45359 - DNA, 252 bp, Glycine max
  Peptide Sequence Number=SeqID_137044
gctgaagcttatgctgcaaacatctacaacagacctcctcaacctcaacagcaaaatcagccacaacagaataattatgacctcttcagcaacaggtacaatcccggatggaggaatcatcccaaccttagatggtcgaatccttcacaacagcagcaacaacaacaacaacaacagactcattttcaaaatgttgctggcccaaacagaccatacgctcctccaccaatccagcagcaacaacaacaatag

SEQ ID NO: 45360 - DNA, 1015 bp, Glycine max
  Peptide Sequence Number=SeqID_137045
atgggatcaagtcaaatgccttcactcaaaaaaaggttctatcaagtcaaggtcaagagcctagggatcaccagtctaagagagttagggcagttgatgggtcagctccagcggcaagcttttcacaaagcttacagtaaaatctgggacctagccatggtagaagtctccacagaggccattgcatccctcgcccagtattatgatcagccgttgaggtgcttcacctttggggacttccagctatcacgtatggtagaagaatttgaggagatcctaggatgccctccaaggggaaggaaaccatacctcatctcagggttctatccctcattagctagaatttccaagatagtccaaatctcggcgcaggaattagaccacaggaagcaagtcgaaaattgggtgtttggaataccgagaaaatgtttggaggcaaaagcaagaatcttggcaagtaatggcaaatgggccctgttcatagacattctcacactattgatctttggaggagtcctctttccaaatgtggatgggttggtggacctagcagcgattgacgcttttcttgcctatcatgaccacaaggaaatcctggtcgttgctatgctagccgacctctatgaaacctttgaccgaagatgtgagaagagcagtacgaggattgtctgttgtactcctgctctttatgtatggttggtttcacacctttttcgccaagaggtgaggcatgcctgcccgttagaaagccaccgttcatgcacagagaaaggaagggcgaattgggaccaactcttaacaaacagggaaggagcatctgtcaactggttccctcgatggaaagaaggaagaactggagttcttatttcatgcggaggatttccaaatgttcccttgatagggacaaggggttgcatcaattacaatcccgttcttgcgataaggcaacttggctacccgatgagaggggcaccactagaggaagagctcgcacctgtcatttcacgagggttca

SEQ ID NO: 45361 - DNA, 244 bp, Glycine max
  Peptide Sequence Number=SeqID_137046
ggcgagtcctggtgcagcggtaaagttgtgccttggtgacttgttggtcatgggttcgaatccggaaacagcctctttgcatatgcaaggggcgagccctggtgcagcggtaaagttgtgccttggtgacttgttggtcatgggttcgaatccggaaatagcctctttgcatatgcaagggcaaggctgcgtacaatatccctcccccataccttcgcatagcgaagagcctcggggcaatggg

SEQ ID NO: 45362 - DNA, 342 bp, Glycine max
  Peptide Sequence Number=SeqID_137047
atggataaagttgatatctttgtccctcatcctctcacaaacgcatgtttgcttattcaactttcaccggaatgtgggtgtaagccattggtctgtttgctcaagcaacctgcgctcctgagtgttgacttccaagaccgttcaatcagagattactcatcttgcacgttggtggggggacaacccttcccttgtgttcaagaatcccctacaacaagagacccccggtctcttaatcccttttcagaaataagaagaagagaagaagaggtctctcttaaaagagatggattgtacaatgaagatcaatcaaaattatttattgaatatgcaagtggttga

SEQ ID NO: 45363 - DNA, 231 bp, Glycine max
  Peptide Sequence Number=SeqID_137048
atgtgcagcacatccagagaggagtatccatctactatatggtttaagatttcacccgtgccgatctatagtgttcggacatgcgcaccccaaagacacctcagtggacccggagaagtccaacagggccctggggatttccagctcggttacgggcctctggatcgcgtctgcaggacacccagtggacccgaagaagtccaacagggtcttggagttgtcaagctctaa

SEQ ID NO: 45364 - DNA, 779 bp, Glycine max
  Peptide Sequence Number=SeqID_137049
gagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcggttggactcaagacgatagttaccaggataaggcgcagcggtcggactgaacggggggttcgtgcatacagtccagcttggagcgaactgcctacccggaactga

SEQ ID NO: 45365 - DNA, 639 bp, Glycine max
  Peptide Sequence Number=SeqID_137050
atggcccatgaacaaaagctagtggaggattttgcacaagtgtatgccgaaaaagaagcaagagggagggtgattgatgcgttgcatcaagaagcgactatgtggatggataggttcgccttgaccatgaatggaagtcaagacctcccgcgtctgttagccaaagcaaaagccatggccgaagtgtgcactgcccccgaggagattcatgggctaatcaattactggcgtgtaggaacagatgaaggccgatctatcggccttaaaagatcaaatggtttccatcttggaggtcatgttaaaactccaaaaaccatagaggataaagccaccgcaaccgcctccagtacagttagggaagcggagccggtgctgcagcccgccttgaatccgggcctagacagaaacacggccgtgttcagtcgaaggtatagtctgcaagcttatccttatggcctgcctccggacttcaccccccgtgccaccccggaagatttaagccaagcccctacttttgaggggcaactcccaccttatgaagactatcccgggcaagacgatggggaaggagatacccatcttggccccctgctccacctcaaagatctgtccccgcatgaactaccccaaccgaacata

SEQ ID NO: 45366 - DNA, 213 bp, Glycine max
  Peptide Sequence Number=SeqID_137051
atgggcttagtctgcagccgaagtcgtcgttttcgtgaagctgatgctgaagaaaatgctcaggatgcagaaattgaaagaagaatcaagttagaaacaaaggctgaaaagaatattcagaaacttttattactaggtgctggagaatctgggaagtctacaatctttaagcaggcaagaaattgcatcttctcaaccgcttgtgaattatga

SEQ ID NO: 45367 - DNA, 729 bp, Glycine max
  Peptide Sequence Number=SeqID_137052
atgtcgcagaggggatcgttgatcccaacacatattcagccagatatacatgggttaggagcacgagtgagcacaaaagggagcaatgcgaagagtgttcgcaacccatgtctgcctaatgatgttgctcttgtcaaaccccctatggggttgtatgtgcaacgccaagattcaattgagttggtggccttaggaaaaacatatgatggaggctcgaccatacacaatgtggcttatgctgacaatgtcgtaagggttagtgttgagcaagttattgatggtgacgctgaggtcccattcccaacatcagagattaagtgtgtcaggcaggcccttcacacattcattgcatggccaacaccacttgttaaaaaaatctttattgagcatgagggcagtagtccaactaaagacactgaagctgttgaagcggtcaacgatgttgttgtagatgaccccttgcgcgagttgattaagagcctagttgacatttatgagaagcctgtagagttagtgtgggatgttactaaatttggaattccaaatgcaactgcatcattgttcataacgtgtgctgatgtgaatgaaataatatcaggcgtacagtgtttgaacatagctatactacaattgtggaccatgtatatggaccaattgagtcaaagctatggtctaggatcggtgtatggattccttgagccgcagggctatactgaatgcaaacgataa

SEQ ID NO: 45368 - DNA, 450 bp, Glycine max
  Peptide Sequence Number=SeqID_137053
atgacttgttgtgatcctaagcctattttagtttcggtgtggtttgttagatacttcattagataccttgattcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 45369 - DNA, 369 bp, Glycine max
  Peptide Sequence Number=SeqID_137054
atggaaacgcagttgatccatgatcgtgttgtgatggagtgcctagagggtgtttgggagactctcgaaggcaatgagaggtgccgattccgtggcacaattcgactcactgctacttcattagtacatccagaggaacccgcacgcacacttcagcagcctgtggagtggatactacctacacctactccatatcgactagtggagccacttcaagtgatagaggtgtcatcctctgaagaagatcctgaagaggacccagaggagttacctcctgaaccagctgtggatgatcttgacttacccgaggatgatgaagacccactccctgatgttgattccctagaggatgttatgtcagcatctgag

SEQ ID NO: 45370 - DNA, 564 bp, Glycine max
  Peptide Sequence Number=SeqID_137055
atggaagccaatgcggttgcagttgtcgctaccagtgctgttgctaaggtgaactcgatgcccccatctggcctcaaccaaatgaatcatccaacctcagatatgcacgccttcccgccatatggcttgcctcccaactatacaccacccaatgtggcatacactcccagtgagaatgtcaataactccactcccatactcattgagagtcgacaaccccaaactgataatgcacatgtctctcaaaccatgggggagacacatgaaattccccaccacaatctagccgacttcgagccttgcctcggatatgccactgaagggcaagcagttggtggtatacccctgcaaaacactttggagggccctcggtatcacccacaaccacaccccttgcattccacagtgggtaaaaaccctcatgctatggtagaaatgggaaagttggatcatctagaggaaaggctcagggccattgaaggaggcgaagattatgcctttgctttgctaaggtgccggattttgacaattacaaggggacttcttgccccaagaaccatctaa

SEQ ID NO: 45371 - DNA, 885 bp, Glycine max
  Peptide Sequence Number=SeqID_137056
atggctcagcaaccggtgcagacggtgaacggtaagattgtttacaaccgtaaatatggcgatattccgaaaggcagctacaccggcggcagcacctataccgttaagcgcggcgataccctgttctatatcgcatgggtcaccggcaacgatttccgcgatcttgcggaacgcaacaacgtcccggcgccgtacgcgctgaacgtgggccaggtgctgcaggtcggcaactccgcaggccagccgatcaccggcgaaaacccggtatctcaggctagcgcgcaagcaagcggcggtgcgacggccaccacaacttctgcacaaaaatccaccgcagtggttgcgtcacaaccgactattacgtattctgaatcttcaggtgaacagagtgctactaagatgttgccgaataataaaccagcaacgaccacgacagcggtcgctccggttacggcgccatcaaccgttagcacaacccaaccgactgcaagcagtacgtctaccagttcgccgatctcatcatggcgctggccgactgatggcaaggttatcgagaactttagcggcgcggaaggcggcaataaaggtatcgacattgcaggcagtaaaggacaggctattgtcgcgaccgccgatgggcgcgtcgtctatgccggtaacgcactgcgcggttacggtaatcttattatcatcaaacacaacgatgattacctgagtgcctacgctcataacgataccatgctggttcgggagcaacaggaagtcaaagcggggcagaaaatcgctaccatgggtagcaccggaaccagctcaacaagattacattttgaaattcgttacaaggggaaatccgtcaacccgctgcagtacttaccgcagcgataa

SEQ ID NO: 45372 - DNA, 468 bp, Glycine max
  Peptide Sequence Number=SeqID_137057
atggggatcgcacccacaaagacaccaagtggacctaaagaagtccaacaggccctgggatttccagctctggttacgggtctctgtcagccctacagggcgcccgttccccccagcaaggattgtgcccgtaagacacctagtggacccgaagaaggccaacagggtcttggaattgccagctctaaatatgggtctctgtcagttatagggagtgtctgtcgcccccagcaaggtcatcaggccccctaccaatcgagctttcatcaagaagtgctgcgcccccaggcaagcgcagggcgaaacaccacagcagcattgggatggccggtagcgggcaatagacacaccgccaccacctctaaagttcacctcagctcatccataaaatggttagagcgttgcctacgacacatggccgaccagcaggctaccaagtccaaagccaaagataagcaaaagtactag

SEQ ID NO: 45373 - DNA, 448 bp, Glycine max
  Peptide Sequence Number=SeqID_137058
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatggccgcgtttgtctcattccacgccctgacactcagttccgg

SEQ ID NO: 45374 - DNA, 393 bp, Glycine max
  Peptide Sequence Number=SeqID_137059
atgggtgatcaggaggagacacaggaacaaatgaaagccgacatgtcggctttgaaagagcaaatggcttccatattggtggccatgttaggaatgagacaactcatggagaaaaacgtggccactgctgccgttgttagttcggctgctgaagaagacccaactctcccggctaccacgcaccattctctcccaaacgcggtaggacgagaaaggagcacactggggcacaccagcaacccccatttgggatacaatcgggtggcttacccttatggattaccacctaattacatgccgccagtcatgcgtgatgacgcgggtcatgtcccttcccccatccttgaaggggagcctcctcgactggccgacgaggttcacgaggatcattga

SEQ ID NO: 45375 - DNA, 625 bp, Glycine max
  Peptide Sequence Number=SeqID_137060
cctccatagccccgttcatcttcggccggtagggggtggagttatgatgctggattttgaaatcctcgcacatttcctgcatcattttgttattcagattggtgccattgtcagtaatgattttcctagggagttcgtatcgacaaatcagttccctctttatgaatctgaccaccacactcctcgtgacattggtataggaagtcgcttcgacccatttggtgaaataatctatcgccacgagaatgaagcgataaccgttcgaagccttgggttcgatggcccctatgacatctatcccccacatggaaaaaggccaaggggcggacatgacattcagaggatgtggcagaacattgacattgtctgcgaacgcttgacatttatggcatttccttacatgggtgtagcaatcgctttccatagtgagccagtaataacctgctctaaggatcttcctggtcatagcatgcccattggcatgtgccccaaacgaaccctcatggacttcctcaatcatgtagttcgcctttttggcatctacgcatcgcaggagggtcatgtcatggtttcgtttgtacaagacggtaccactcacaaagaaaccagtagccaatctccttaa

SEQ ID NO: 45376 - DNA, 432 bp, Glycine max
  Peptide Sequence Number=SeqID_137061
atggcggcgcagctaatccgtgaattagtagagatggagtgcctagagggagtctgggagaccctcgaaggcaacacgaggtgccgattttggggcattattcgatttacggcgacttctttggtgcatccagatgaacccgtgcgcacgcttcagcgcactatggagtggatactacccacgcctacaccatactgtctagtggagccagtccaagtgatcgaggtgacgtcatccgaggaagaccctgaggaggatcccgaggagctacctcctgagcctgctgtggatgctcttgattttctagagggcgatgaggacccacttcctgaggtggattctcccgaggaagtcatgtcggcatctgaggcagactctacggaggatagtggcctgagagagatggcgaccagtggaggctcttcatcatag

SEQ ID NO: 45377 - DNA, 179 bp, Glycine max
  Peptide Sequence Number=SeqID_137062
gatttgctgaatcaagctgagaaagaattcgggtatgaccatccaatgggcggtctcacaataccatgcaaggaggatgagttcctaaccgtcacctctcacttgaatgacctggatttctattttctacagaagttgaaacctgtttcccgaatgagaattaatgcagcacaggacac

SEQ ID NO: 45378 - DNA, 438 bp, Glycine max
  Peptide Sequence Number=SeqID_137063
atgggtggagtagaggaggtacaagagcagatggaggccgacatagagcccatgaaagagcaaatggccacaatgatggaggtcatgatgagcatgaagaagataatggaagccaatgtggttgcagttaccgctaccaacgctgttgctaaggtgaacctgacgtccccatccggcatcaaccaaatgaatcatccaacctcagatatgataggcaaagatttgggaagtaccatgatgtgcaaattcaaaacgaacatgcattcccgccatatggcttgcctctcaactatacgccacccaatgtggcgtacactcccaatgagaatgtcaataactccactcctatacccattaagagccaacaaccccaaactgatcatgcacatgtctcttaaaccgtgggggagacacatgaaattccccaccacaatctag

SEQ ID NO: 45379 - DNA, 243 bp, Glycine max
  Peptide Sequence Number=SeqID_137064
atggcctcttcaaattctttgtttcctgaaggaaattccatccataggccacctatcttcaatggtgagggttaccactattggaaaacccgtatgcagattttcattgaagccataaaaataggaccctacatacccactgatgagaatcatgaaactgaccaaatacaggctaaagtcccaagtggagaaggacaaaggcctaagtggagaaggacaaagcccccgagtagagaacgatga

SEQ ID NO: 45380 - DNA, 639 bp, Glycine max
  Peptide Sequence Number=SeqID_137065
atggagacaagtatgatagatgctgccaatggtggagcccttggagacatgacccctgctgaagctagaaatttaattgagaagatgacttccaactctcagcaattcagtgccaaaaatgatgctattgtcattagaggagtgcatgaagtagccacaaattcatcaggtgagactaagaagcttgaaggtaaactagatgtcttggttaacctggtaactcaactggccatgaatcaaaaatctgcacttgtcgccagactttgtggtttatgctcctctgccgaccaccacacaaacctttgcccttctgtgcaacaatctgaagcaattgaacagcctgatgcttatgctgcaaacatctacaacagacctcctcaacctcagcagcaaaatcagccacaacagaataactatgacctctccagcaacaagtacaatcccggatggaggaatcatcccaaccttagatggtcgaatccttcacaacaacagcaacaacaacaaccttactttcaaaatgctgttggcccaagcaaaccatacgttcctccaccaatccagcaacaacagcaacaacaacagccccagaaacaacaaacagttaaggcccctccgcaaccttcgcttgaagaactt

SEQ ID NO: 45381 - DNA, 359 bp, Glycine max
  Peptide Sequence Number=SeqID_137066
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttccccagtcacgacgttgtaaaacgacggccagtgaattgtaatacgactcactatagggcgaattggagctccaccgcggtggcggccgctctagaactagtggatcccccgggctgcaggaattcgatatag

SEQ ID NO: 45382 - DNA, 396 bp, Glycine max
  Peptide Sequence Number=SeqID_137067
acttatcaaggtaatccttgtggcgtctaccctgacttatcttccttcactggaagtggcgtctacccagacttatcttccttcaccggaagtggcgtctacccagacttatcttccttcaccggaagtggcgtctacccagacttatcttccttcactggaagtggcgtctacccagacttatcttccttcaccggaagtggcgtctacccagacttatcttccttcactggaagtggcgtctaccctgacttatcttccttcactggaagtggcgtctaccctgacttatcttccttcaccggaagtggcgtcatccaaacctccgtagcctgtatcaaacgatccactcctactcaggtttacatcaatttttttgtagacctcgatctgtaa

SEQ ID NO: 45383 - DNA, 394 bp, Glycine max
  Peptide Sequence Number=SeqID_137068
atgcagcagcgcggcagccagatgggccaggatcagcgcgaacagactaaacgccagcagcgaatcggcggcagcaccagcccctcgccaattgtcaccggaaacccgcctgtgacagcatcgcccagcctaccagcggttgcgccagcatcagtaaatagagcgccagatgggtcaaatgtgccaccgtttgctgccagcccggcaccgacgcgggcatggcgggcacaccacagtaacgccgcagcccgatacgcacgaccaccagcaacgcgatcgccacgccgagtggtttatgtatcgccagctagcagtgaatgggcagccgagatatccgccaccatcgccacgccgataaatagcatggtcagcacggccagcgccatcaaccagt

SEQ ID NO: 45384 - DNA, 306 bp, Glycine max
  Peptide Sequence Number=SeqID_137069
atgtcatctatatctgtcggacgtgtgaaatcttgccccggtatgcatagtagctgtgtgatagcctccctctctggttgtgctcgcacagttggccgtcctccagtatcagggggtggcccaggaaccgttaaaaggaaactactggtacggatgtggagcacactgaaaatgaggacacgtagccctctaaaggtgagggcgtgcaaccctctcaaggcgaggatgtatagtcctctaaaggtgagggcgtgtagtcctctcaaaggtgagggcgtgcagtcctctgttgtcgagtacgtgtag

SEQ ID NO: 45385 - DNA, 313 bp, Glycine max
  misc_feature (27)..(27): n is a, c, g, or t
  Peptide Sequence Number=SeqID_137070
cttgggaggattgatggggacccggtngttgagagaaatgaggatatgggctacgtgggagtacgtgagctcagttggaggtgggcaacaggggatgataagaggaacaaagaccacaaagcaaggaggcttgtgtggtggctggccagctgtgaatcttgtgtgatatatgggttgtggcctctggtaatcgattaccaagggcttgaaaacgaggtcaggaagctaggagagcttctggcctctggtaatcgattaccagtcagtgtaatcgattacacagaggaatgggtcattggtaatcgattaccag

SEQ ID NO: 45386 - DNA, 312 bp, Glycine max
  Peptide Sequence Number=SeqID_137071
atgacgaagaatgaacgaagaacggtgaagaacgatgaagaatttccacataatcgcttacagaaacgtctcggaagcgttacggaagcacctcggtttggattttcttcacgaaaacacattttttcacccaaaacagccgaaatgcatagcctaggggtctggaatattttgaaacaacccccctcccctatttatagggaaaaggggaggtgcttgccgcccagagaagcattatggaagccgcagaagccccaaaaacaatttttcaacaacgtggaggagcttgccgcccagttgcttcctccttaa

SEQ ID NO: 45387 - DNA, 276 bp, Glycine max
  Peptide Sequence Number=SeqID_137072
atgaatatcgaggaatccattcatgttacctttgatgaatctaatgctatcttgtcaagaaagaatatgctagatgacattgcagattctttagaacatatgaatattgatgaacaagattccaaaggaatgataaaggaaacaatgaagattctcaaagaagaagtcaaatccaataatgaacttccaagagaatggaaagtttcaagagatcatcccctcgacaacattattggtgatatctcaaaaggggtaacaactagacatttctcttaa

SEQ ID NO: 45388 - DNA, 288 bp, Glycine max
  Peptide Sequence Number=SeqID_137073
atggagaaagatggaacctcttacgtgccgatcaacgtctcattttcgccaaaagttggcccaggacttcccggtatcaacagggacaccaggatttatttattctgcgaagtgatcttccgtcacagctgtccctcaagttcaggtactgacggggtggatgtgcaactgttgggaagggcgatcggtgcgggcatattcgctattacgccagcaggcgaaagggggatgtgctgcaaggcgattaagttgggtaacgccagggttttaccagtcacgacgttgtaa

SEQ ID NO: 45389 - DNA, 489 bp, Glycine max
  Peptide Sequence Number=SeqID_137074
atgtgggcctttcatatcgggcgtcaacttgactgggcacacttagtcagatatcgcatgcataaggcattgcgattaaatgctccattgccatatccacaccttgtcactctctttcttcgccattttcaaattcctcttcattctgaaccttatgttccaatcaagagatcctttttaattggtgctgctgtgattgcctcctttggttaccacaaagagcatgatggctcttgggtcaaaaagggtgctcaacccgctgatgatgaaggcaacctaccagttgaagataattcctctcttcttcgaaggcttttggacaagttcgatggtcttcggacttttgttggtggcaagtttgatgccatggaattgcaagtcgacatgcggttcgatgccatggattcaaggataaccaaggttgaagaagatgtctccttcatccgtacttgctttgatccaccaccaccgcctccatcatcatcttag

SEQ ID NO: 45390 - DNA, 693 bp, Glycine max
  Peptide Sequence Number=SeqID_137075
gaaatcactgccaaacgagtccagcattggccaaagaaagggaagctttcagcaggaaagctaagtgtgaagtatgccattctgcacaggattggagctgcaaactgggttcccaccaatcatacttccactgttgccacaggtttgggtaaatttctgtatgctgttagaaccaaatccaaatttaattttggaaactatatctttgatcaaactgttaagcattcagaatcttttgctatcaaattacccattgccttccctactgtattgtgtggcattatgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgcggaagaggaagatgcagcagaagagacagaatccgatgatgattctgaagccaccccatga

SEQ ID NO: 45391 - DNA, 156 bp, Glycine max
  Peptide Sequence Number=SeqID_137076
atggtgagcaaagtttggagctttaatggaggcttcaatggagaggaagaagaagagaaaagcaacgtgagaagtattgtttacaaaattccgggtagaaatttccaggatgtcacatcaagaatgaagaaaatactcaatcaagataagtattaa

SEQ ID NO: 45392 - DNA, 234 bp, Glycine max
  Peptide Sequence Number=SeqID_137077
atggggcttgaatgcaggtctttggctagagacaaagactttcccagtgaaagcgctggcgttcagtttggttgcgtgctttccaatgatctctttcccttcctttctgtggtagcatgcacgcatccagtgaccgatgaatctgttgtcggaataagcgtaagcgcaacaagagaattcgcagcttttgtgcctaaaatccctactttaaactgggttggctttcaaagatag

SEQ ID NO: 45393 - DNA, 387 bp, Glycine max
  Peptide Sequence Number=SeqID_137078
ccatctgccccatctgatttgtcaaactttgaatggaggctcttgtctcttgctaaaattgcatattctggatggtcattttcctcactaactcttctaaggaaggttaaggaggagcctcaattgcttgttgtctttgttgtgactgctgctgtattggtggaggaacacatggcttgcttggaccagcaacattctgaaaaggagggacaaactattgttgttgtttttgttgtggaggacttgtccatctcagatttggatgattcctccaacctggattgtatctattgcttgaaaggtcataattattctactgttgttggttttgctgctgaggaggtctattataaatgtttgcagcataagcttcaggttgctcattga

SEQ ID NO: 45394 - DNA, 246 bp, Glycine max
  Peptide Sequence Number=SeqID_137079
atggccgctgaatcgcaacttaatcccacccagcccgtcaaccagcaaatctatcgcattttgcgacgcgatattgttcattgcctgatcccaccggggacgccgctttctgaaaaagaggtctccgtgcggtttgacgtctcccggcagccggtgcgtgaagcgtttattaagcttgcggaaaacggtctgattcagatccgtccccagcgcggtagttacgtgaataagatttcactttctcag

SEQ ID NO: 45395 - DNA, 393 bp, Glycine max
  Peptide Sequence Number=SeqID_137080
atggaggagttgattaacaaaacacaactctctcccaaaataatcccaacttcatcacgtcagcctggtggctccaccaaagaatctcacttctcatactctactgctgtcattctgcttccacgaacaaaggttcgcgatcatcacagtatgatgcatgcacctgacctcaactctcaaatgcaatgtggtaccatccctaaggaaaagcctaatcgtgtacacacgacactctcacttaggaaaactaggcagcaactccccccaccccacggtgatcagcctgagtctcaatggagttccaaaccgagtgacatgcccccaagtacaagtattcctcctcatgtacatacacaacataacatcatcacaatgcattttcaaagattctaa

SEQ ID NO: 45396 - DNA, 402 bp, Glycine max
  Peptide Sequence Number=SeqID_137081
atggaaacatgtttagcagtggaggagttgttgcaacgaatgatagatcaaggccgactggaagttggtgatgagggtagccacgcggtcccgtggaggtatacacctccgagtgaaaggaaagaagaagccaccgacatcagctcattgtcggccaaggtaaccaatatcacggggctgagcggtatgacccacagcggtcgtgtgtttgcaccccccgacctgccgacacaacccgcaaacgttaaggggaaggcaaaggtggtggatgaaaaaaatgacaagacgaccctcactctgaatgaggatattccagagaaaagggatggtcgcgacaagagggaagtgtcgctagaggaagcaagcaagtttctccgcattattcagcagagcgagttcaag

SEQ ID NO: 45397 - DNA, 228 bp, Glycine max
  Peptide Sequence Number=SeqID_137082
atggatgccttagaaatttactacaatgaaataaaagggcaattagacataaatgtgaaaattattagatatgatagaggtgatgagtattacggaagatatgatgaaactgggcaacacccaggtccatttgctaagcttgttcagaaacgtgcattttgtgaaattacaatttccaaaagagttcctaagtcaaggcctaagttccaagagaatcacttttcatag

SEQ ID NO: 45398 - DNA, 258 bp, Glycine max
  Peptide Sequence Number=SeqID_137083
atgcagagccagggcttcgcttctttttcatgccctactccagaccagttcagggcagaggttgcatggcccggagattggcccgaggcccaagcaggagagccacccgcagaagctcccgacgatggagaagaggcccacgaggacgaggagatggccgatttgcttgacttcttgggagggagtggagatacggtgaatgctgtgaaattttcccggacgcccgaaatggacttggatgaatgcacaaatggataa

SEQ ID NO: 45399 - DNA, 429 bp, Glycine max
  Peptide Sequence Number=SeqID_137084
atgttgctaagtagcaatgtcatctatatctgtgtaagagtggtcatgttggtgcgcatgatccgcactcgtctctttgcagtggcacgggtgaaatcttgccccggtatgcatagtagctgtgtgatagcctccctctctggttgtgctcgcacagttggccctcctccaatatcagggggtggcccaggaaccatgtggagcacactgaaaatgaggacacgtagccctctaaaggtgagggcgtgcagccctctcaaggcgaggatgtgtagtcctctagaggtcagggcatgcagccctctgttggcgaggacgtgtagtcctctcaaggtgagggcgtgcagccctctgttggcgaggacgtgtagtcctctaaaggtgagggcgtgcagccctctgttggcgaggacgtgtagtcctctaaag

SEQ ID NO: 45400 - DNA, 309 bp, Glycine max
  Peptide Sequence Number=SeqID_137085
atgaaagataaatggaatgtgcatgaattgcacattatgttagttcaagaagaaacgagacttaagaatcaaggaagtcactcagttcattatgtaagccaccaagggaatcaaggagctggaaagaaatttatgaagaagcatgataaaggcaaagggtcattaaagatcaatgacaactctttgcaaatccagaagaaggtattaaagagcaataattgtcaattttgtaggaaatcaggacatttccaaaaggattgcccaaagtgtaagtcttcgttcgaaaagagaggcgagcttaatgctcat

SEQ ID NO: 45401 - DNA, 597 bp, Glycine max
  Peptide Sequence Number=SeqID_137086
atgaggaatgccttgcgcttagatagcatgaaaaagcccttcgataatatcacggccccgagaaagctttccacaaagagatctaggagggatgccgcggctgaggggaccagtgccgctcccgagtttgacaaccatcatttcaggagcgctgagcaccagcagcgtttcgaggccatcaaaggatggtcattccatagagagagacgcgtccagcttagggacgataagtacacagattttcaggaagagatagctcgccggcgttggacgttgttggtcactcccatggctaagtttgacccagatatagtcctagagttttacgctaatgcttggcccacggaggagggcgtgcgggacatgtggtcatgggtaaggggccagtggattccttttgatgcaaacgccctcagccagttcttgggtgacccactagtgttagaagagggccaggagtgcgagtttagtcagagaaggaaccgagccgatggatttgacgaggaggccattgcccagctgttatgcatatcggtgtcagctggtgtatgccatcctgacacggatgagcgtccatgtggctcagttgatcgttga

SEQ ID NO: 45402 - DNA, 335 bp, Glycine max
  Peptide Sequence Number=SeqID_137087
atggctaaattttctccagaagaagtcactgctcttcaagcaggtggcaatgagaatggaatcctctgcgccattctcaccccgaatccggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 45403 - DNA, 378 bp, Glycine max
  Peptide Sequence Number=SeqID_137088
atggataaatttgacatctttgtccctcatcctctcgtaattacatctttgcttccactggaatgtgagtgcaagccattggtttgtttgcttaagcgacctgtgctcctaagttttttgacttccaagaccgttcaatcagagattactcgtcctgcatgttggtgggggtgccgtaaaacgacgagtaaatttcttccttgctacaaggtcatgacaaaagacaaggttgatacctcaaagccctacactggggcaatgaggggcatcgtgcatgagcctcaagcgaacctaggggcagatcaaaagttctcacctgtcgatgtttttaaacaaaaaagggggggggggacaaaccctggaatttcaatggattga

SEQ ID NO: 45404 - DNA, 303 bp, Glycine max
  Peptide Sequence Number=SeqID_137089
atgcacagagaaagaaggggcaaattaggaccaactcttagaaaaacaaagaaaagagcgtttgttaactggttccctcgatggacagaaggaagaactggggttcttatttcgtgcggagggtttccgaatgttcccttgatagggacaaggggttgcatcagttacaatcctgttcttgctataaggcaacttggctaccttatgagaggggcaccgctagaggaggagctcgtccctgtcatttcacgaggtttcaataagaccaacggggagacacttcaaaaggtccccaaggcatag

SEQ ID NO: 45405 - DNA, 291 bp, Glycine max
  Peptide Sequence Number=SeqID_137090
atggtgcagatggctactcagttgaaccaagctcagtcccaaaattctgacaaattgccttcacaaacggtgcagaatccgaaaaatgtgagtgtcatcaccttgaggtctggcaagcaaattgaagtgcctccaccaatagcagcacctgcacctgaacctatcaagcttcattctacacctgaaaaagaggatgagctagctgcacaaaagagaaagcttcctaatcatgagggagctaacaaaaattttcatgcaggtggaccttcttctagtagttttgacttgtag

SEQ ID NO: 45406 - DNA, 205 bp, Glycine max
  Peptide Sequence Number=SeqID_137091
atccgacgacgagtccctcaaaggtactaatactcgaaacccggccatcaatttcgagcaagaagctggtcggatggagagtgaagaggacaaggatgtgggacttcccccagagctagagaggataatcgctcaggaggaccaagagatgaggcctcatcaagaagagacagaactcgtagacttaggaaccggcagtgggtaa

SEQ ID NO: 45407 - DNA, 66 bp, Glycine max
  Peptide Sequence Number=SeqID_137092
atgggtgccaagtacctcgaagtggtgttcttggctgataggatgatgggtaatgagaagagctga

SEQ ID NO: 45408 - DNA, 120 bp, Glycine max
  Peptide Sequence Number=SeqID_137093
atggatgtcaagtacctcgaagtggtcaaacgagggttgcatcccaacaacggatggtccccggacgaaattagggttctatcatttctcagtcataatcttcttgtgttgaacctttag

SEQ ID NO: 45409 - DNA, 516 bp, Glycine max
  Peptide Sequence Number=SeqID_137094
atggctgctagtgaccacgcaattttgcgtgatagagcacacatcccaaccaaaagaagcctgctagagctttcatcacaggatgcattgttggcacaaaacaagttgttgtccaagcaacttgaggcaatgacagaaacattgagttgtgctatatgtggtggagctcacgaatctggctgttgtatttccactaaagatacaacacatgaaggaaaatggagaactcaccctggcaatcagttcaataaagaccagggtggaccatctaacaggccacaacaacaagggcctagtctctatgatagaacaacaaagttggaagagactcttgctcagttcatgcaagtatccatgtccaatcaaaagagcaccgagtcaaccatcaagaatctagaagtccaggtgggacaattggcaaaacaactggcagacttaccgtcaagaagctttggagccaacacagagaagaatcctaaggaggagtgcaaggctgttatgactagaagtaaaatg

SEQ ID NO: 45410 - DNA, 429 bp, Glycine max
  Peptide Sequence Number=SeqID_137095
atggagctaatagagaacatggcggccagtgatcacaccatccttcatgatcgagcatacgcgccaaaaaagaggagccttctggaactcacagcccaagatgcaatgctggcccaaaacaagctattggcccgacagatagaggccctaacggagaccctcaacaagctccctcaacaactacaagcgtggagcacacgagctagggtaatgcatagcccaagaggattcttccagggagatgaactacatgggagcttagaatcaccaaggattccaaggctacaaccaaggaggaccatcgggattcaaccaagggaggaatttcacacaaggcttaagctggaggaatcatctggggaaccagttcagcaaggagcaaagaagtcaacctgtccagaattccaaccaaggggtcgatctttatga

SEQ ID NO: 45411 - DNA, 801 bp, Glycine max
  Peptide Sequence Number=SeqID_137096
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaggccttggcaaatcaaggtgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgactggggatgtgaaaagagcggcgcaagaattgaaggaagaatcaggattctatcttcatgcgaaggatgtcccatgaggggagtgccatcagacgaaagcatcacgcctttcatcgcacgaggtttcagtgaccacaacgcgagggacagagagcttaggggaagcagtaatgggatcatcggcggctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagttgaagagaagttcaagtccatagccatcaaa

SEQ ID NO: 45412 - DNA, 1017 bp, Glycine max
  Peptide Sequence Number=SeqID_137097
atggccccgaggaagcttgcctcaaagaggtccaggaaggacaaggcagccgaaggaactagttccgctccggagtatgacagtcaccgctttaggagcgctgtacaccagcagcgctttgaggccatcaagggatggtcatttctccgggagcgacgcgtccagctcagggatgacgagtatactgatttccaggaggaaatagggcgccgacggtgggtaccactggttactcctatggccaagtttgatccagaaatagtccttgaattttatgccaatgcttggccgacagaggagggcgtgcatgacatgagatcctgggtaaggggtcagtggatcccgtttgatgccgacgctatcggccaactcctaggatatccgttggtgttggaagagggccaggaatgtgagtatggccagaggaggaaccggtttgatgggtttgatgaggaggccatcgcccagctgctatgtatggcgcccactaggcaccctttggacccagataagtccaatagggccctgggattccccgcactgatcacaggactctgccagtcgttcggagtccccgttgcacctaccaaggtgattcggccgcccatcacccgggcttttatcgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 45413 - DNA, 567 bp, Glycine max
  Peptide Sequence Number=SeqID_137098
atgatcatgaggggtcaagacatttatagtagtcaagaggagactacttcttgcccctcctctagtggaagtgaagatgaagtaaggggtgaagagtctagtgaggaagtctacccccacgaagaaggtgacctcttaatggtggccaaagatcaactaactatgaaagataagagggatgaggaagaaaaactagaaaaacaaaagaaaaagaaggatagtaaggccttgccttcaaaggccaaggggaaggaaaaagaggaaaaggattcgtccaagaagattgttaagaaggaaaatcattttgcaacaaaaggtgatattaaaatagtactccttcttaaacaatctttctaccttctcctatcaagggaaacatcccttagcaccaccatacctcttgagcttgaggttattcctcaagtaaaggagttgttggatgagggtttggttcgcaagagcttaaatccttgtgctttgttggtgcttacaataggtattattaggcaccaaatccctatgataggtggtatgatgaatgtgttgagtggtgcaacactcttttga

SEQ ID NO: 45414 - DNA, 690 bp, Glycine max
  Peptide Sequence Number=SeqID_137099
atgttcttatgcatacctggccgagggttcatcttgaactcagagggccatcctggtaagattcttaggaaggatatgactacactagctcaggtgtggagtgtcctctcatactccaacttggcccctacatcacatacttctgaattgacagtggatagagctaggctgatctttggcctagtctcttgcttggatatgaacataggagcactgatctctagccagatgacctctatagcccagtctaacacttctagacttgggttccctgctctaatcatcgcattatgtagagccacaggggttgtctctgataacctcacttttgagcgcttgagcctggtggtggcacctccaggatctattccttcagttgagcagttcagggagatggtagtctggcccgggacccaaccttctcttcacagggaagatgaaggtcccacagcccaggtacctcagcatgtggaggatgagtcgtctgaggccaccatcccagagccatttgttataggagaagaggctaaggagacacatatgagacaggtagctgctgccacacttgagcgatcccttgaggctactttagagccttctgcacaaggggaggacataccctcacctcagcctgcagcagacccctccactcctattctagagatgccagaggacttggggatcctctag

SEQ ID NO: 45415 - DNA, 627 bp, Glycine max
  Peptide Sequence Number=SeqID_137100
atgaagcacttcactgacaccctcatcagtgccaacataggaacaaaagctggtaccgggccccccctcgaggtcgacggtatcgataagcttgatgcgccgcagcgtttttcattgggcggtcggtgcactggctggcctggccctggcgcctgcagcctttgcgcaagccccggcttaccccagcaagcccatcaccatcgtggtgggttacccaccgggcggcagcacggacctgatgggccgcatggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 45416 - DNA, 543 bp, Glycine max
  Peptide Sequence Number=SeqID_137101
atgcttaacatatttttgaagacccctgttgttgtggaagagggtgaaacactttgtgcatattccagatttgcactcctgaggcctaatcctcaggagttggctgctaagctctatatcctagggaggggattcgagcttaatgctgacgggcagcccttgaagattttgaggaagaacatgaccaccctagctcagacatggagcgttctttctttttctaacttgattcccacctcccacacttctgatgtcactcttgacagggccagactcatctatggcattattatgaagatggatatgaatgtgggtgtcgcaacgtgccctttcgcgggcgagcgagggcgaggctcacgagtgcgctttccaaaggaggaaaggtgcgcggagtcgccaccaatgtttatttgtggaaaacgtcgggaaaatcgaaggaaaccggtcaaaatgaaaattctaagttcgggagttgtatttacgtttgaggaaggtattagcaactctcacgtttgtctcaaaggacaacagcctattttttag

SEQ ID NO: 45417 - DNA, 836 bp, Glycine max
  Peptide Sequence Number=SeqID_137102
gatgccctgaacgggcaatcgcgcaggttggtggcgagtccgttcgactgcatgctgctggacggaccgattcagtgttatgggccagtgaagtggctgacgattttcatgcccgatttagcgctcgtgcccgcagttatcaatacgtactgttcaaccatgcagtggcgccagccagccagcatggccgtgtcggctggtatcatcgaccactcaatattgacctgatgcagcaggcgattcaaatactggtaggcgagcatgatttcagtgctttccgtgccagtgagtgccaggccagtagcccgatacgtactatgcaacgtgccgagattgttcagcatgacaggtactttattttcagtttcaaggccaatgcgtttctgcagcaccagattcgcaacatggttggtgccctggtttatgtggggcagggcaagctgagtgtcactgggtttgctgagttgcttgagcataaggacaggcgactttctccacccacctttatgccagatggtttatattttaccggtgttgattatgacgcaagctggcaattaccgctttcaatagatgcaggtgcagatgcgttaggatttgtcttttatgcaccgagtccgcgggcggtgacagcgacggcagcgcaagcaatcacggccgtgttgccaccttttgtctctaaggtgggtttatttgtaaatgctgaagccagtgaagtgcgagaggctattgctaacgcccgcctggattgtttgcagtttcatggggatgaatcagcggactattgtacgcaatttaatctgccatattacaaagcaatccgcgtcaaaccgggg

SEQ ID NO: 45418 - DNA, 392 bp, Glycine max
  Peptide Sequence Number=SeqID_137103
atgcagtcgagtgatagaagcccaagtaagcctaaacctttggtgatccatttcaccagggatattactactcatatacctcgaggtttccagccctctatagcaaagacgccaacacctttcccttatacgagtgacaaggcagtaccatggaagtatggcgtacaggggcttggcggaaggaaggacacgtccgtcatacgtgttgggaatggcatgccggctactaagatcacaaatatttctggtacgatcagcatgactcatagtggacgtattttcactccttctgaactaccggcaaggtcgaaagacaaggggaagacaaaggcagatataggtgagagggagaggacgggccttaccgcgaatgatgaggcccttgttggaaa

SEQ ID NO: 45419 - DNA, 402 bp, Glycine max
  Peptide Sequence Number=SeqID_137104
atggtgaaagttggaacctcttacgtgccgatcaacgtctcattttcgccaaaagttggcccagggcgtttccgtatcaacggacaccgttttactgtctgcctctgtgtgtctgtcgacctgtcctcctgttcagctactgacggggaatgtgttatccgtaacggcaaaagcaccagccggacatcagcgcgcaagtgtaaagcctggggtctaagacgtgacgctcgggaccatgtcaggtgcgcaactgcattgggaatcggccacgcgatcgggtgtttcccagtgaacgtgcttctgtggcaggagaaaaaagcgacggccagtgaatatgtgagaatacgactcactgatagtggtcgaattggagctgccaccgcggaatggcggccgctctag

SEQ ID NO: 45420 - DNA, 114 bp, Glycine max
  Peptide Sequence Number=SeqID_137105
atggtgtggcatctcctctcaactcctcttcttctccattccgctgccattgatattcaagaagcaaaggactcctttgatgaagaagatccaaggcctacaagctttacatag

SEQ ID NO: 45421 - DNA, 510 bp, Glycine max
  Peptide Sequence Number=SeqID_137106
atgttggtgcgcatgatccacactcggctctttgcagtggcacgggtgaaaccttgccccggtatgcacagtagttgcgcgatagccttcctctggttgtgctcgcacagttggccctcctttgagatcaaggggtggcccgggaaaaagaatggtcgaagggaaattacagggcagaggaccttaaatcctcttaaggtgtggatatggagcccactgaaagtgaggacgcgtagccctcaaaagacgagggagagcgcagccctccgaagggggacgtgtagtcctctgaaggcgagggcgtgtagtcctctgaaggtgagggcgtgtagccctttgaaggtgagggtgtgtagccctttgaaggcaaggacaggtagtcctctaaaggtgagggcatgcaaccctttgaaggcgaggacgtgtagtcctctgaaggtgaggacgtgtagtcctctgaaggtgagggtgtgcaaccctctgatggcgaggaagtgtagtcctctgaag

SEQ ID NO: 45422 - DNA, 237 bp, Glycine max
  Peptide Sequence Number=SeqID_137107
atgtcgggtttggtttggctcaaggataaaagggatgccccacactatttccatgacacaaatgcaaaaatgatgatttggaaattttatgcaaaactggccacgcatgcacctatgtggacactcaagtgtcaaattttttggaaactactgggaaaaatcttcgaagaaatctacccttcagtgtatcatccacagatgcgaggtattttgctaaaaccaaaatgtgctagccag

SEQ ID NO: 45423 - DNA, 387 bp, Glycine max
  Peptide Sequence Number=SeqID_137108
tattgcacacctaggcaggcgcagggtgatgcacctcaggccatagacgcaccgccaccacctcatcaggctgatcctgctgggtcactaggcatggagcattatcttcagcacttggttcgccagcaggcggccaaccaccgagggcaggtgcagatacatgagtgtatctaccagctcagccttagtcagcaggggaagggttttgctccttttgcgtgccctactctagagcagtttagggctgaggtcgcatggcccggagattggcccgaggcccaggtaggggaggcgcctgcaggagctcccggcgatgtagaggaggcccgtatgggtgaggagatgacagacttgcttggtttcttaggaggaagcggagccacatga

SEQ ID NO: 45424 - DNA, 255 bp, Glycine max
  Peptide Sequence Number=SeqID_137109
atgacaataatgttggtgtcgacaacaatggtgataacgataatcatgttggtgatgataacaatggtaacaacgacaacaataatggttatgttggtggcgacaatgatggtgataacaactatcataatggtgatggttgtgggcacctgtacatggatgagagtactgttaaataataccacgttaatgcacttattgtcgtttaataagcaatgtctcgtggttgggcttggagatcaatggcttgattaa

SEQ ID NO: 45425 - DNA, 692 bp, Glycine max
  Peptide Sequence Number=SeqID_137110
atggaaacctcattgcctttagccacggatagcttctcatatagttggttaccaaattacaaaccccttgcaaatgaccttaaggagcctctaagagaacccacttacaatttttgtgatggcacaatcaattatccatttatggaagattggcaaaacttcaattttgatatttccatcactcagtcccctgctgttttttctcatgctgatgaacttttctctaatggccttatcaaaccactatttgttggtccttccaaggtagagttttgcaataccaccacagattccacacaatccaagcctgtttcttctagaaatgtttctccaagaactgtgcaaattcatcatggtttcctcacaaagtggaaaacctctacatgtagaaccttgagaagcctttcaaggtatgtcaaccaactatgccagaaagttggaagctcaaggaaaagtactaaagttgatgattttgataaagaagagtggctagttaataatagctggagcagctcacagcaaccatctccaaaatcaaacactgtcaatcatattggtgctttgcttgattatgagaactcaatctatgaagcagtcctccattgcaaaagatcaatagcatttacttcagtaagagctaccactaagaatactgttgtggctaacaaagaataccaaatgaccctctcaag

SEQ ID NO: 45426 - DNA, 594 bp, Glycine max
  Peptide Sequence Number=SeqID_137111
atggttctaatgctgcaaaattgcaatctactggggccagaatggcaactaggcacgctggacgaggcttgtgccacagggaactatgactatgtgatcatagcctttttgccaacccttggcgatggccaaactcctatgattaaccttgcaggccattgtgatccatacagtaaaggatgcactggcttaagctcggacattgagtcctgccaagccaaaggcatcaaggtgttgctctctttaggaggaggtgcaggaagctactcaattgcatcaactcaagatgcaagccaattgtcttctcgtcctcttggccccgccattctagatgacatcgactttgacattgaggatggatcaaaccagcactggggtgatcttgccaagttccttaaagggtatggcatggccaagcaaggcaagcaagcgttcataactgcagcacctcagtgcccatttcctgatgcttggattggaaatgccctcacaacaggcctttttgacattgtttgtgtccaattctacaacaaccctccttgccaatacaattctggggcaattagtcccttgaagatgcatggaagcaggtag

SEQ ID NO: 45427 - DNA, 231 bp, Glycine max
  Peptide Sequence Number=SeqID_137112
atggatggcttagcctcaaagcctggtatcacagcaagagttggcctctctcctgcatctgctactgctactgctactgctactgcaaatgggctatctccaggaggagctccatcatcagctcccaggaatgctgcatcagcattgatcaccttttcagggcctatccctgtgggttgggccaaattgacagctctacctaaaaggatggttgaggaagttttagcttga

SEQ ID NO: 45428 - DNA, 636 bp, Glycine max
  Peptide Sequence Number=SeqID_137113
atgacggaatgtgttcggctatttgaccatccgataatcaaagttcatattttggtgcttagtggtgtggatatatgtgtgtcttggatcattcgaccaatcaaatacccaaacattttccaatacgagattaaggctttgcttggtgcacaactattcgattacccaaatatccttcaggaatcgggatggcctattctcaggcgatgggaggtgccttggcaatggcaaacagtttcactgacctctcttgcctgtggattgggttttgtgttgacaggtttgactgaagcaattgccttaccatatctcgggatcaaacctgatgtgctaagtttagatgacaaggcagagatacttttattcgatcagagcatcacaactgctgttgtacttggaatcatatatagtgttgccaacactttccagccacttcctgaagacttcttcaaatacgatttgagggaacctttcaatcttcaaaagggttggcttttgtgggctggaattggacttgctggtgccatacttgccatttcattgaccggagttgctgtgtctttcttcaatggagaaaccccacaaagagaggttcatgttctatttttgaaattttacaggaagatgcagatgtaa

SEQ ID NO: 45429 - DNA, 108 bp, Glycine max
  Peptide Sequence Number=SeqID_137114
atggtgaagatgaagatatgtttcagtgtggagacaattgaagactctatttttagtgaatgtgaagttgttaaggtctcctttgctaaaggggaaggtgaaagatag

SEQ ID NO: 45430 - DNA, 3696 bp, Glycine max
  Peptide Sequence Number=SeqID_137115
atgacacagcaatcatgttcctcttcttccacatgtgagtggacttatgatgtgttcctcagtttcagaggcgatgatactcgaagtggtttcactggaagcctttacaagtctctttgtgaccagggaatccacaccttcatggatgatgaggggctcagaagaggggaagagattagacatgctcttttcaaggcaattcagcagtcaagaattgccattgttgttttctctgaaaactatgcttcctcaacttactgtcttgaagagcttgtcatgatccttgagtgcataatgaagaagggtcgcttggtttggccggttttttacggggtgactccgtcttatgtgcgacatcagaaaggttcttatgggaaagcattggacaagcttggagaaagatttaagaatgataaggagaagctgcaaaagtggaagcttgctcttcaagaagcagctaatttgtctggttcacatttcaaactcaaacatgggtatgaacatgaagttattcagaaaattgttgaagaggtgtccagaaagataaatcgtagccctttacatgtggctaattatccaattggattggagtctagagtgcaagaggtgaactcacttttggatgttggatccaatcaaggagtaagcatggtggggatttatggaattgggggaatagggaagaccgctattgcttgtgcagtgtacaatttgattgctgatcaatttgaaggtcagtgtttccttggtgatatcagagaaaaatcaaagcatggcttagtagagcttcaggaaacaatactttctgaaatggttggggagaagagtatcaagttggggagtactaatagggggaaggcagtattgaaaagcaagcttcaacgaaagaaagttcttttgattcttgatgatgttgatagattagagcaattaaaggcacttgctggtgatccttcctggtttggtcatggcagcagaatcattgtcacgacaacggataagcatttgttacgtgtacatggtgttgaaagaaggtacgaagcaaaaggattggatgataaagaagctcttgagttgtttagttggcatgcttttaaaagcaatgaggttagtccaagttacatggatatctctaagcgtgcagtactttattccaatggccttccattggctttggaaataataggttctaacttaaatggtaaaacaatgcctgaatggcaagcagcattggataccattgaaagaaatccagatgaagatattcaggaaaaactaaaagttggctatgatggtttgaaaagaaatgagaaggaagttttccttgacatcgcttgtttctttagaggctccgatttgaaagatgtcacaagtttattgttccaaggtcgtggtttctctcccgagtatgttattcgagtgttgatcgataaatctctcataaagattgataaatacggttttgtgagaatgcataacttggtagagaacatgggtagagaaattgttaagcaggaatcaccatcagaacctggaaaacgcagtagattatggctttatgaggatattgttgatgttttagaaaatgacaagggaactgatacaattgaagtaatcatgctacactcgccaaagaataaagaagtacaatggaatggaagtgagctcaagaagatgacaaacctaaaattactatctattgaaaatgctcacttttctagaggccctgtgcatctcccaaatagtttgagagtactaaaatggtggggatatccttcaccgtctttgccacctgaatttgattcaaggagacttgttatgttagacttgtccaatagttgcaatataatgggcaaacaactcaaattcatgaagttcgagtctttgagcgaaatggttttaagaggttgcagattcataaaacaaacacctgacatgtctggagcacaaaatttaaagaagctgtgtcttgataactgcaagaatttagtagaagttcatgattcaatcgggcttcttgacaaaattacatggttcactgctgttggatgcaccaatctaaggattcttccccgtagcttcaagttaacatcacttgaacatctgtctttcaaaaaatgctcaaatctccagtgtttgccaaatatattagaggaaatgaaacatgtaaaaaaacttgatctgtgtggaactgctattgaagaattgccattttcttttaggaaacttacagggcttaaatatctagtgctggacaagtgcaagatgcttaatcagatcccaataagcattctgatgttaccgaaacttgagaaattgacagccataaaatgtggacggtatgcaaatttgatccttggtaaaagtgaaggacaagtaagattgagttcatctgagtctttgagagatgttagattaaactacaatgatttggcacctgccagcttccccaatgtggaatttttagtgctaactggcagtgctttcaaagtccttccccaatgcatcagccaatgtcgctttctcaagaatctagttttggacaattgcaaggagcttcaagaaatcagaggggttcctccaaagataaaatatctctcagcaataaactgcacatcattgtctcatgagtctcaaagcatgttattgaatcagagattacacgagggtggtggcacagatttttcccttccaggaacaaggataccggaatggttcgaccattgtactacaggaccattgctgtctttctggtttcgtaacaaatttccaaggatggctctagctgttgttggagttttggacaagcagggaagctttcccatgtcaagattccacttgctcattaatggcattcaaaagctgcattgccttttcaccgcacaatcaaaactaaccacgtatcatatattcctgtccgatgtgcagctgaaatcctacaatggcgaattgcaaagtgtgtatggggaggatgggtggaaccatgttgagatttcatatgtgagaccaagtgcctttccacattcatgcagagccaagagaggaaccatcaaattgatgggggttcatgtttacaagcaaaaaacaagcatggagggtgtccggttcacgaatccttggtctccaaagagatcatacagcgaagtttccaagcctagtttgaaagaaaattttcagtcactggccaaaagaagccgtggatcacaaggcatggaaatttgtgaggcaccacgcatgaagcagcatgaagtgaatagtggttatcacagtgtatcacagagactatggttagaaatttgcagcattgtagctcctgcagatgttaaagtcctaatgtggagcatttgccaaaatgctttgccaacttttgaatatcttttcaggaggaagcttgtaaatagtccactctgccccatttgtggaacagaacctgaaaccgtcgaacacgcgttcctgttttgtccgtggacacgacccctttggtttggaagtgatttccagtggtgcattgatgccaaaacagttcaaagctttcaactttggctttggcagaaactagtggagattcaaagggtatatcaagaaaatgccaaccaagtatctgctcaggtgggaagtatttgttgggctatttggaaaggaaggaatgaatttattcttgaaggaaaacctgtcaatccattgattttaaggtaa

SEQ ID NO: 45431 - DNA, 405 bp, Glycine max
  Peptide Sequence Number=SeqID_137116
atgaagaataagaaggttgcagaagttggtgtctcgctaagcgagccatatgcacttagcgagcaacatctgctaagcgagggaggaggaagtgcggacaaggttatggaggtaaccaaaagcggcgttcgaaggcgaactggcgttgggaataagggattcggattggaagtggtggccgagactgtggaggagggcgacgagttcgatgacagtggtggggttccaagtgaaccatgggacttggctgattcctgtgtaaagctaggaggcgaggggagagaggtggggataagaggtggaaggggagaggagtcaacgtttgagactaatggtcaatgtccaattggggcgtccaagaccaaaattgcaggaatttataaaattggaggaccaaaattgtga

SEQ ID NO: 45432 - DNA, 924 bp, Glycine max
  Peptide Sequence Number=SeqID_137117
gatctacatcgaactgaagcatctattgttgaaaggtgtgttgcaaaagaaactattgagttttgtttagagtacattgaaaaggcaaaacctattaggattcccgagtctcgacatgacaaaagaaagggagatccttgtgaagaaaggtggttagtggttctacacgaaaaaaccattggtgttaatgttgaagatgatgattcaaccgttgatacttatgttagtccttcctccacacaaatgccgcctaacatcaacggagaagaagaagttgacgaccacatagctacaccacccatctcccctcttcttcctcctgagtcattaacaccttcgccatctacgtcgaaaaagacaagaaaagtaacacgactcagatcattggctaccagacctgttggggcggagagatcagtggtttatgtgaatcctgctactgggaaaattgatggtccccacaaaaataaattaaggacgtatttgaggatcgtcgctcgagacaagattggatttgatattcttaaagcattcaatcataagatgaagaaaaaaatccttcaaaccgtaagaaatcaatataggcagtttaagttagatttgaccttcaaatgggctctgacagatgacaaagagggcgagaatgataaagtatgtgaaaagtatgacggactcgcactgtctcctgagcttgaggttggtttttctggtactcttgccagaacaaagggaagttgtgtcaatccctcgaggcaggacccagacacagtttatgaggggttgacgaccacccacaatgtccctttgggcaatgatcaagtgaagatcggtgttgagaaagctcgagatgctgattctcgtgttcttgtacccactcaagaggttcagttaatgaggcaaacacttaataccttccttgcttga

SEQ ID NO: 45433 - DNA, 1620 bp, Glycine max
  Peptide Sequence Number=SeqID_137118
atggagaaaaataagaaaagaaggctcaaaacaccagcccagcttaaggccttggaagatttttataatgataacaaatatcccacggaggaaatgaaatcagaacttgccgatgagttagaattgacagaaaagcaaatatctggatggttttgccacagaagattgaaagataaaaaaatgttgaatgatgaagtatgtgctaatggacgacaagatcgttcaagtggtgtcattcaggatcgtggcagtggtctagtgcaggattcatgcggaagcactaaacatgttcactataggtatctggatcccaaagaggttgagagtcatggcctctataaccatggattttcagctgcagatataacctatggacacaaaaaccatcgttatgcagaaaatgatagtgcaacagataacacatcatctgagagtagctcatctttgcaagatcgattgctttgtcaaggacaggatccgtatgatatggagccttctagtcatgtaacacctaatggatctcttctgcctcccaataccaagggtgcaaataacatgggacataaaccatcaggatatttgaaagtgaagggagagatagagcatgctgctattactgctgttaaaaagcaattaggaaagcattatcgggaagatggtccactacttagtgttgaatttgatacaattcctcctgaggcatttgaatttatccgatttttccaaggctcactaggtttgcagatgctttgggttgaaggaatattgttggtcacatcagaagcatactatgctgcaaatcctgctcttccaaattctccagaagtctctgcagtgaaaaaacagtccagtctcagttctagatatgattcatattttaccaaaatcagttcccaagattcacaaatggtcagaggtgactttggctccttgcatgattctgatttccagtataagaaatcccaccatgatataaatcaaaggagaaattttcagagttttaccaatcctttgcctcacaagaactcttgcctggatttcaatgcagactctactggggaagcatctgcttataataacactaaaaattgtagaaagggtactaagcatggttttgatgggacgagatatgactctggttctaaccccagtgatcactatgaagagaataacctagtggttaaccagacagattctctgctacatggctatgaaaacagcaacctgaagaatgtacaaaggggtgaatatgtgaaatctaaaccttcaaattcagtacataagtctcaagtttacttggatactggagaaagaagagggcttaataaaaggatggcaaaggaagagaagtttgatggggatagaaagataaaaaaacaatatcgtgatccagatgaagttagggtgcttacaaatgaaatgacggttgcaaagtgggctaaagttgatccacttgaacaatatgatgttaaacaatcatctgttgctgagttggaaccaagaaaaagtcaaagaagaaataatcaattattttataaaagtgctttcaggtctgctgcagagatgccatctagctttagtgaggatgaaactgctgaaaccagttcctcagcggattaa

SEQ ID NO: 45434 - DNA, 279 bp, Glycine max
  Peptide Sequence Number=SeqID_137119
atggctattgctgcagttattggactcagtggaggaaagagactcttgagttcatcataccattactttgatattatagaaaaggatatcagaagagagcttggaatggaaataattgaggaacatatggtgatggaatattctaaggtcaacaagaaatgtgaaaaatgtggccatggggaagctacctattatactagactgatgagatcagcagacaaagggcaaactactttctacacatgtatcggctatggtcatccgtctcaggagaattag

SEQ ID NO: 45435 - DNA, 648 bp, Glycine max
  Peptide Sequence Number=SeqID_137120
atgcagctgcctcaccaatccaacatcatcaccacacgcagtgatcacgcccgacaatgtaaacccgtcaagccccaaacgaagctctctaacttcctcaaagagcctcaacgtgggcccacactcacccctatcagcataagcagctataagggtgttgtaagagacaatgtctggttggggaatttcatcgaacacccggcgggcaatgtggataagggagtgtttggcataggcattgatgagggtgttgtaggagaagacattggggtattgggtgaggtggaaggaagtttgggcattgtggagggagccacatttggagtagaggagggtgaagtggttggagaggtaggtggagggtgggatgagggacttgaagtaaagggcatggaggattttgccagttatgagatccctttgggctatgcaggctttgagaaggttgcggaaggtttgaagttgaagtggaacccttgcattgatctgacgggtattgcttttgttggagagagcggaagagaaaacccacgctggagaagatccgcttggaagttggaagcgacctcggttcgcaccacccacctctcagaaaaacctaaccctaaccctaccgttagttctctgttctttgtcgttcttgtgtga

SEQ ID NO: 45436 - DNA, 714 bp, Glycine max
  Peptide Sequence Number=SeqID_137121
atggaacgaagtggcggaatggtaactgggtcgcatgaaaggaacgaacttgttagagttagacacggctctgatagtagggtgcgaattgagaagtgtgtcattgaaatagtgcggcttagtctttggaagaggccattagcacttggaagaattgtgatttctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggagggagatgatgatgatgaagacgatgctgatgatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccagttcccgtaagagttttagacctatcaaagaacttaaaattcttacttcaattcctttaa

SEQ ID NO: 45437 - DNA, 2880 bp, Glycine max
  Peptide Sequence Number=SeqID_137122
atgacttctatccttgacactcttcttctaaataaaaagttgaatttcagcacagggtatgtggggcctgtgcattatccatgctttgagcctgaaggacttttgcgtggggtagatgaatctgttttgatatggttctcagggaaagaagagaagcgccttaaactaactaatgtttctaggattatatctggacaacgcacgccaatctttcaaagatatccgcggcctgagaaggagtaccagtcgttttctctcatttacaatgatagatcattagacttgatttgtaaggataaagatgaagctgaggtttggttcagtggattgaaagcgttaatttctcgcggccatcactggaagtggagaccagagtcaagaactgatggtattccgtctgaagctaatagtcctcgaacatacactagaagaagttctcccttgaattctccatttggtagtaatgaaagcttgcaaaagttaaagatgtttattaagaggattttcattttccatgttcaggatagtggggatcatcttcgccttcatagcccatatgaaagcccccctaagaatggtttggataaagcattttctgatgtggtttattatcctattcctccaatgggtttcttccctccagattctgccagtggttcggtccactctgtgtcatcaggaggatcagatagcatgcatggtcaaatgaagacaatgcctatggatgcttttagagttagtctatcaagtgctgttagctcatctagccaaggttctggtcatgatgatggtgatgccttaggggatgttttcatttggggggaaggcacaggtgatggtgtactcggtggtggggctcaccatgttgggagtaattttggtgtcaaaatggactctctgttgcccaaagccttggaatcagcagtagttcttgatgtacagaatattgcttgtggtggggaacatgctgccatggtgaccaaacaaggtgaagttttttcctgggggggagaatcaggaggaaggcttggacatggagttgattctgatgttccccatccaaagcttattgaatctctaagtaatacaaatattgaacttgtagcttgtggggagtatcatacatgtgctgtgacactttctggtgatctttatacatggggtgatggcacttacaattatggtcttctggggcatggaaatcaggtgagccactgggtcccaaaaagagtaaatggccctttggagggcatacatgtttcatctatttcttgtggtccatggcacactgctgttgttacctcttcggggcaattatttacttttggtgatggtacatttggtgttcttggtcatggagaccgaaaaagtgtttccttgcctagggaaatagagtccctgaaaggtcttcgtactgtgcaggctgcttgtggtgtttggcatactgctgctgttgtggaggtcatggttggaaattcaagttccagcaactgctcttcagggaagctgtttacatggggcgatggagacaaaggtcgacttggacatggtgacaaggaatcaaaacttgttcccacccgtgttgtgactcttgatgaacctaatttttgtcaagttgcttgtggtcatagtatgactgtagcactttctagattaggccatgtctatacaatgggcagttgtgtctatggccatttgggaaatactcaagctgatgggaagctaccaacccctgtcgaaggaaagctttcaaagagttttgtggaggagatagcttgtggtgcatatcatgttgcagttttaacttcaaggactgaagttttcacatgggggaagggtgcaaatggttgtttaggccatggggatactaatgatagaaacaccccaacattagtagaagcgctgaaagacaaacaagtaaaaagtattgcttgtggtacaaatttcactgcagctatatgcctgcataagtgggtatctggtgttgaccagtccatgtgttctggctgccgtgtgccattcaacttcaaaaggaaacgccacaattgttataattgtggacttgctttttgtcattcatgcagtaataagaaatctgttaaggcttcaatggcaccaaaccccaacaaaccttatcgtgtctgtgataattgttttaataaaataaggaaaactacagaaaccgattcttcatctcaggcttctatgagcagaagaggaagtgttaatcaggggtcacttgagtttaatggtaaggatgataaattggattccagatctcataatcaacttgccaggttttcttcaatggaatccttgaaacaagtggacagcagatcttcaaagaaaaacaaaaaattggaattcaacagtagccgtgtctcacctgctccaaatggtggttcacagtggggagcaatgaatatttctaaatcttttaatcctgtttttggatcatcgaagaaatttttttcagcttctgttcctgggtctagaattgtttcccgggcaacatccccaatatctagacgacctagtccaccccgttcaactactccaaccccaacactggggggactttcatcgccaaagatagttgtggatgatgctaagagaatcaatgataacctcagtcaggaggttgttaaattaagatcacaggtggaaaacctgactcggaaagcccagcttcaagaagttgagttggaaagaacaactaaacagttaaaagaagcaatagcaattgcaagcgaagaaactgccaaatgcaaagcagcaaaggaagtgatcaagtcactcactgcccaggtagaaacccttacccctctagccatttttcgaaactatattcctatgacagctaaaagttctcactcatga

SEQ ID NO: 45438 - DNA, 1572 bp, Glycine max
  Peptide Sequence Number=SeqID_137123
atgggggagggtgggggtagggatgaggtttcgtggaatgcaatgatcgtggcatgtgggcagcaccgggagggaatggaggcagtggggttgtttagggagatggtcaggaggggtttgaaggttgatatgtttaccatggcgagtgttttgactgcgtttacttgtgttaaggatttggttggggggaggcagtttcatgggatgatgattaagagtgggttccatgggaattcacatgttgggagtgggttgattgatttgtattccaagtgtgctggcagtatggtggaatgtaggaaggtgtttgaggagattactgcaccggatttggttctttggaacacgatgatttctggattttcactgtatgaggacttgtctgaagatggtctttggtgtttccgggagatgcagcgcaatggttttcgtccagatgattgtagtttcgtgtgtgtgactagtgcttgttctaatttgtcatccccttctctgggaaagcaggtgcatgcattggctatcaaatctgacgttccttacaatcgtgtttcagtgaataatgctcttgttgctatgtattccaaatgtggaaatgttcatgatgcaagaagggtttttgataccatgccagagcataacacggtgtcgctgaattcaatgattgcaggctatgcacaacatggtgttgaggttgaatcgctcaggctttttgaactgatgctggagaaagatatagcacctaacagcataactttcatagctgttctttctgcatgtgtacacactggaaaagttgaggagggtcagaaatatttcaatatgatgaaagaaaggttttgtattgaaccagaagctgaacattattcgtgcatgatagatcttttgggtcgggctggcaaactcaaggaggctgagaggattattgagacaatgccatttaatcctggttctattgaatgggctactttgcttggtgcgtgtaggaagcatggaaatgtggagctagctgtgaaagcggccaatgagttcctccggctggaaccttataacgctgctccgtacgtaatgctatcaaatatgtatgccagcgctgccagatgggaagaggctgcaacagttaaaaggctgatgcgggaaagaggagtgaagaagaaaccaggttgtagttggattgagatagacaagaaggtgcatgtctttgtggctgaagacacttcacatccaatgataaaagagattcatgtgtacatggggaagatgttaaagaaaatgaagcaagcagggtatgtaccagatataagatgggcattggtgaaagatgaagaggtagagccagatgaaagagaaagaaggttattgtatcacagtgagaagctagcagttgcattcggtttgatctccactgaagaaggggtgcctatactggttgtaaagaacctaagaatttgtggtgattgccacaatgccgtcaaacttatttcagccctcactggcagggaaatcactgttagagatacccacaggtttcattgctttaaggaagggcactgttcatgcagggactattggtga

SEQ ID NO: 45439 - DNA, 1197 bp, Glycine max
  Peptide Sequence Number=SeqID_137124
atgcttctcccacccttcctcactctcactttcctcctccttttcttcaatgcttccgtcgctgcgatttactcaacgacaacatgttccaacatagtgtcgctgagatatcgcagcgacagaatttccgtaacggactttggaggtgtcggcgacggccgcacgctgaacacgaaagcgttcagggcggccgtataccgcattcagcaccttagaaggcgcggtggcacggtgctttacgtgcctcccggggtgtacttaacggagagcttcaacctcactagccatatgaccctttatcttgctgctggtgccgttatcaaagccacgcaggagttggggaattggcctttaattgcacccttaccatcttatggaagaggaagggagctccctggaggaagcaatgttgtggttcgatatgtcacaattttggcccctcgtgactctcctaatactgatggaattgatccagagaactgtatctcatcttttattggagccaaactgttcaagggaagtattgagattactatcgccgactccactagtgctatcatgctatattcaagttcaaatgtctgcatagaagactcatacatatctaccggagatgatcttgtggcagtgaagagtgggtgggatgagtatggtattgcctatggtcgccctagctacggtatcaccatccgacgcttaacagggtcatctccattcgctggcattgcaattggcagtgaaacctctggaggggtggagaatgtgctagctgaacacatcaacctcttcaacatgggagttggtatccacatcaagaccaacagtggcaggggagggctcatcaagaacatcacagtggctcatgtgtatgtggagaatgcaaggcagggaataaaaatagcaggtgacgtaggggggcatccagatgaaaaatttaaccctaatgctctcccagttgtgaagggtatcacaattaagaatgtttggggagtgagggttaaccaggcaggtttgatacatggattgagaaattcccctttcactgatgtttgtctgtcaaatatcaactttcatggcatgagaggaccaagatctccctcctggaagtgttctgatgtgtttggatttgctcatcaggttagcccttggccatgttctcagctgagcagccaagagcctggatcatgtgccatttag

SEQ ID NO: 45440 - DNA, 1837 bp, Glycine max
  Peptide Sequence Number=SeqID_137125
tctgtccctgaagcaaaaaagaaaatgtctattcgaacaaatcgctttaaagcagtggatagagtgttgaaggatctggagagagtagaaaaagaagggaaattgaatgatttgaagtctgagttgaacaagataaaggaggtgtttttgaaggtgaaggagaatgaagaagaactccttgacacgttagcggttgtggatggctatattcgcaacaaaaacatagctaagttgagggaagaggagggacacttttgccagaaaatatggaattcaactctaaagttgctgccagctgctgcctcatctggacaatcatctcatcatgctcaagctgctgcctcatctcatcatcatgtcacaccactcccttcttccactccacaacttcatcaggaggaggacttgcaaaggattaaggactgttataacagccttggtcctgaattcaaacgtatcttctcatctctcttgcagtttcctgaaaatgctgttttcaagagaagggaaatcgctctctggttctctcagtatggtgattatcgttggaattcagtttgggttgattctattttgaaaagtaaagtaattgtaccccatggtaatggcaagtctcccattgcgagtaaatttaaaattaatccgttgctccgtcacaagtcactaagtccattgtttcaaaatgaggaagtgccgatttgtggttattattcacaaataaagacctcatcttcatctcgtgccagtgatattgggtatcaacgtttagtacttgaccaacgtaaaattaaaataagtgatggttttggttttaaatcgttccgtgctgtttataattttggtgcaagttatcttaattttggacccggatggatggccaaaatgaaggatttgtgggtgcttcaactgggtcgtttcatgcaagattcaccaaaacatcatattgaagtggacagtgaagaattcctcaaggagttgagtggtcacgaggatttgctctgtcttagccttcgagggatatcaagaatattcgagcttccaccttccatcgtaaaaattgagagcctaggaattctagatctcaaggcctgtcacaatctagaaacgctacctagtgatatttcatcattgcaaagtctctggtatttgaatttgtctgagtgctacttgttggacagaatgccaaaggggattcagaacctgactaggcttaaggtactgaagggatttgtattaggtagttctagcaagactccctgcagaatatctgatattgctgcaaatttgaaaagactagtgcgactcagcatacgtataggaagtggggctgtgatccaagaaggcgagtttgaaagcttgaaaaagttgtcagaacttgagcatctaaaaatatcatggggtgtatttgacacaaggtacattgatattcagataagtgtgccttcaagtttgaaaaagttgcatcttgaaggctttcctggccaaaatattccagaatggttgaagcctagcaaactatcttgttcattgagagagctacatataacaggaggaaaactcaaaagtttggatcatggtgaaaataatgattggggtgtggagatggtgtatctcaagtacctaaaggatttggatgttgacttggaacatttgagaaagttgtttccttctctaagactactagacctgtctcagaaaaataacgatctcggactcattcatcgttggatcgtcgtaaaatttaagaaccagcaatcagaggaaaaactcgaagaatctcaggaaattgctagagatgtcactatcactaccggaacatacatgagcccgcttagag

SEQ ID NO: 45441 - DNA, 1554 bp, Glycine max
  Peptide Sequence Number=SeqID_137126
atgaaaagagctctttgctatgcaaacgatggcaatcagcagggaaggtcaccatctgttattgtcattggtggtggcatggctgggattgctgctgctcgttcgctccatgatgcttcgttacagggaagtgtcctgggtgatgctagtcagtttagaattcagctggttgttctcttagagtcaagggaaagaattggtggccgaattcacactgattactcatttggttttcctgtggacatgggagcatcatggttgcatggagtttccaatgaaaatccactggcttcggtgattgggaggctaggtctacccctttaccgtactagtggggataattccatactctatgaccatgatttggaaagctatggactttttgatatggatgggaaacaggttcctcaagagttggtagcaaaagttggtgaaatatttgaggcaattttgcaggagacagataaaataaggcaagaatccagtgaagacatgtctgtacttcgtggtctttcaatcgttttcgataggaagccagaactgaggttggaggggattgcttataaggtacttcagtggtatttatgtagactggagggctggtttgctgcagacactgatgctatttcactgaaaggatgggaccaggtggatgtggtggggtgtataggaatcctgtcatctgaatataccatcatattgcatgattgtgaaaaggaggtactgctccctggtggtcatggtcttatggtccgtggctacttgcctgttgtaaatagcctagccaagggtcttgatattcgattggggcacagggtcacaaaagtagttaggcgatataatggagtaaaggtaactgtggaaaatgggaaaacgttttttgctgatgctgctgttattgctgtcccacttggggtgcttaaggcgaagaaaatattgtttgagccaaagcttccagactggaaggaagctgccattgctgatcttgggattggacttgagaataaaatcattttacactttgaaaatgtgttttggcctaatgtggagttcttgggagtagttgcagatacaccttatgaatgtagctacttccttaatctccacaaggccacaggtcgtgctgttctcgtttacatgccttctgggcagcttgccaaagacgttgaaaagatgcctgatgaagcagctgtcaacttcgctttcatgcagctcaagaagatttttccagatgcttcttcaccgattcagtatcttgtgtctcgttggggatcagatataaattcactaggttcatatagctatgatgcagttgggaaaccccatgaactatatgagaggctacgggtcccagtagataacttgttctttgcaggggaagcaacaagcatgagctatccaggatctgtccatggggcatactccactggaacgatggctgctgaagattgccggatgcgtgtgctcgagcgatatggagaggttgatttattccagccagtgatgggagaagagggttccatgtctatcccgcttcagatatcgcgtctttaa

SEQ ID NO: 45442 - DNA, 534 bp, Glycine max
  Peptide Sequence Number=SeqID_137127
atggaggatgcctctccctcgcattacctcagccctctcgtccgctctctccccttcgtcccctgccacgtgtcatccctcgatttcctcgccgatcctttctccgacgaggtcttcgccaagatggaagtaaaagctgattacatcgggttgctgttaattgcatcagctagttatgatccccgggtggtacctaaagtgtatgaggagttgggaaaatttgctggtgcagcagttgttgtctcgctaagcgaggatcacgtgcttagcgagtatcatccgctaagtgagacattagcccgcttagtgagtaaggtgaatctagaagagaatctgtcacgcaagcacatgctcaacgtgtcaccagctcgcctagagagtcatttgtttcttatggcgcttagcacacctggctcactaagccaaagttcacttacttgtactaagcgcgaaaatggcgctaagcgcgccttcgaggacagaaaaccctttttaaagcttgaagtgaaggaaaagagagagcttggcggatag

SEQ ID NO: 45443 - DNA, 1575 bp, Glycine max
  Peptide Sequence Number=SeqID_137128
atgaacaacagtgttcctgattggaattttgggagtgattcctgtgtcacctccaccaatcaaaagaagcccatgatgggggtggaccaagagcttgtggagcttctgtggcaaaatggccaggtagtgcacagccaaactcatagaaaaccggttgtgaactcaagtaacttgattcaagatgatgagacagtctcatggatccaataccctcttgaggatccattggaacaagaattctgttcaaaccttttgtctgaactggcaccttgtgaagttgagtcctataagcaaatcaagccatttgaagagggaaaatttaccaaattggatgcttctagtgcccctcatgtgactgatttctcaggaattcctataccggccccaagattccatgtttctgattcacctcagaaaaacaataatcacttgggtggatcatgtaaggtccaaaacttctctcacttttcagcaccccttaatgtttcttcagcatcggctaacgtgcattttggagacaaaattactggtaacatgtcaagaaatgagattagggagtgctcattgatgacagttggatcaagttactgtggtagcaatcacatcccccaagatccagatgctagcagggcatcaagcaatggtgtttggactactactttatcagtcgagccagaagctgttagagacgatgtgccgaaaacaattcctcagaaggagaaagggaaatcagagatgcttgaaccagctgtgacttcatcatctggtggctcaggtagtagtcttggaaaaacttgttcattatctacgagaaaccagggccaaaaaagaaaaggaatagacgtggaagaatctgaggagcaaagtgaggacacagaacttaaatcagcacttggaaacaagtcatctcaacgcacagggtcggctcgaaggaaccgtgctgctgaagtgcataatctatcggaaaggagaaggagagacaggatcaatgagaagatgaaggcattgcaacaactcatacctcacagtagcaagacagacaaagcatcgatgttggaagaggcaattgaatacttgaaatcacttcagctacaacttcagctaatgtggatgggatctggcatggcaccaataatgtttccaggaattcagcactacatgtcacaaatgggcatgggaatggctagaccgcctttccctcctcctattcataatccgatgcaattaccgagagtgccgcttgataagtctgtatctgcatctcagacaccaaaccagacattaatgtgccaaaatcccattttgggtgcatttaattaccaaaatcagatgcaaaatccagctctttcggagcaatatgtgcgttacatgggctatcatcttatgcaaaatgcctctcagccaatgaatgtattcagatatggtccccagggagtacaacatagtcaaacaatgattacacccagcagcaacagcagtggaaacatgagtggagcagcaaatattgatgaggctgtgagtggcaaaatggatggtgacaaacagacactaacttgtcaccatgtaaacagctaa

SEQ ID NO: 45444 - DNA, 588 bp, Glycine max
  Peptide Sequence Number=SeqID_137129
atgtctgagaaaaccacagctgagaaccttattgaaaaccttgtggacacatttgttgataagaaaaaatctgtatcattctttgaggatgataagtcagactcagtgagttctcagatcaatagactgtttggacgccagaaacctgtgcaccatgttttagggggtggaaaatctgcggatgtcttgctatggaggaacaagaagatttctgctagtgttttagcatgtgcaacgattgcatgggtgcttttcgaatggcttaattacaactttcttactatcttatgctttggtttggttcttgtcatgcttgcacagtttctatggtcaaatgcttccagcatgtttaacagttcaccatctaatgtaccccgtcttgttctcccagaagaactctttctgaacattgcaactgtggttggtggtaaggttaacatgggcttgaggtttcttcaagatgctgcttgcggaggaaacttgaagcagtttcttattgctctatattggtctaatgttgataacacttatgaaatgctctgtgattccattatagcattatattccatagattctcaccatatttag

SEQ ID NO: 45445 - DNA, 405 bp, Glycine max
  Peptide Sequence Number=SeqID_137130
atgtggagatcccgtttgcataaaagcaaacatgtgcgaaagctaggatactttgaacagaactcagaactatcagaggagtatgatccagttatctcagtgattgaaagcaatgaatttggccatggtgaaggtcatcatcgtggcggtagaggtcgcgatcattatgcaaattttcaatgccaagtttgcttcaaatttggtcacacaacaacggaaatcgatgaagtctcacttcaaggttcactaggtcctgatggcctctacatatttccacatcttgcacccaaagactatgcctcaaccacctgcttactttcaaattctagtgttgattatgttattacttcttcttctagttgttctaaaacaaatttattatttcattgtaaatccagttcttga

SEQ ID NO: 45446 - DNA, 1662 bp, Glycine max
  Peptide Sequence Number=SeqID_137131
atggaaatccatgaggagttgatcaatagtgggtttctgctggacagtttcattagctctgctcttgttgacatgtatggaaaatgtggtcatctagaaatggccatagaggtttttgagcagatgcctaaaaagactgttgttgcttggaattccatgattagtggatatggtttgaaagggaaactttttgaagcccttggcctctttagtgaaatgagaaaatcgtatgttgaacctgatgctattacttttaccagtgttttgacagcttgttctcaactagcagcactagaaaaaggtgaagagattcacaatctgattattgagaaaaaattggacaacaatgaagtggttatgggagctctacttgatatgtatgcaaagtgtggtgctgtagatgaagcattcagtgtttttaaatgtttgcccaaaagggatctggtgtcctggacttccatgattactgcttatgggtctcatggtcaggcctatgtagctttggagctttttgctgaaatgctgcagtccaacatgaaacctgatagggttacttttcttgctatattatctgcttgtggccatgctgggttggttgatgaagggtgctattacttcaatcaaatggtcaatgtttatggcattatacctagagttgaacattattcatgcttgattgatcttcttggacgtgctggaagattgcatgaagcatatgagattctgcaacaaaaccctgaaatcagggatgatgttgagttgttaagcacattattttctgcatgccgtctgcacagaaatattgatttgggagctgaaattgcaagaacgcttattgataaggatcctgatgattcatcaacctatattctcttgtcaaatatgtatgcttctgcacataagtgggatgaagtacgtgtggtgagatcaaagatgaaagagcttggattaaagaagaatccagggcgtgggattagaaagaaatcatctgttcacaaaaccaaaaaggaggttgacaccactaggatgttgggtagtcttcctcatgtcacatttcctgaagagtcaaatcaggtgttaggaggtttattaatccgttatctatctggtgatgaagtactttggggagagatgattggagcatatagtgaccctaccgacagaacaaaacaaaaggcttggttgaatagtcattctgtaaattcgaagttgtcaccacagaaaacttttgattgctctttagttgtatatgatgagaatgagattactatcaacgactgcagcatgtggataaggaactgtactgttgttggactacttccattattcttgctttccaaagagatcgctgttgctctagcaaaggattgtacagagggacacgagtctatatcttctgataatttagttagagtgacacattcaaccgatgttcttcctcatattctactgtctgctgtggatgccttagcttgcattctgtcccgtcatgggctttctggcataccacagacctcagattgtgctaacacactgacttctataaatgctacaaatccaaaagaattccaaacacagcttataaatcaagatgcaccccagatcaatccttctgaagttaaggcatctgaacctgaggccatcgaaaatccgagtaactaa

SEQ ID NO: 45447 - DNA, 600 bp, Glycine max
  Peptide Sequence Number=SeqID_137132
atggtgaccttaggagatattatgataacaatcacaaggaaggagatttttattgtttggtttgtggggcactccactgccatactaaggacaagaaggaagcgagctcacagggcctatgcacaagtcatctacaaagttgttgagcccaaaaatcctgctgtgggttatactgatgatacaaattcaaatgatgttcttccaaagtttgctagaagggggctcaatttttttgagacgcaggaggagagtaatgagcaaaacagtggaagcaacaacactttgtctgagtctgaacgcgtgacaaaagctgagacagaaattttggccttgaagaaagccattgccaaattaaaagatgaaaaggaagctggcttgcttcagtatcagcagagtttggagaaaatgtctaatctcgagttagaagtgtctactgcacaagagaattctcgaaaactcgatgagcaagcaagtaaagctgaagctgaagttcaagccttgaaggaagcccaaatcaaattacaggctgaaagtgaagctagtcttcttcagtaccaagaaaaagtgaaaaaacagaggaccctcattttcaaacagtga

SEQ ID NO: 45448 - DNA, 2133 bp, Glycine max
  Peptide Sequence Number=SeqID_137133
atgagtagagagagaaacacagggtgggggagagatagactgagaggtaagagagtatggcgtgatagagcaagcttcggggaggcatcccgacggcattatgccggaaacataggaagagctaagctgaaacacacggtgactaactggagagatcataaggatattacatccttctatttctctcgtttcgtcgacgacatcatagagaaagagctctggtaccatttcaagaaatggggggacgttagggaaatcttcatcccaaacagaagaaacttcacggggagaaggtatggctttgttaggttcaaaggggtacaagatatcccttatctggcgaggcagctagacaggattgtcataggggggttgaaattgttcgtcaacctcccaaagtatggaagggaggtgcagagggaggcagcgggaacaacccaaacaaggccgtgcacggacagaaagcaaggagctgaggttcgaacccaccacacgaagccaacatcatacgcaaatgcgctgacaagaaacatcagacggtcgggatatcagataacatcaaacacccccatcaaccataaaacctcttcatcctcggttcacattgaagttaaaccagaagatacctcgtggctgaaggaagcgtggatagggcccctcaaaaaccaagctttgtttgaacgattggaggacgagcttctctgggagactggaatggatgtaactcctagatacatgggtgacgatcaagtcctcttgcaaggtctcactgaaaatgaagcgcaccaactcatgagtggaggaagagcaggaggaataacggtattctcctctattgaaaggtggagcccaagtctgtgcgcaggatgtcggcttacatggattcaatgttgggggattcctgtccaggcatggaacccaaaatacattaaccagattgtagccgttatgggagagctggtggatttggacgattcaatggaggagaaaagaagattggatagagcgcgggtcctcattaggactccctggcggccattaattcaacacacggtggaggtaatggtcggagacgagaagttcatggttcacatcgtcgaggagtgttgcggtggctattcagactgtcttcggagaaggagaagtgtcggagggtcatcggaggagattaactccgatgatagcttccttgacagctcctcgcacatcaactgggacctcgcggaaaacgtcccacatttgccagagttggaatcgtgcagtgatctccacggagtcatctctaagaatcttggcggcgtcgaagaccaggggtcgccaccccggccatacctattggagttggaatcgcgttccgcatgtcatggcgacgacgcaatggccttggccggcgccgaagaccaggggacagtccttttatcctctggtcataacgactgctgcgactcactggataataatcttcgggtcaatggagataatcaaggggtgaggcaatgggtcagcctacctaacagggatgcagtgtcacaggattatcaccaaaacaacaatgaaggtaacagggggcatagtgggctggcagagggtcaaaaggattttggtgcagaagctaatgatgtggtcctggctaaggatagcttggatacacgtggcaattttaaatataaggagttggagggacatgtatctgaagaagcaccacgtataacacatcaggatgagcatatttccaattatacccccaaagacaaaaactccaaattgggctttaacccacaagcagggggggtgggaattcaaggcaggtttattctcggcagaggaggatctgcatcacacaatggagactcacaacaacaacacacaaacactttgacacagccaggggaaacacacaatgacattcgggatctttccttgcagcaacagctcagcaatggagttacaaaggcaatcccagtcttggataatcagtacactattgaggcaagtcagatatggagtatggccaaacaattgggcctcactggagaaggaagcaagaaggcagtcattcaaaaattccggcaaatggaggaaagggacagggtagaagcaaatagaagggctgacagcaacaggaatcaatga

SEQ ID NO: 45449 - DNA, 480 bp, Glycine max
  Peptide Sequence Number=SeqID_137134
atggcattcttgggagagacaagcagtgagacagttgtgaactccacattaggttttatttttccaaatggagccattgttcacaacgacagtggtgttttcttccaagcttccactccagttcccattcgagtaactaacgggtgtgattttcaaacgttaaaaaccagaatacacaatacccttaagctaaccgacaagcaatttttggatgaaatttactaccgacagcctttcacgtatgcagatcaaggtgatccgtacttgatccgtaaaacacttacggatcaccttgatccgtggaattatttgattgacatgttggatgaagcacagctagcaaatgctattctagtgattcgaaaaatgcttagaaggacctgtaaagtcaaaggggaaagcttgtataatgtaaaaaccatgaagaatcagattaggaaaaaaggttccaaagagaaattttatgaatcatgtagttaa

SEQ ID NO: 45450 - DNA, 549 bp, Glycine max
  Peptide Sequence Number=SeqID_137135
atgtcagctccgcggctcatgcttactccgccgcccatgccgcctccgcagcccatgccgactccgtcacccatgccaactccgcttcccatgtcaaccgcgcctccatgtcctgcacccgtgcaaacattccttccactattttcgggtccgcttcctatgcctgttcttcatctgtccaatcttggtctcgttcgcaccaccatttccttcaacaagttcctcaacattgttcctccttatgggattgtcatggccgcatacaagctccaatcagttgcctttgcattatgcacaactgctaaaccaggtgcaattcgccggaataaactttgggatcccggtatcacttttggaagccatgtgttgaacccccaacaccttgaggacaaggtgtttttgcaaggcccgaggaatgatagggaagcaagggtgcaacaagcaactagcaagaagcctagtaaagacagtaacagaggggtgcagttagaagcaaaggcaaataggacaaccactaaaccttcatacctgaaggattatgtgatatga

SEQ ID NO: 45451 - DNA, 1554 bp, Glycine max
  Peptide Sequence Number=SeqID_137136
atgaaggaaggagacatcatttttggaaatgacattgtttccaacaacgacgaaggaaacgatacccgcgatgacaacaagcaattcacaatggccagcgccaatgcattgtgctcgtggcccagtgagagaagctccatcgccattgtcgtgtgtatggatatcgtcgtcgtccggaagtgtcacttttccattagaaagagtggcagcagcttcaattccagcattgtgaaagagggtggtgagggagatgatggttcactcctctgtcctcttcccgatgtcttctctcatatagcgactctgcaatgtggtacttttgacatgtcaaaccctatcacttttctggtgagagtcttcgagttcgtctccgaacacagtgactttttggagacaaagagcgccgaaaaggaggtagcatcgttggtgtgcgcagttgagaagaagagggagtttctcaaggtggagagagaaaaggttgagaagaagaagagagaggacctcaaggcctcgaaggagaggggaaaatccgacaagaggttgaaggaagagaagaaatccaaagccgaagacaccaacaaagacaaaagcacctccagagttccaaacaaaggtaatggcttggatttggagaaatactcttggactcaatcacttcaagaggttaatgttaatgttccggtgccaaatggaaccaaatcaagagcctatgcttatctgcttaatgtccttgctcctgaacattgcagtccggtcaccttggataccaaggatggcaatgaaagggcaaatctggttcttgatcacgcagagagaatgggctgcaaaagatacttgaccccaagggatgttgcagaggacactaaaaagatgtcctatgctgagatgatgacggatgatgtacaaacatctagagaagagagatgcttccaactgtggatcaatagtcttggaatttctacacatgtaaataatatgtttgaggatgtcagaaatggatggatacttttagaagtggtagacaacatatttccaagatcagttaactggaaacatgcaacaagacctccaattagaatgccattcagaaaagtcgagaactgcaatcagctcatgcgattcacaatgcttcaactgttgaaaattttgagatctgattcccaaggaaaggagatcactgatgctgatatcctgaaatgggtgaacagaaaagtgaagagcactggcagaacttctcaaatagagagcttcaaggcctggacagaggcatcatctattccaagagcactagtttcaattattttaagattgccaagacttaaatttacgattgtaaccttgggaaaagatggctgcataatgcttgagaaatgtgtggatgatgctaatgctattttggcagtatcagtatcacttgctgtctgtaacgctggtgcggcagtgaagaaaattcctctgtacaagcacattgcctggctggaaacaagactttggtactacctatgctttcattcaatgttatcaatggaggctcacatgcaagaaataagctag

SEQ ID NO: 45452 - DNA, 4004 bp, Glycine max
  Peptide Sequence Number=SeqID_137137
tgtttgagatgtctggtgttcttctttgggtgagttgtggacccaaggagaaccctatctccattgttggtcttggcgggagaggtggcagaagccagaggaggtttggactgtgcaatgggatcagttttgcaagcttttcaccagcagtggcagacccttcaagatcctcagaggagagggtatatgaagtggtgttgaaacaagcagcactggtcaaggagcaggacaagggtacaaagagagcactgaatttggacaaaccaacaattgaaggtgatttaaccaatggggatctgttgagtgatgcttatgatagaagaacagatgaactagtggatggacctaatgcttctcacatcacaccaaaggccttggacaggtgggagcaaagattatctgatgttttcgaaggccggccttatgatatgtatgatgctgccctctcagatacagtctcaaagtacccagttgatatacaggacatgattgaagggatgaggcttgatctgagaaagtcaagatacaatagctttgatgaactctacctttactgctactatgtagcagggacagtgggccttatgagtgttccagtaatggggatagcaccagaatcaaaggctacaacagagagcgtttataatgctgcattggcacttggcatagctaatcaacttaccaacattctcagagacgttggagaagatgcaagaagaggaagagtatatcttccacaagatgaattggcacaagctggcctaacagatgatgacatttttagagggaaagttaccgacaagtggcgcaatttcatgaagggccaaatacagagagcaaggatgttttttgatgaggcagagaagggagtttcggagctcaactctgcaagcaggtggcctgtatgggcatctttgttgttgtatgggcaaatcttagattctattgaagctaatgactacaataacttcactaaaagagcttatgtaggaaaagttaagaagctcttatcactacctgctgcttatggaagagcacttctaggcccccaaaagttaaccaagatggttacaagaagaacctcttctgattctgaatcagatggaaaccaccaaaaaggtggcacctttactgtgtcttacctcatcaactcatgtggggtgtccccaacactggccaggaaactctccaataaggtcaatttgaaaaccccacatggcccaaatgctgttcttgatcttctcaacaactatgggtttgacaaaatccaggttgcaaaacttgttgagaaacaccctttggtgcttcttgcggatgcagagaatacccttttgcctaaactcaagttcttacgttctattggggtttccaacactgacatgcctaagattttaattgctaaccatagcttgaagaggagcttgaaaaaattcttcatcccaagatatgagatcctcagacgtgtacttggtgatgatcaggaagtcgttagagctataacaagttcccgatttggtattaattatggtgacgcaatgaacttggttccaaacattgaggttttgaggcagtctggtgtgccccaagcttctatctctttcatgatgatccattgtgggactgtagcctactggaagcattccagatttgtggaagctgtcaacactgctaaggaaatcgggtttaatcctttgagaacaaattttattgtggccattgaaatgcttctgattagcagcaaagcagtatgggaatcaaggtttaaggtttatgagaggtggggctggaaccgtgaaatggctcttcaagcatttcgaaagtttcccaatgtaatgaggttgtcagaggaggcatttagcaagaaaatgaatttcctagtgaatgatatgggttggccatcagaagaaatcgctgagtatcctcaagttgtagcatacaacttagagaagaggattatccctagattctcggtaatcaaaatcttgaaatcaaaaggtttgcttgagaataatgtatcctttagttccattatatgcataactgaagaaaaatttctggaaaattttgtgatcagtcttcagaaagatttgcctgtcttaccagacctctatagaggaatctcttctgatgctgaatcagacgatgaaaaccaccacaaaggtgacacctttactgtgtcttacctcatcaactcatggggattgtccccaaaactagccagtgaactctccaatagggtcaatttgaaaaacccagatggcccaaatgctgttattaatcttctcaacaaatatgggtttgaaaaaacccatcttgcaaaacttgcggagataaagccctccgtcattgctgcaaatgcagagaatacccttttgccgaaactcaagttcttccgttctattgggatttccaacgctgacatgcctaaaatcctaattgctagccatcatatgttgtttagaagcttggacaaatgcctcattccacggtatgagattctaagtagtttacttcgtgacaaaggggaagttgttagagctttgaaaaatgccccatttggttttacgtatgttgacatgatgacacacttggttccaaacattagggttttgagggaatctggcgtgcctcaaggttccatatcttacctgttgatgcattctgggactctagcctacagggaccattccaaatttgtggaagctgttaacactgctaagggatttgggtttaatcctttgaaaagaacttttgtcgtgggtgttgaagttcttgccaataagagcaaagcagtatgggaatcaaggtttgaggtttatgagaggtgtggctggaaccgcgaaatagctcttggagcagttcgaaagtttcccagtattgtgaagttgtcagaggaagtgtttataaaaaaaatgagtttcctagtgaaggatatgggttgttcatcagaagatattgctgaatatcctcaagttgtaacgtacaacttggagaagaggattatccctagattctcgataatcaaaatgttgaaatcaaaaggaacctcttttgattctgaatcagatggaaaccaccataaaagtggcacctttactgtgtcttacctcattaactcatgtggggtgtccccaaaactggcaagggaactctccaacagggtcaatttgaaaaaccctgatggcccaaatgctgttcttgatcttctcaagaattatgggttctgcaaaacaaaacttgcaaaacttgttgggagacatcctttagtgcttgttgcagatgcagagaatacccttttgcctaaactcaagttctttcgttttattggggtctccgacgctggcatgcctaaaatcctgattgctaatagttctatcttgaagaggaacttggaaaaatgcctcatcccacgttatgagatcctaaagagtgtactttgtgatgatcgggaagttgttagagctttgagaaattcccctcttggttttatatatggtgacttagtgaatgccttggttccaaacattaaaattttgaagcaatgtggtgtggctcaggcatccatatcattactaataaccattgctctgtctgcagcgtatgtgaagcattccagatttgtggaagcagtcaaaacagttaaggaaattgggtttagtcctttgaaaaataattttgtcgtggctatttctgtgcttgtaactatgaggaaatcagtctgggattcaaggtttgaggtttaccagaggtggggctggaaccatgaaatgtctcttcgagcatttagaaagtttcctggttttatgatattttcaggggagacttttaccaagaaaatgagtttcctggtgaaggatatgggttggccatcagaagctattgctgaatatcctcaagttgtagcgtacagcttggagaagagaattatccctagattctcagtaatcaaaatcttgaaatcaaaaggtgtgctaacatgtacattagttccattatttgcataa

SEQ ID NO: 45453 - DNA, 816 bp, Glycine max
  Peptide Sequence Number=SeqID_137138
atgtcttccactccctccaatctcattgatttcttggtgaaccaagccaatggagtaaagggtcttgctgatctgaacctcccaaatgttcctcaccaatacattcaatccctccaagccagattggaccactccaaaattattcctcaggaatcaatacccatcattgatttcacaaaatgggatatccaagatttcatctttgatgctactaccaagtggggtttcttccaaattgtgaaccacgggataccctctaaggttcttgatggtctcaaggatgctgtgcacaagttctttgtattgccagctgaggaaaagaagtgtcttaaagtgaactcatcccctgaagttgtcaggttggccactagctttagcccccatgctgagtcgatcttggagtggaaagattatctgcaacttgtgtatgcctcggaagaaaaaaatcatgcacattggcctgcaatatgcaaggatcaagcactgcaatacatgaagcatgctgaagttataattagaaaattgttaaaggtgcttcttaagaaactgaatgtaaaggagttagataaaccaagagaaaaaactttaatgggggcaatgatattgggtttcaattactacccagcttgccctgaccctgaagttgtagcaggggtaggccctcattccgatgtatcatcaatcactgtccttctacaggatgatattggagggctttatataatgagcaatgaaagatacaaaagcatagagcatagagtggttgcaaaaagaaaccaggatctccattccaatctttgtcaacccagctcctga

SEQ ID NO: 45454 - DNA, 1752 bp, Glycine max
  Peptide Sequence Number=SeqID_137139
atgtctattcgaacaaatcgctttaaagcagtggatagagtgttgaaggatctggagagagtagaaaaagaagggaaattgaatgatttgaagtctgagttgaacaagataaaggaggtgtttttgaaggtgaaggagaatgaagaagaactccttgacacgttagcggttgtggatggctatattcgcaacaaaaacatagctaagttgagggaagaggagggacacttttgccagaaaatatggaattcaactctaaagttgctgccagctgctcatcatgctcaagctgctgcctcatctggacaatcatctcatcatgctcaagctgctgcctcatctggacaatcatctcatcatgctcaagctgctgcctcatctggacaatcatctcatcatgctcaagctgctgcctcatctggacaatcatctcatcatgctcaagctgctctcccatctggacaatcatctcatcatgtcacaccactcccttcttccaccactccacaacttcatcaggaggaggacttgcaaattattaaggactattataacagccttggtcgttttgacaaacgttgcttctcatctctcttgcagtttcctgaaaatgctgttttcaagagaagggaaatctctttctggttctctccgtttgaccaagtggttgatcctcttttggagggtaaagtaattgtaccccatggtaatggcaagtctcccattgcgagtaaatttaaaattaatccgttggtccgtcacaagtcactaagtccattgtttcaaaatgaggaagtgccgatttgtggttattattcacaaataaagacctcatcttcatctcgtgccagtgatattggttatcttaattttggacccggatggatggccaaaatgaaggatttgctggtgcttcaacttggtcgttggacgaaagattcaccaaaacatcatattgaagtggacagtgaagaattcctcaaggagttgagtggtcacgagtatttgttctgtcttagccttcgagggatatcaagaatattcgagcttccaccttccatcgtaaaaattgagagcctagaaactctagatctcaaggcctgtcacaatctagaaacgctacctagtgatatttcatcattgcgatggctccggtatttgaatttgtcagagtgctacttgttggacagaatgccaaaggggattcagaacctgacttggcttgaggtactgaagggatttgtattaggtagttctagcaagactccctgcagaatatctgatattgctgcaagattgaaaagactagagcgactcagcatacgtataggaagtggggccgtgatccaagaaggcgagtttgaaagcttggaaaagttgcgtagacttgagcgtctaaaaatatcatggggtgtatttgacacaaggtacattgatattcagataagtgtgccttcaagtttgaaaaagttgcatcttgaaggctttcctggccaaaatattccagaatggttgaagcctagcaaactacctcaagaattggaattgagagagctacatataacaggaggaaaactcaaaagtttggatcatggtgaaaataatgattggggtgtggagatggtgtatctcaagtacctaaagtatttggatgttgacttggaacatttgcgaaagttgtttccttctctaaggtacgtagaaataaaacaaatcttaaaccagccataccttgaatggagcattaattga

SEQ ID NO: 45455 - DNA, 288 bp, Glycine max
  Peptide Sequence Number=SeqID_137140
atggcgatgactgctcaaagcgcatcttcatgggagcaagtagcaaaagtaccatccaagaacatgttctccaatacaacatttttcttcctcaagttcgatgccttcctagaatcccatggccttatcttgagtttttctacttcactctccttaacaaacgagtcagtgggagaggtatattcaaagcaggatgtgctgaaacctctgaagttatgggctaaatttggggcttgctgtgggccaataaatttttgggttggactatgctgccatgggtttaattaa

SEQ ID NO: 45456 - DNA, 267 bp, Glycine max
  Peptide Sequence Number=SeqID_137141
atgtcaatggctttgggttttttttttttctttttttttttttggttttgttattctgagctcgaattcttgattttgaaaattttggtgaacacgcgagcgaaagggaggtgtctctctctgttgagagagagagaggaggagctaactgttttttctgccgagacgcattcattgagatccgaggctgggttttggaggggtgcaccgtactccgagctcgttccctcacacgataatttcacggtggatttcgcggaccaatag

SEQ ID NO: 45457 - DNA, 370 bp, Glycine max
  Peptide Sequence Number=SeqID_137142
tcgcctgcgcttccgtgactacaaccacattgtcgagatcgtgtttgtggagatcgtctttagcacttatccattgagttggtgtttgtcgcaaactgggctgcgcttccgtgactgcaaccacactcctttgttgcttggccaagtaaaggtgagtgtggaggaggttagagatgcagatgctccagttcctgtacccactgatgaggtttccttagtggggcaaacacttcacaccttccttgcttggctgacacatctggtcaagtctttatcacagcaggtagttgtgtctccgccaaaaccacctccgaagccagatccggaggtcgatgatctgctttatctgatgacattgaccatcccatag

SEQ ID NO: 45458 - DNA, 66 bp, Glycine max
  misc_feature (43)..(43): n is a, c, g, or t
  Peptide Sequence Number=SeqID_137143
aggatccccgatgaggatccacttcttgaggtactttctcccngaggaagtcatgtcggcatctga

SEQ ID NO: 45459 - DNA, 405 bp, Glycine max
  Peptide Sequence Number=SeqID_137144
atgggcggcgcggtactggcggatttcattctggtgggcgcggtcgcttccggcctgggcgtggtgctggccgcctccgaagtggccttccatgtcatcaagtgggcgggcgctgcctacctggcctatctcggctggaagatgctgcgctccgacgccgcgctggtgctgccggccgccgaacccggcgccgcgcggccggcgcccctgctgccgcaatacgccaccgtggcagccgtgctggcgctgatgaacatcctgaccatgctggcctacgccaccctgggcgcgcagctggtgcgggcctttcgcggctcgggcctgcgctggctgaaccgggtatgcggctcgatgatgatcaggctggccggcaccctggcgctgtaccgccgcagcggcgcctga

SEQ ID NO: 45460 - DNA, 327 bp, Glycine max
  Peptide Sequence Number=SeqID_137145
atggatacaccacccagctctcctcctcctcctcctcctagtgcagcatcacattcgacgtctaccttgaagcgaacaacaaaagccacacgcttaagatcattggcgactagaccagttggggtagagagacccctggtccatgtggatcctgcgatcgggaaagccgacagtctccacagaaaaaagttaagaacatatttggggatcgtcgctcgtgataaggtggaggtgacatacgagaattggaaacaagtccatgctgctcagaaggacttgatgggaggatattcagctgaatttgatatccctgaagcatctaattga

SEQ ID NO: 45461 - DNA, 51 bp, Glycine max
  Peptide Sequence Number=SeqID_137146
atggacacccgtctccatgtgattggtgatcccatgaatggagttcaacgg

SEQ ID NO: 45462 - DNA, 1068 bp, Glycine max
  Peptide Sequence Number=SeqID_137147
gattcgtttgaggagcaggccacactcggatcgttcgtcccccatggacgtcaggatgttctcgccgctgctattggacgtccagagcaccctggacgtgtccgtgctgttggagccggtgtcaccatcaagcaatactttggatcggctccacggacgtcccgtaacgcttcctccgtgcctcctgacgaattacagcaactgacccagcagatcagggacccgctagaggagtccatcacaatgaaagtgacgaggcaggtcatggcatccttcagccagcttcagtcgcagatgcaatctcagggacttgcagtgcctcttaagcctctggttggtccctccggtcctcaagtgagcacaaaggggagttgtgttgatccctcaagaaacgatcctgagacgggtgactctgacaggtgcgacttgtacatagaagcagatcctgaccgcctggttgccatggggagagtttatgagggatccactgttgttcatagcactcctttgttgcctggccaagtaaaggtgagtgtggaggaggttacagattcagatgctccagttcctgtacccactgatgaggtttccttagtggggcaagcacttcacgaccttccttgcttggccgacacatctgctcaagtctttatcacagcagctgtgtctccgacaaaactacctccgaagcccgatccggaggtcgatgatccgctttatctgatgacattgaccatcccagagattttcttgaggccttatcaggttagatgggatgccaccgtgttcggggtctttaatccagatttccccctctacataaagcacaaagacctctccgaaatctcacacagtggtcaatgtctcagcatatcagtgttacagttgtggattctgcatctcactgaaacatgtatgcgagtggggaattctgatatttatggattcctcgagccacagtccattcagaggtctgcgcaatcgcagtttgagtctgaaagttacataaagagttggatgcagagttcacaacgcgatgtatatcttggagcctacctaaatgggtaa

SEQ ID NO: 45463 - DNA, 327 bp, Glycine max
  Peptide Sequence Number=SeqID_137148
atgtgggccatcattgaccaatacaaagagaagctaagtctaactgcaacccatgaacaaaggctagaggacgagtatgtgaaggtatcggtcctgcaagcaaaaagggaagcaagagagagagtgatcgattcattacacatagatgcaatgatgtggatggataggttcgctttcaccttgaatgggagtcaagagcttcccagactgttagccaaagccaaggcaatggcggatgtgtacttggctcccgaggaagttcatgggctcctcaattattgtcagcacatgatcgatttgatggcccacataattaggaaccgctaa

SEQ ID NO: 45464 - DNA, 411 bp, Glycine max
  Peptide Sequence Number=SeqID_137149
atgggtgatcaagccacaagcatgcatacaataagcatagatatgaaaaagagtttacatcaactactcaataagaatccccaactgagggttttaaccattcatggcaaggaaactccttttacactgaagaagaggaatcaagagaaattgcttgcttacaaaggagtagggatgtctcctccacctctaggaatctctcaatcactcaaaaactcactactttccctcaaagatgaaaacttggccccttgctctgctctacgctatctgaaattcacactcttcaggcctcttagtagtgaacagttctcttggctcttctttaattctgtgcaaatcaggcttaaaaagggcttcctgatctcgacgtcgctgatcgaggccgtacccgaatcaaataaacattaa

SEQ ID NO: 45465 - DNA, 249 bp, Glycine max
  Peptide Sequence Number=SeqID_137150
atggagtttttgcagattgcaatcggtgaaatcaaaagaaaaatgaaaaagaagaagattgcaagttacgggagtcgatttgatgaagaaatgagtaagataggaaggtttgaaggtttgggaactggagagacgtcgcaaggaggaagaggctgcgcaggggtttctgaaaaacgtggtttagacggcagcctactggtaatcgattacatgaatacctgtaatcaagttacaggccatctgttctag

SEQ ID NO: 45466 - DNA, 231 bp, Glycine max
  Peptide Sequence Number=SeqID_137151
atgcatagatctcccatagctacattgagaaggaacagggccgagaggagaaggaagcttctgcaagatagaacaatcgcatccattcttgaggaagaaactcatttttctgattcattatcacttgattcatcatcatcaagggaatccactactcagttgcctaaagccactatcatggcagacgagcaacaccagaggattacccttgaggattattcaaacagctga

SEQ ID NO: 45467 - DNA, 546 bp, Glycine max
  Peptide Sequence Number=SeqID_137152
atgggtgaagcagaggaggtgcaagagaagatgaaggccgacatggaggccattaaaaagaaaatggccacaatgatggaggccatgatgagcatgaagaagataatggaagccaatgcggttgcaattgccgctaccagcattgttgctaaggtgaacccgacgcccccatccggcatcaaccaaatgaatcatccaacctcagatatgcacgccttcccgccatatggcttgcctctcaactatacgccacccaatgtggcgtacactcccaataagaatgtcaataactccactcccatactcattaagagccaacaacctcaatctgatcatgcacatgtctctcgacccatggaggagacgcatgaaattccccaccacgatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagtga

SEQ ID NO: 45468 - DNA, 702 bp, Glycine max
  Peptide Sequence Number=SeqID_137153
atgacatttttaggagaaactagcagtcagatgattgtcaactcaaggttggctttcatttttccaaatggatcgattattcacaatgatactggggtttacttccaaacttcaactccggtgcccattcgagtaccaaatagttgtgattttgcaagcctaaaaaccagaatacacaatacccttcagctatccgacaaacaatttttggatgaaattcattaccggaagccattcaccgatacagatggaataataaacttacttgaacgcactatgccccgtactcatgacgcgatcttgtattacaacgggaaatggaacatgccaccgcagaacaaatttgttggatgcgcgttcacaggaaaaaatcctaagaaatttcaaattccttcaacatgtaccatcgatgaactaaagaatttaatcaagcaagttgcacctaaagggattccccctcatggaattcacgaatcacaaacggtaagacgattgtttttccgccaaccagctcgctttgagtattcagatacgattataaaatatgaaataaatgagctgatgaccaacaaagaactactgaaggtgttagtacaatctaactactggaaaaaatatggaccaatagaaattttagctgtctttactaaatatgttgtgaaaatcgaagacgaggtcactgggacatcgctaaataactga

SEQ ID NO: 45469 - DNA, 249 bp, Glycine max
  Peptide Sequence Number=SeqID_137154
atgaaggttgaacaactctttgtttgccatcatattagtgaagagagaaaagttccattggctacccttagcttccaaggggagcttatggaaaagctccaaaggcttagacaagggagtatgagtgtcaaagaatacaggcaacaaatgaaactactccttttgataggtggacttagggaggaggaaggaacaaacattgctaggttcctaaggagtttaaatatgggaagtaagagacaaggttga

SEQ ID NO: 45470 - DNA, 327 bp, Glycine max
  Peptide Sequence Number=SeqID_137155
atgggtaaggactggggtcctggcactgctgatgcaggttgttggtcctgccccggctgctgtgcctaccttggcatgcaatacttttcaatgaaagacctgttaatgggaggccagatgagctttgtgggtgtaaccgacacccgagagaactggcagagacctgtgatcaaggctggtgtcgcaacctacccttcggcgggagggcaacgtgtgactcgcgggtgcgtgttccaagaaaggaatacacgcgaagtcgccaccaacgtttatttgaggaaaacgtcggaaaaatcggaaaaggtgtggtctacaaactttaagtga

SEQ ID NO: 45471 - DNA, 240 bp, Glycine max
  Peptide Sequence Number=SeqID_137156
atggggaaggctgttgcttctggaggaagcaacctggctcgcctgggcaagctgggcggcaaccacctcccctattttgctataaataggggaggaagtgaagaagaaaagggttcagcccctttggcacttctctctctttcgaatttgcttggaaaaattgtttccgaatttcgcaaaggtttcaaccgttcttcgacgttcttcattcgttcttcatcgttcttcgatcttcaacgg

SEQ ID NO: 45472 - DNA, 342 bp, Glycine max
  Peptide Sequence Number=SeqID_137157
atgcgtccaaatcttaagggcaaaaactacaatagccaactccagatcatgggtgggataattcctctcgtaagtctcgagttgtctagaagcataggtgtcgcaacctacccttcggcgggagggcgacgcgagactcgcgggattcgtgttccacgaaaggaatacgtgcggagtcgccaccaacgtttatttgaggaaaacatcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 45473 - DNA, 159 bp, Glycine max
  Peptide Sequence Number=SeqID_137158
atgtacgggaagtatcgcgggacgctgttaattgcaacaacacaagatggaaatagtcatgttctttcgcttgcattcgttgtgattgagggagaaacattaacagcgtggtcatgggttttcgggcacacttgcatgaacatgaaacagataaagatg

SEQ ID NO: 45474 - DNA, 408 bp, Glycine max
  Peptide Sequence Number=SeqID_137159
atggctggtacattcttccttttgaaacagcaaaatagtttagagattatgagcggtaagaaagaaatgactccgaatagagttggacgccacactcaacgtaaggatgcacatgccaaagttgagtatgtgaaaagattgtatgaccaagtaaagatgcaaattgcaaagaagaatgaaagctatgtcaagcaagcccacaagaaaaggaaggaagtggtacttgaacccggtgatgatcctgaacatttgaggacaaatgttttccaagaaggagggaatgatgagaatcatgaaactggccaaatacaggctaaaggcccaagtggagaaggacgaaggctcaagtggagaaggatccaaagcccccgagtggagaaggatgaaggcccaagtggagaaggatga

SEQ ID NO: 45475 - DNA, 276 bp, Glycine max
  Peptide Sequence Number=SeqID_137160
atgcatgaacgacaatcaagtcatggggctccgtataagattcgatggtggaggatgcaaacagcgcttgacagtcaattcatggggctccgggctcgatggatgcacgaacaacgcttgaaaatcaattcgtggggctacggactcgatggtggaggatgcatgaacgacaatcaattcatggggctccgaataagatttgatgatggaggatgtacgaacagcgctaggcaatctattcgtggggatccggactcaatggtggaggatgcatga

SEQ ID NO: 45476 - DNA, 612 bp, Glycine max
  Peptide Sequence Number=SeqID_137161
ggcagcatgccctctcctttgagagggctacatcccctcgccttcagaggactacacgtcctcaccttgcaaggactacacgtcctcaccttcagaggactacacatcctcaccttcagaggactacacgtcctcaccttgagagggctacaggccctcacctttcagaggactacacgttctcgcctttagagggctacacgccctcgcctttagaggactacacaggactacacgtcctcctactgaggactacatgtccttgccttcagaggactacacgtcctcaccttgagaggttctacactgccctcgccttcagaggactacacgtcgcctttagagggcagcacgccctcgccttgagagggctacatcccctcgccttcagagttctcaccttcagaggactacacgtcatcaccttcagaggactacacgtcctaaccttcagagggctacatgccctcgcgttcagaggactaaacgtccttgcctacagagggttgcacgccatctccttcagaaggatacgcgccctcgccttcagaggactacacgtcctcaccttcagaagggctacacgccttctccttaagagggctacatgct

SEQ ID NO: 45477 - DNA, 687 bp, Glycine max
  Peptide Sequence Number=SeqID_137162
atgtctgggcattcctccactcgccaatttcctagtcggaaaccggaaggacatggccgtaccaaatccgatctcctcgaggagtcatcctcgcatatcgcggtgacttggccttcgcgtcttaaacccgcacttataaagcttctactgatgtggcagggcggggcctctttggcttactgtcccaactgcgagccttggcctttgttcttcctttccgagatatttttccttatgtcagcttgcgtagatttacaacctaacccaaacttcccgcggtttcctctgccgtaccccaacatcactcgggcccccatcattgccatatcagacaggcgaggctacccagagagggaatctacggaggcaatgcttactacttcaaaagattggaaagccgtttccaatgactcctccgtggcttgcacatatggcatagaggaagggcaacttaccaggacgtcttcctcacctgatactatgaccaaatgtccctccactacgaacttcagcttttggtggagtgtagagggaacgactcccactgagtggatccacgagcgccccaaaagacagttgtatgaggccctatctatacgggaaggtcgatctctctcctcacctctcggcagctgtcgtcgaaggcacggaccaccatggaacttggccttagatgggaagcgttaa

SEQ ID NO: 45478 - DNA, 519 bp, Glycine max
  Peptide Sequence Number=SeqID_137163
atgacagcaataaagataaccattaaagaaacttcccttcttagaaaacctctgcatcttctcctttgtaaaggaacacttgttatcattgtcatacctcttgagcttgaggttattcctcaagtaaaggagttgttggatgagggtatggttcgtaagagcttaaatccttgtgctttgttgctgcccaaaataggtattatgaggcaccaaatccccatgataggtggtatgatgaatgtgttgagaggtgcaaccctcttttgtaaaatcatccatgcatccaacatcttcatgattcacatacgtagggactcattaggggttcccatgaaccctaagagaataaagaccattcctgagtggcccactccaccaagtgttgaaggaagaagcccagagtttcaagaacctttggatttgagttcaaatccttttcaaaggggatgggatgatgcaatcctacccccaagggtattgaatagaagactccaagaagattgggccagagattcatga

SEQ ID NO: 45479 - DNA, 797 bp, Glycine max
  Peptide Sequence Number=SeqID_137164
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtgtctcgccgtttatcatgggagaatctgctgcttgtgccagaatcaagacttccatagtaaggagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45480 - DNA, 93 bp, Glycine max
  Peptide Sequence Number=SeqID_137165
atggggcatgccacattgtccccatcctcttacaatttatgtccaaacatgcgctcaccaagtgctcggtacaacataggagattcaaaatag

SEQ ID NO: 45481 - DNA, 510 bp, Glycine max
  Peptide Sequence Number=SeqID_137166
agggctacgcgtcctcgccttaagagggttgtacgtcctcaccttaagagggctacacatcctcggcttaaaaggactgcacatcctcgctttaagaggactgcacgttctcgccttctgagggctgcacgcctttgccttcagaggacagcacgtcctcgctttcagaggactggaattcctcgccttcagagggcttcacgtcctcgccttcgagaggactgcatgtccttgccttcagaggactgcacgtcctcgccttcagaggactgcacgtcctcggcatttggaggactacaccttcacgactttagaaagtgctgcacgtcctttcctttatcgggtctgtacctccttcttcagagggctctacacgtcctccccttcaaggactataggtcctcgcctttagtagggttgtatgtcctcaccatcagagggctacacgccctggccttcagaaaactgcacgtccttgctttcagagggctacacatccttcgcgtttag

SEQ ID NO: 45482 - DNA, 485 bp, Glycine max
  Peptide Sequence Number=SeqID_137167
agtactaccaagtcatcaccagcagagggctactcgcccccacctctagaggactaacaagtcctcgccttgagagggctacacgtcctcgccttgagaaggactacacgtccctcaccatcagagggcggactacacgtcctcgccttgagaggactacacgtcctcaccatcagagggctgcacgccctcacctccagaggactacacgtcctcgccttgagagggctacacgctcaccttgggtactagttaccctcaccttgagaggactacacgtcctcgccttgagaggactacatcgtcctcaccatcagagggctgcacgccctcaccttccagagggactacatgtcctcgccttgagagggctacacgccctcaccttgggactacacgtcctcaccatcagagggctgcacgccctcacctccagaggactacacgtcctcgccttgagagggctacacgccctcgccttggag

SEQ ID NO: 45483 - DNA, 165 bp, Glycine max
  Peptide Sequence Number=SeqID_137168
atggtggaatggtccccacagtgcacatgggagctggtgttgacgatgaaacgagaaagagcacaagacgtttatgaaaagcgtgcaatagctttcactaatttggcaaagaggcctcccatttgcggcaatgcaaacgcacctcctctttccctcattaattga

SEQ ID NO: 45484 - DNA, 753 bp, Glycine max
  Peptide Sequence Number=SeqID_137169
atggataagcgttcttgggtgaggggccaatggatcccatatgatgtctctgctatcaaccaattcctagggcatccattgatcttagaagagagccaaagttatgaatacgctgaaagaaggagccaagtcttaggttttgatgaagaggccataggccagctactatgctccccgggacatgattttgcatggagcgtagcgaggaggcaggtgtggatcatgcgcactagcatgaccactttgactcagatctggatgacgcttctgctcagcaacatccttcctaatgactataattctgatcttccgcttcctaaatgccaattgttcgacgctatcttgacccagaccagtgttcatgtagcacgacttatctcagatgccatctaccagtttataggtattgcacctctgagacacccagtggacccagagaagtccaataagggattgggattttcagcattgatcacaggcctctaccagttctacggggcaggcagagtagctggggcaagaccaacagcagcagccgacaacagatgtgccatcatcgcctccacatcagccaccatccctagagtccatctcaactcacatgcagaggatggagctccagatgcacacttacatgcatttagaaccactatcgcatggcctgggaacaggcctaattttcaaggaggtgcaggtcccacagaggcccaaggagatgaagacgaagctgaggaagatggagatatggaaaat

SEQ ID NO: 45485 - DNA, 228 bp, Glycine max
  Peptide Sequence Number=SeqID_137170
atggtcttggctgtcctttggcttattccccgatcggaatggacaactggtgacctcggaagaattacgggaatggaattcaggctgaaaagcgcgagacacagagtaaggggtttacagaaagtggaatgtggaatggataaagagaagaagaggtcgactagggcgccaactaagggccaaagagacaaagaaccaccagcggctccaccgagtttccccgggtag

SEQ ID NO: 45486 - DNA, 576 bp, Glycine max
  misc_feature (324)..(324): n is a, c, g, or t
  Peptide Sequence Number=SeqID_137171
atgcggactacctgcacctggacagaaagaccctatgaagcttcactgtttcctgggattggctttgggcttttcctgaacaacttaggtggagggcaaagaaggcctccttctgggggggccagagccatcagcctcccaaaaggtaacggaggcgtgcaaaggtttcctcgggccagacggagattggccctcgcatcctcaggcagaagggagcttgactgcaagacccacccgtcgagcagggacgaaactcacatcgacgggaaggtttggcacctcgatgtcggctcttcgcctcctgccgctgtagtatgttccaanggttgggctgttcgcccattaaagcggtacgtgagctgggttcagaaacgtcgtgagacagttcggtccatatccggtgtgggcgttagagcattgagaggacctttccctagtacgagaggaccgggaaggacgcacctctggtgtgccagttatcgtgcccacgagcctccggtagcacagccgagacagcgatgggttctctgccccagcggggatggagcgaaagaagttttgagaattcaagagaag

SEQ ID NO: 45487 - DNA, 231 bp, Glycine max
  Peptide Sequence Number=SeqID_137172
atggcatgcgacctttctttggtccttgtgaggtgcttggcacccatcattaggcaatttgtgaaattccaggacatgccggaaaaccaaaaaatattgatgcacaatccgcccttccagaacattttggaagttgggttgcttaaggaggaagcaactgggcggcaagctcctccacgttttagaaaaatggttttcggggcttccgcggcttctgtaatacttccgtaa

SEQ ID NO: 45488 - DNA, 201 bp, Glycine max
  Peptide Sequence Number=SeqID_137173
gattcaacaagcgattctcctcaaatttcagccagcccgtatcaattagaccttgcaccttacgcttcagagccgtacaatgctcaatggaacgccccggggcttctccgtgacaagcacacgttgcgttcgagtcgtattctcggagaaatggagggggtcttcgccattggaagtgcggtaaacaggctttggggttga

SEQ ID NO: 45489 - DNA, 192 bp, Glycine max
  Peptide Sequence Number=SeqID_137174
atggcaagagctggtgacaatggtggtgtatatcatcaactggacgaatctcaacgcttatttctggacgcgtggactacacaaatgcaacgtttgttgaaccgtaacaaagaaaagccctacaaacgaatagccaaatcttcctcatttactcctaaacctctatcccctagagaaaggcgagtgaagtga

SEQ ID NO: 45490 - DNA, 405 bp, Glycine max
  Peptide Sequence Number=SeqID_137175
ttgctcgtacaataccaacaacaaccttcttctatagccattgtcgaagcaaccgttcaatcatcacaaattcacgaaacatcatacactgactaccatactcaaatctatcatgaaggcccatcctcatacacaccaatcccatacacgaccataaatgattattacgtccctccttttgaacccaccgaattcgatacccacattacttcatacacacaactgcttggtggatcgtcgaactattgtgagatgactccccaactaaatgagcccacccaactaaatgtcaacccaactactgatatccatgttgctcagtctgaaagcaatgaaatgtcacatgactatcatgctcaaaatggtttcacatttataaaagagttcgtctccacagggacttga

SEQ ID NO: 45491 - DNA, 312 bp, Glycine max
  Peptide Sequence Number=SeqID_137176
atggtgatgagaatcatgaaattggtcaaatacagactaaaggcccaagtggagaaggacgaaggcccaagtggagaaggacaaagcccccgagtggagaaggatgaaggcccaaaggtaatccttgtggcgtctacccacttatcttccttcactggaagtggcatcatccaaatctccgtagcctgtatcaaacgattcgccccgaacttaagagtgaacacgagtggtaaaaggaaagaggagctggtgacaatgatggtgtatatcatcaactggacgattgtcagcgcttattactggacgcgatga

SEQ ID NO: 45492 - DNA, 90 bp, Glycine max
  Peptide Sequence Number=SeqID_137177
atggataaaagcttgaaggtaggagaagatgagtggagggagagggagagaggggaacaaaattttgagagagagaagagggagaatgag

SEQ ID NO: 45493 - DNA, 117 bp, Glycine max
  Peptide Sequence Number=SeqID_137178
atgtcatcaggaaagacctctaggaattctgacatcaccggtatactgctgtcataccctaatttcgtccggggaccgttgcttgatgacatgcaacttttgtttggtccttgtgag

SEQ ID NO: 45494 - DNA, 338 bp, Glycine max
  Peptide Sequence Number=SeqID_137179
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacgggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgtt

SEQ ID NO: 45495 - DNA, 570 bp, Glycine max
  Peptide Sequence Number=SeqID_137180
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagcccaatccctggggttcatcatgccgtttgtgatggcttccatgtcggcaggaatgctttatgaattacaacagtactgcgatgagtggcagggcgggcggaatttttttaagggagttattggtgcctag

SEQ ID NO: 45496 - DNA, 228 bp, Glycine max
  Peptide Sequence Number=SeqID_137181
atgtctgttgctcagcaaggcctggtactgtacgcggctgaacgcggttacctcgaagatgtggaactggcgaaaatcggtagcttcgaagccgctctgctggcttacgctgaccgtgatcacgctccgctgatgcaagagatcaaccagaccggtggctataacgacgaaatcgaaggcaagctgaaagctatcctcgattccttcaaagcaacccaatcctggtaa

SEQ ID NO: 45497 - DNA, 272 bp, Glycine max
  Peptide Sequence Number=SeqID_137182
tatttcgggccggatgtcaggacatcgtgtccgacatcgtggatcctgcagcttcacttctgcacttgacttttatcttgcattgtacagcaattccagtattctcggcaggatgtcaggacattatatccgacatcgtggatcctgcaacttcaattcttcatttgacattttatcttgcattgtacagcaactccagtattctcggggcaggatgtcaggacattgtatccgacatcgtgaattctgcagctttcaatatctacatttga

SEQ ID NO: 45498 - DNA, 384 bp, Glycine max
  Peptide Sequence Number=SeqID_137183
atgaaggggaggacgtgcagtcctctgaaggtgaggacgtgcagccctctgaaggcaagggcatgtagccctttaaaggtgagggcgtgtatccctctaatggccaggacgtgcagtcctctaaaggcgagggcgtgcagccctctgaaggtgaggacatgcagtcctctgatggcgagggcatgtagccctttgaaggacgtgcaatcctctgaaggtgaggacatgcagtcctctgaaggtgaaaaggaactactagtccccttaactgggagcgtgcaggctcgattaagcattaagggtgaggaacttgagttctctgaaggaacagatatggagcccactgaaggtgaggaaccctctgatggcgtaggcatcctctaa

SEQ ID NO: 45499 - DNA, 556 bp, Glycine max
  Peptide Sequence Number=SeqID_137184
gcaagttggaagattccgtttcggttgaagggttcctctcggtgtggggtttcaacggagaacaacgacggtttgtggtggctaatggtgcctgtgggctgaaatgcttaaatgagaaatgctcttgggaacggaagcttcgtgcatactccagacatcgtctccaagatcccaacggtcagatcgtggacaagtgtcttgtgaagctgcaaacaaaatttaaagacaatccaacggttaacgaaggctgcacagtgtttttaccgaggcagcttcatgtagcttcctcaacaagcttcattaagaggcttcctcaaaaagcttcctctgatcaaggggttcccatgaaccctaagagaataaaggtcattcctgagtggcccactccaccaacaccattcattgagttggtgagaaaccatgttccttcatgggaagatgcccaggaaatgggtgttgagggaaggagcccagagtatgaaaaaccttgggatttgaggtcaaatcctttccaaggtggagggaatgatgcaatcctatctcgcaagggcattgg

SEQ ID NO: 45500 - DNA, 100 bp, Glycine max
  Peptide Sequence Number=SeqID_137185
tgtcatgaaacgtcttaaagaaagcgacattgtccgcgactctgtagatgcaattggctttgatgttttgatgatgatcatgataatgtgttgcaattga

SEQ ID NO: 45501 - DNA, 387 bp, Glycine max
  Peptide Sequence Number=SeqID_137186
atggcagcgcaattgatccatgatcgcgtggtgatggagtgcctagagggtgattgggaaccctcgaaggcaatgagagtacatccggaggaacccgcacacacacttcagcagcctgtggagtggatactacctacacctactccatatcaactagttgagccagttcaagtgatagaggtgtcatcctctgaagaagatcttgaagaggacccagaggaattacctcctgaacctgctgtggatgcccttgatttcccagaggatgatgaggacccactccctgatgttgattctccagaggatgttatgtcagcatctgacgcagactctacagaggagagcggccttggagggacaacgaataatgacgactcttcatcgtag

SEQ ID NO: 45502 - DNA, 282 bp, Glycine max
  Peptide Sequence Number=SeqID_137187
atgtttgcacacttgattaaaaggctgccgtcccttgtgacggacgcgtggggtgctaataccttccccatgcgtaaatacaactcccgaacctttcacttaaagttcgtagaccatgtctttttccagttttttcgacgttttcctcaaataaacgttggtggcgactccgcacattttcctttcttggaagatgcacccgtgagtctcgcgtcgccctcccgccgaaggataggttgcgacagctcaaaaagggagcaaaggatgcaattatcattcaag

SEQ ID NO: 45503 - DNA, 387 bp, Glycine max
  Peptide Sequence Number=SeqID_137188
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactgggtaattga

SEQ ID NO: 45504 - DNA, 587 bp, Glycine max
  Peptide Sequence Number=SeqID_137189
gggggtgtacttagtagaaatgggtgtgcaaatagcaaccagacccacttgggccctccagaagattcctcccgaaggctgttgcttctggaggaagcaaccctgctcgcctgggcgagctgggctcgtctatccgctacgaggtcaccgctcgtgcgtcgaaaaaggaaaggcgacttgggaccaactcttggctagtatggaggggcgtctgttaattggttccctcgctagaaggaaggaagaatcaggattctatcttcatgcgaaggatgagtgccatcagacgaaagcatcacgcctttcatcgcacggggtttcagtgaccacaacgcgagggtactccaaggagttcgcaaggcatgggatgcggcatgaagaaaggacagagagcttaggggaaactgtgagagacgatgaggttaaagcttcggaagaaagtgatgaggtacaagccctaaaggcagagcttgaaagagcccgggtagtcgaagagaagttcaaggcagcaatagtgagctcaagctccgaagaggtgaaaggaatcatcacgggtcaaaggcatgatcttgaaggacgagctaaag

SEQ ID NO: 45505 - DNA, 300 bp, Glycine max
  Peptide Sequence Number=SeqID_137190
atgaccgaccctctcgatgagtcaatctcttgctttctcacaagggtgaacccttgggtactaatacctatcttcttcagaggattacacgtcctcgccttcagaggacttcacgtcctcaccttcagagaactacacgtcctcgtcaagtcagaggactacacatccttgtcttcagagggtctgcacaccctcacctttagaggacttcacatcctcaccttcagagggctacacccccttcgccttaagagggctgcacgcccttcgcctttagagggcttcacgtccttgccttag

SEQ ID NO: 45506 - DNA, 63 bp, Glycine max
  Peptide Sequence Number=SeqID_137191
atgaaaatacagaaaaaggtgttgacgaaaaaagcccagagttttaaaaacctcaggatttga

SEQ ID NO: 45507 - DNA, 642 bp, Glycine max
  Peptide Sequence Number=SeqID_137192
ctgttggccccgatcatcagtcaatggaacaatcgagctgagtttagggtcgatgtttatcctcgacaggagggcctactgggttttaactcggactacatggtgtggtataggcgtaaaacaaagatgtttgtcgacccaaacaatggtgaagttgtggagactttacagtatattgtgtcaccacaagggaagaacacatggacagttaatgatctcgtgccttacatgaaaaagttagcgattatatctgaagagcaagagagaatcactgagccagtgtcacatggtccaacatcagagtgtgaattcccagcacaagagtttcacattcttcaatcaagtgttgaaactcggggcataggtagacgaagggagcctattgaagcggaacaatattcccaacaaatgatggagcgtggtcatggaatgtattacacgccagcaacattttcccaatatccttcacagatgtatcagtatccttttgaaggtcatcacattgatacttctgcgagcgaacatttgttcggtggtgttgcgaaaacacggcctcatttttcatggcccattatcactccttcacagcaacacgatgccccaatggcaacacctaacgccccatttgctccgcaatggaat

SEQ ID NO: 45508 - DNA, 276 bp, Glycine max
  Peptide Sequence Number=SeqID_137193
atggtgaaagttgggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 45509 - DNA, 50 bp, Glycine max
  Peptide Sequence Number=SeqID_137194
atggcgccgcctcttacctcttctcctttgtctttcaatgcatctccatg

SEQ ID NO: 45510 - DNA, 295 bp, Glycine max
  Peptide Sequence Number=SeqID_137195
gaacccgcacgcacacttcagtagctgtggagtggatactacctacactactccatatcgactagtggagccagttcaagtgttagagttgtcatcctctgaagaggatcttgaagaggacccaaaggagttaccccctgaacctgctatggacgcccttgacttacctgaggatgatgaagacccactccctgatgttgatcctccagaggatatcatgtcagcatctgaggcagactctacagaggagagtggccctagagggataacgaatagtgacgactcttcatcatag

SEQ ID NO: 45511 - DNA, 117 bp, Glycine max
  Peptide Sequence Number=SeqID_137196
atggggaccaccacgggggaggagcttgccacccagctcgcccaggcgagcaaggttgcttcctccagaagcaacagccttctggaggaaggatctgggatgcccaagtgggcctga

SEQ ID NO: 45512 - DNA, 309 bp, Glycine max
  Peptide Sequence Number=SeqID_137197
atgagtcattattcatctagtgctaatgacgagggaagacataggtcacatcttagacctcactcccataggagagaaaaggaaagaaagcctcaaaaggctaacattaacctctcatacttccatgggaaggacaatgtagaggcttacttagattgggaaataagggtagaacaacaacttaaaaggaagtctacttcaaaatcttatggcgctcactcttatccaaagaaagaccaaggtcaaggcatcttaggggtgacaccttttaagcccaaagatgataaggggaagacaatagaaaagtaa

SEQ ID NO: 45513 - DNA, 558 bp, Glycine max
  Peptide Sequence Number=SeqID_137198
atgaccaccctaactcggatatggatgactttgctgctcagcaacatcctgcccaccgatcataattccgacctccccctgccgaagtgtcagctggactctgcctcgttcggcgtccccgtcgcacctagcaaggtgattcggccgcccatcacccgagcttttattgagaagtactgcacacagagacaggtccagggtgatgcaccacaggccgcggacgagccgccacctcatcaggctggtccagccggatcgtttgatacggagcagtatttgcggcatttggttcgccagcaggcggccaaccaccgggcgcatgtacagactcatgattgtctttatcagatgagtctcagcctgcagagccagggctttatttcttttccgtgccctactccggaccagttcagggcagaggtcgcgtggcttggagattggcctgaggcccaggcaggagaggcaccagcagaggctcccgacgaggcagatgaggcccgcgaggacgaggagatgaccgatttacttgatttcttaggaggaagcggggccacatga

SEQ ID NO: 45514 - DNA, 645 bp, Glycine max
  Peptide Sequence Number=SeqID_137199
atgaattcattgcctagcactgttcatgtgtcctccaccaatgattctggagccccgcgaatttattgcctagcgctgttcgccaattctccattctccactattatccggagccccatgaatttattgcctagcgctgttcatgtgtcctccaccatcgagtctggagccccgcgaatttattgcctagcgctgttcgccaattctccattctccacttttattcggagacccatgaattcattgcctagcgctgttcatgtgtcctccaccaacgagtctggagccccgcgaatttattgcctagcgatgttcgccaattctccattctccacttttattcggagacccatgaatgcattgcctagcactgttcatgtgtcctccacccacgagtcaggaaccccgcgaatttattgcctagtgctgttcgccaattctccattctccacttttaaccgaagccccatgaatttattgcctagcgctgttcatgtgtcctccaccatcgagtctggagccccgcgaatttattgcctagcgctgttcgccaattctccattctccacttttattcggagacccatgaattcattgcctagcgctgttcatgtgtcctccaccaatgagtctgaagccccgtga

SEQ ID NO: 45515 - DNA, 477 bp, Glycine max
  Peptide Sequence Number=SeqID_137200
gacaccctcatccagtgccaacatagtaagccagtatacactccgctagcgccccaatacgcaaaccgcctctccccgcgcgttggccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcgggcgcattaagcgcggcgggtgtggtggttacgcgcagcgtgaccgctacacttgccagcgctga

SEQ ID NO: 45516 - DNA, 126 bp, Glycine max
  Peptide Sequence Number=SeqID_137201
atggccctcccatcattgtggccatttgctctctcatggcctcccatgtcggccttcatctgctcttgcacctcctctacttcacccattactcttgctctagcacgggttcggacatggggttga

SEQ ID NO: 45517 - DNA, 324 bp, Glycine max
  Peptide Sequence Number=SeqID_137202
atggagagaagcatgatagatgctgccagtggtggagcccttggagacatgacccctgctgaagccaggaatttaattgagaagatggcttccaactcccagcaatttagtgccagaaatgatgttattgtcattagaggagtgcatgaagtagccacgaattcatcttcatcagctgaaactaagaagcttgaaggaaaactagatgccttggttaacctgatgtctagccctcaacaacaacaacagcagcctgctccttccttccaaaatgctgctggcccaagcagaccatacattcctccaccagtccaacaacagtaa

SEQ ID NO: 45518 - DNA, 800 bp, Glycine max
  Peptide Sequence Number=SeqID_137203
atggtgaaagttggaacctcttacgtgccgatcaacgtctcattttcgccaaaagttggcccagggcttcccggtatcaacagggacaccaggatttatttattctgcgaagtgatcttcccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccgctttgtggatgcagtcaaaaagcttggtggccctgatatgtataatgacgacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgaggaatatgtgatacagggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45519 - DNA, 290 bp, Glycine max
  Peptide Sequence Number=SeqID_137204
gatggctacacgccctcaccttgggaactagtaccctcgtctccagaggactatacgtcctcaccttcagaggactacacgtcctcaccatcagagggctgcacgccctcacctccagaggactacatgtcctcgccttgagagggctacacgccctcaccttgggtactagttaccctcatccgtcagaggactacacgtcctctaggtgccttgagaggactacacgtcctcaccatccagagggctgcacgccctcacctccagaggactataagtcctcgccttga

SEQ ID NO: 45520 - DNA, 258 bp, Glycine max
  Peptide Sequence Number=SeqID_137205
atgggggtgcaaatagcacccaggcccacttgggccctctggaatattcctccagaaggcggggaggaaggcaagaaggaaggggtcagccccttaggcacttctctctctttcgaatttgcttggaaaaatcgtttccgtgaagaaaatctaagccgaggcgcttccgaaacgttttccgtgaggaatctcgcaaaggtttcgatcgttcttcgaccgttcttcattcgttcttcatcgttcttcgatcttcaacgg

SEQ ID NO: 45521 - DNA, 429 bp, Glycine max
  Peptide Sequence Number=SeqID_137206
atgtcgcctaaggcgatgagttccttcggtagaggagggaggtccgacaaaggagtagcattggctctaccagagctagctatcaaaaaagcatcctcaatatcttttgggtcacctacccagactgggtcatctacccagaaatcaaaacttgatgggtcatcaacccaactaacctctatcaaacttgagtcatcaactcaggacttcccaaaacctatcacctccaaacagaccgtggcagattatgcctggtcaatccaaaccctccaagcccttgaagaaacaggcctcaccaaggtccccagatggagccagaatattgggacaaaaatccctttaaggcaactgcaaaggccttcccaccaggattccattacaggccaacgaccctcaataagaccaggaaattttatgagtttatcttag

SEQ ID NO: 45522 - DNA, 261 bp, Glycine max
  Peptide Sequence Number=SeqID_137207
atgcaaggtctggattggctcccaagtttgagaaccactaagggggtagaaattgaagctccagaggaggacgaagaggtgcaggccctcagggcagaactcgagaaagcccaaacagtcaaagaaaagttcaaattagcagctcttaagatccaaaaggagaatgccgaactgagagacgtaaatatagccaccaccaaggccttggaacaagagaccaaaagagcccgtagggaagaacatggccagaacaaattctga

SEQ ID NO: 45523 - DNA, 186 bp, Glycine max
  Peptide Sequence Number=SeqID_137208
atgggtgccaagcacctcacaaggaccaaagaatggtcgcacgtcatcgagcaaaggtccccggacgaaattaggggaccgtcggctttactgatcccaagatcgacatggaccagcggtctctctgccccaactggtctagtcaccaatgatcttaaccgtgtgacttttcttgtccgcttcaag

SEQ ID NO: 45524 - DNA, 438 bp, Glycine max
  Peptide Sequence Number=SeqID_137209
atgtcaggatttacacgcaattctcctcaaatttcagccagcccgcatcaattagaccttgcaccttacgcttcagagccctacaatgctcaatggaacgccccgaggcttctccgtgacaagcacacattgcgttcgagtcgtattctcggagaaatggaggttgatgaaccttggctagggttatggctaccattgaattatcaagtagatatgggagcaagctttctcgctgcaaaattcacttcttggttggtgtttttggtttatgctaaaggtggtgttcgtcattggaagtgcgtagacagactttgtggtagatttagggatggctttgtggatgactgggtggtgggaacggcagtcgcaacatgggtttctccttcattctcaccctcttcatttgccccagttttcttattcgtccaagcaggatga

SEQ ID NO: 45525 - DNA, 273 bp, Glycine max
  Peptide Sequence Number=SeqID_137210
atggtgcatctcttgttgatcaattcaagtggagggtacatccacttcggttttcaaagagaacaagggaggggaaattccatccataggccacctatctttaatggtgagggttaccattattggaaaacctgtatgcagattttcattgaagccatagatttaaacatttgggaagcaatagaaataggaccttacatacccaccgtgatagatgtaagtactagcaccacaacacaaaaacctagagataagtggactgaagaagattga

SEQ ID NO: 45526 - DNA, 525 bp, Glycine max
  Peptide Sequence Number=SeqID_137211
gccttgtcttcaaaagccaaggggaaggaaaaagaggaaaaggattcctccaagaagattgttaagaaggaaaatcattttgcaacaaaaggtgatatcaaaagagcactccttcttaaacaatctttctaccttctactatcaagggaaacatcccttagcactgccatacctcttgagcttgaggttattcctcaagtaaaggagttgttggataagggtttggttcgtaagagcttaactccatgtgctttgttggtgcccgaaataggtattatgaggcaccgaatccctatgataagtggtatgatgaatgtgttgaatggtgcaacactcttttgtaaaatcacccatgcatccaacatcttcatgattcacatacatagggactcattaggtaggggttccaacgaacctaagagaataaaggtcattcttgagtggcccactccaccagcaccactcatagaattggtgaggaaccatgttccctcatgggaagatgcccaggaaatgggtttttag

SEQ ID NO: 45527 - DNA, 1596 bp, Glycine max
  Peptide Sequence Number=SeqID_137212
atgcccgtcaattttgacctcaacgatctctacgccttccgcgcgctggtggagtacggcaactttcgtctggcggcggagtcaatctgcctgtcgcagtcagcgctcagccgcagaattgagaagctggaagcggcgctcggtgcccggctgtttgaccgcaccacgaggcgcgtcacgctgacgctgtatggtcagaactttgctcagcgctcggagcagttgctggataatgtcgaatcgatgctggccgacgtcgagcgcgccagccaggatcgcactggcctgatcaccgtcgctaccgtgccctcaggcgcttactattttatgccggaggtgatccgccgctttcaggcgcgttacccgcgcgtgcgcatcaagctgattgatagcagcgtcggaaacgtgatggatgcagtgagcagcggacaggccgatttcggtatctgctttgcgcgcaatttaccgccggagctcaccttcacgccgctggtggaagatgtttacgtcgccgcctgtcgccacgatcatccgctggcgacgcgccagcagctcagctggcaggagtattttgcgcaggattatgtggcgctggataagtgcgctggcgcatcttacgcccgcccggcaaagtatctgcgaaacgcgccatgtcacgacgctgctggggatggtagaagcgggcatcggcattgctgccgtgcccgcgatgtcgatgccggcgaacgggcatccgctgctgcgccagctggcgctgaccgatccgcaggtcacccgttcggtaggattaattcgccgcagcggacgtatgcaatcttacgtcgctgcggagctggaaaagctgattatcgaacagtctcagcacgcttaacgcgcggtttgcaacgtcagcgcgcggcggcgatacagcgcggtagacaccaccggcgtgaagccgccaaacagcgcggttgccaggctgtaggccagcgagaaaccggcgacgcgcacttctgccggcatcacttcggtcagcgccgggatcatcgcaccgttatacaggccgtaaataaacgacagccacagcagcacgctcagcatcatgctgaaggtcggcgtctgcgccagcagcgtcagtgccgggtaggcggtcgccagcgccagcagcgtcatcgccagcagcaccggtttacgcccaaagcggtccgacagcgcaccgccaattggcagccagataaagttggagatcgccaccagcagcgtcaccagcaggctgtccgaggcgctcagcatcagcacttttttgccgaaggtgggcgcatagacggtaatgaggtagaacgcggtggtggtcatcgccaccatcagcatcccggcaatcaccaccggccagttctgcaacagcgtgctaaatacctgacgcatatccagatgatgacggcgcgcgctgaactcctgtgtctcttccagacggcggcgcagaataaagataaacggcacgatcaggcagccaaacaggaacggaatacgccagccccagcgctgatggcgctctgctccagcgcggcattgagcgcgaagcccattgcggccgcgaccatgatggcaacctgctga

SEQ ID NO: 45528 - DNA, 288 bp, Glycine max
  Peptide Sequence Number=SeqID_137213
atggctttaactgacttttgctccggctcttggagtgagcggataacacatttccacaggaaacagtctatgaccatatatcgccaaggcgtcgaaattaaccctcatctaaagggaacaaaagctggtaccgggccccccctcgaggtgacggtatcgataagcttgattacgggaagcccaatatggccaacttcttcgcccccgttttcaccatgggcaaatattatacgcaggcgacaaggtgctgatgccgctggcgattcaggttcatcatgccgtttgtga

SEQ ID NO: 45529 - DNA, 788 bp, Glycine max
  Peptide Sequence Number=SeqID_137214
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggcgagtatgctccagtgaattacacggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45530 - DNA, 387 bp, Glycine max
  Peptide Sequence Number=SeqID_137215
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtctttgaagtcatgcgccggttaaggctaaactga

SEQ ID NO: 45531 - DNA, 702 bp, Glycine max
  Peptide Sequence Number=SeqID_137216
ggctacatgccttcgccgtcagacggctacacgtcctcaccttcaaaggactacacgtcctcgccatcagagggctgcacgctctcacctttagagggttagacaccctcgccttcaaaggactacacgtccttcaccttgagagggctgcacgccctcaccttcagaggactacacgtcctcacaatgagagggctacacgactacacgtcctcaccttcagagggctacacgccctcaccttcagagggctgacgtcctcaccatcagagggctgcaagtgctcggctacagaggactacacggctgcacagccctcgccattagagggctgcacgcctccttcagaggactacatgtcctcacttctcagagggctacaccctcgcctcagagtgcgaacttttgaggactacgtcctcacctttagagggctacacgccctcaccttaaggagggctacacgtcctcaccatcagagggctcagcacgccctcatgaggactacatatcctcaccttcagagggctacacgtcctcaccttaagagagctgcacgtcctcaccatcagagtgctgcacgccctcaccttcagagggctacacgtcctcaccttcagagggctacacgtcctcaccttcagagggctgcacgtcctcgcgttcagaggactacacgtcctcaccttcagagggctacac

SEQ ID NO: 45532 - DNA, 258 bp, Glycine max
  Peptide Sequence Number=SeqID_137217
atgttttccaagaatgagggaatgatgagaatcctgaaactggccaaatacaggctaaaggcccaagtggagaaggccgaaggccgaagtaatccttctggcgtctaccctgacttatcttccttcaccggaagtggcgtctaccctgacttatcttccttcatcggaagtggcgtcatccaaatcttcgtagcctgtatcaaacgatccgctcctactcaggttcacatcatctggtatcagagcttcggctcttga

SEQ ID NO: 45533 - DNA, 189 bp, Glycine max
  Peptide Sequence Number=SeqID_137218
atggtttttcacttaaggcttgtagtgaacttcaaaacaaggaaagggaaacaaggctcaaaaaggctatcaaaggaattaattcaagatatgcatgtgaattgggacgcatcaacaagaaacttcaagccaaggctattgtcaatcaatggggcaaaacacacaggaatgatagagaggaatgggtaa

SEQ ID NO: 45534 - DNA, 854 bp, Glycine max
  Peptide Sequence Number=SeqID_137219
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtggatcacctgaggtcaggatttctagaccagcctggccaacagcaggagaatcacttgaaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45535 - DNA, 896 bp, Glycine max
  Peptide Sequence Number=SeqID_137220
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagtttgctcaggagggttaatcaatgcctattaccgtacatgcttacagttcactagaaaatctaggaattcgtacccagctagagcgactttatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45536 - DNA, 426 bp, Glycine max
  Peptide Sequence Number=SeqID_137221
ttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggtcgcaaggctgaaacttaaaggaattgacggaagggcaccaccagagtggagcctgcggcttaatttgactcaacacggggaaacttaccagtccagacata

SEQ ID NO: 45537 - DNA, 588 bp, Glycine max
  Peptide Sequence Number=SeqID_137222
atgggaacaaatcaaactggcaaaaagttttatcaagtcaaggtcaagagcctaggaatcaccagtctaaaagagttagggcagtttatgggtcagctccagcggcaagcttttcgcaaagcttatggtaaaatctgggacctagccatggtagaagtctccacagaggccattgcttccctcacccagtattatgatcagccattgaggtgcttcacctttggggacttccagctatcacccatggtagaagaatttgaagagatcctaggatgtcctctatggggaaggagaccatacctcttctatgggttctatccctcattaggtagaatttctaagatagtccaaatctcggcacaggaattagaccacagaaagcaagtcaaaaatggggtggttggaataccgagaaaatatttggaggcaaaagcaataatcttggctggtaaaggcgaatgggccccgttcatagacattctcacactgttgatcttcggaggattcctttttccgaatgtggatgggttggtggacctagcagcgatcgatgcttttctcgcctatcatgaccataaggaaagcccg

SEQ ID NO: 45538 - DNA, 213 bp, Glycine max
  Peptide Sequence Number=SeqID_137223
atggggagaattaagtttgtcatcatcaaaaagggggacattgtagaagcaagcttcatgatgatgaaccaagcaattttgatgatgccaaaagcccaagtgagtgattcaagattgattcaagacttcaagatcaagcataaatcccatccaagattcaagattcaagagaagaaatcaagaagcaacaagtcaagacatcatataggataa

SEQ ID NO: 45539 - DNA, 360 bp, Glycine max
  Peptide Sequence Number=SeqID_137224
atggaggccatgaaagagcaaatggccacaatgatggaggccatgatgagcatgaagaagatcatggaagccaatgcggttgcaatttccactaccagcgttgttgctaaggtgaacccgatgccccaatggcctcaaccaaatgaatcatccaaccttagatatgccgacttcgagccttgcctcggatatgccactgaagggcaagtagttggtggtatactcctacaaaacactttggagggccctcaattttgcccccagccacaaaccttgcattccgcagcaggtaaaatccctcctattatggaaggaatgggaaaagttggatcatttagaggaaaggctcagggtcgttaa

SEQ ID NO: 45540 - DNA, 726 bp, Glycine max
  Peptide Sequence Number=SeqID_137225
atgcccactaataacagagagattgaggctgctttgcgtatacccagccgaggatttgttttaaatgttgaaagccatcctaggaagatcctcatgaaagatctgacaactcttgctcaggtttggagtgttctctcatactccaacctggctccgacttcccacacctctgatttgactttagatagagctaggttaatctttggtctagtctctcagttggacatgaatgtaggagctctcatctctggccagatcacatctatggctcagtctaactcctctacacttgggttccctgctcttatcacaactctatgtaggtccagaggggttgcttctaacagcctagtcttcgaacgcttgagcccggttattaacttggcctatatcaggaagaactgttggatccctactgatctggcagttactattagaggggctaggagagcaagggcaaggccagctaaggctctttccacatctgcaactcctcctctagcacgtacctcagcagctccttctaccccatcttctacagactttcaacgtcttgaagccatgtgtcatacccaaatttcgtccggggattattatttgatgacatgcaacctttggttagccgctttgagatacttggcgtcctttgttgcacaaaaaatgaagtcccgagacgtgtcagaaataaaaaggaagcaggcttacgcgatccgtgaaattccataa

SEQ ID NO: 45541 - DNA, 267 bp, Glycine max
  Peptide Sequence Number=SeqID_137226
atgctcttgataccacttgatgtaagctccattggagcttgtagacctaggatcttcttcatcaatggattcattttcttcttggaagatcaatggcagtggaatggagaaaggaagagagagaggagacgccacttcaaggagaagatgagtctagaagaagctcaccatcataggaggccatggataagagcttggaggaagaaggagaggaagagaagagcacgaaattttgtgcgcgaaatgacttggaaatctgaagtttaa

SEQ ID NO: 45542 - DNA, 453 bp, Glycine max
  Peptide Sequence Number=SeqID_137227
atgaaacagtcccactctcccaattttacaaaatcatattcatatatcattggggcatttcaccgagcacttggtgggtgcatgtttggacataaattgcaagagaatgggggcaatgtggcatgccccattgcttcagaatacaacacagccccaaggccttctcacacaaatcctcaactcaacaaatcaagcatcaaagcaacccaaaactgcctcacaaatataagcacgttctcacaatttagagcaccgaaagatgaagaaaacacatcaatggtgtcgcaacgtgcccttttgcgggcgagcaaggcgaggctcacgggtgtgctttccaaaggaggaaagatgcgcggagtcgccaccaacgtttatttgtgggaaacgtcggaaaaaccgaaggagaccggtcaaaatgaaaattctaagttcgggagttgtatttacgcttga

SEQ ID NO: 45543 - DNA, 1021 bp, Glycine max
  Peptide Sequence Number=SeqID_137228
agggaagttcgattacgtttcctccacaagtgccaatgctaacagaatcggagcaactggggcaaaaaggaaggaaggagatacccatgtcgtcacttcggcacccgcatgggtcaagcccccgcaggcctctcatggtacccatcagtatgcgcaacatcacccgagcttctcagcttgcgtcggaaactcttccaattcaacacccgtacagcctagggcgtccgcccccatccagagggaggccccccaagcttcggctccaaccacgactcgcccggccgacaatgcccactttggcgccagttccaacatgatgaggaactttcccccgaagccaattctagaattcaccccactcccaatgacgtaccaagacctattgtcgtcccttattgtcaaccaaatggccataataactcccgggaagatctaccaaccccctttcccaaagtggtttgatcctaacgcaacttgcacgtctaagcctttaaaggacgtggcgacccctaggaggtttatctttgagaccctacaaatgggaggtgtgattccccacagtgggcatgaagaggattcttgtttgttgcatcccagcgagctacatgacatggaatcatgtttagcagtggaagaattgttgcaacaaatgatagatcaaggccgactggaagtcggcgatgaggggagggaagagcagcatatatgtatgcagtccgcggatgagagaagtcttggaaggcctaaacctttggtgatatatttcaccaaggacgcagcttcacaaaagccccgatacccctcggcagccaaacttgttcctttcccataccaaaacagccacgcagtcccgtggaggtatacacctctaagtgaaaggaaagaagaagccaccgacatcagctcgttgtcggccaaggtaaccaatatcacgaggttgagcggtgtgacccgcagcggtcttgtgtttgcaccccccgacctgccaacacaacccgcaaacattaaggggaaggcaaag

SEQ ID NO: 45544 - DNA, 90 bp, Glycine max
  Peptide Sequence Number=SeqID_137229
gaaggaccagttttcagaggcttttggagccaaactcaggttcctggaattgctccttatagagttgtccttgaatatataaaagataag

SEQ ID NO: 45545 - DNA, 645 bp, Glycine max
  Peptide Sequence Number=SeqID_137230
ctactgacggggtggtgcgtaacggcaaaagcaccgcccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagaattcgatgtctatgcaggaaaaggaaataacttcgccaaaacgatgttacgtctggcaaaagagcgtgaagaattagcggttattaacgatcagtttggtgcgccaacaggtgctgaactgctggctgattgtacagcacatgccattcgtgtcgcactgaataaaccggatgtcgcaggcttgtaccatttggtagccagtggcgcgcaaagcaggcattcccttgcactcaacaagctcaacgcagtaccaacaacagcctatcctacaccagctcgtcgtccacataactctcgccttaatacaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 45546 - DNA, 789 bp, Glycine max
  Peptide Sequence Number=SeqID_137231
atgacttccaactcccaacaattcagtgcaagaaatgatgctattgtccttagaggagtccatgaggtggccacggattcatctttatttgctgaaaataaaaagcttgagggaaaacttgatgtcttggtcaacctagtaactcagcttgccatgaatcagaaatctgcatctgtacctgttgcaagagtctgtggtctatgttcttctgcagatcaccatacagatctttgtctttctttgcagctatctggagtcaatgaacaacctgaagcttatgctgcaaacatttataatagaccccctcagcaacaaaaccaacaacagcagactaattatgatctttcaagcaacaaatacaatccaagttggaggaataatccaaatctaagatgggcaagtcctccacaacaacaacaacctgtccctcctttccagaatgttgctggtccaagaaagccatatgttcctcctccaatgcagcaacaacaaagacaacaagccactgaggctcttcctcaaccttccttagaagagttacaagagacaggagcctccattcagagtctgacaaatcagatggggcagatggctactcagttgaaccaagctcaatcccaaaattctgacaaattgccttcacaaactgtgcagaatccgaaaaatgtgagtgccatcaccttgaggtctggcaagcaaactgaagtgcctctaccaatagcagcacttgcacctaaacatgtcaagcttcattctacacctgaaaatgaggatgagatagttgcataa

SEQ ID NO: 45547 - DNA, 903 bp, Glycine max
  Peptide Sequence Number=SeqID_137232
atgaggggagcgccaaccgaagaaagtctctcgcctttccttgtgagggatcttcccgcgcaaggtctcaaggttatacaaagaatccacatggcatggaggagtccgttgaggaaagacaaggagcttagaggcatccgaaatggcgtcatcggaggttatcatggatggctaagaattcatacgcgagggttagattggctctccaaattgaaagttatcgatgaggagaacttcgaagctccggaggaagatgaagaagtccgagctctaaaattagagctagggaaggcaagactcgccaaggagaagttcaaatcagctgctacacacatccggaaagagtgtaccgagttacaagaggaaaacgcggccactgcaagagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcttgcgcgaggtccaaaaggagtttggctcaacacttggaagccacggagcaaagcatgctagctatcatagggcaatacaaggaagaattgaaccagtccatggcccatgaacaaaagctagtggaggattttgcacaagtgtatgccgaaaaagaagcaagggggagggtgattgatgcactgcatcaagaagcgactatgtggatggatagttcgcctgaccttgaatggaagtcaagacctcccgcgtctattagccaaagcaaaagccatggccgaagtgtgtactgcccccgaggagattcatgggctaatcaattactgtcaacacatgatagatttgatggcccatataattag

SEQ ID NO: 45548 - DNA, 384 bp, Glycine max
  Peptide Sequence Number=SeqID_137233
atgaatgctaaccgaaatagaaattctatcaggggtgtattcattgatggttcatggactgacgacccacacaaggtgaaggaagaggtgaaatcctttttcttccataggttccaagaaccaattggtcagcgacccaagattgatggaatcaggtttcaaactgttaatctacagcagaataacgagcttctggcacctttcatggacgaagaaattcagaaggcaatttttaaagctgcatatgaaggaaggcaattcacaaaaggattgcatggatttaatggaaatcggtatgcttaccaaaagaaaaggctggcttgggcatcaaggatattgaaacattcaacctcgcactacttggaaaatggaagtggcaattaa

SEQ ID NO: 45549 - DNA, 132 bp, Glycine max
  Peptide Sequence Number=SeqID_137234
atggaggccatgaaagagcaagtgaccacaatgatggaagccatgttgagtatgagaaggataatggaggtcaatgcggctacagctgttgccgcaagtactgccatagaagtggacctgactcactgttaa

SEQ ID NO: 45550 - DNA, 208 bp, Glycine max
  Peptide Sequence Number=SeqID_137235
atggtccccagtggaatcgccaactatcgcaacctacccttcggcgggagggcaaagcgagggctcacgggtgcgtcttccatgggaggaaaatgcgcggagtcgccaccaacgtttattcaaggaaaatgtcggaaaaaccggaaaaagcatggtctacgaactttaagtgtgaaaggttcaagagttgtatttacgcacggggaag

SEQ ID NO: 45551 - DNA, 378 bp, Glycine max
  Peptide Sequence Number=SeqID_137236
atgaaggttgaacaactctttgcttatcatcatattagtgaagagagaaaagttccattggctacctttagctttcaaggagtgcctttaggaagaggcacattgccttctattgtgaaagggagcttatggacatgctccaaaggcttagacaagaataatcaaacaaggccgcttcaaaggataagcatttgcttcaagattaattcaagaatgcttcaacaaacaaaggcccttgtttcagattcacaaaagatcaagccttgcctcaaaacaaagggtttcaaagtcatgcaaggctctgggaaattgattacctggaagtgtaatcaattaccagaagggaagaatgaaaaagagatgttgaaagggttttga

SEQ ID NO: 45552 - DNA, 639 bp, Glycine max
  Peptide Sequence Number=SeqID_137237
atgacatgttcgtcgtcatgctcatcaagtatacaaactaggtctgatccaattgattgtgacgtgttgtggatgcaacccaagcatgttttagaacatgtttggactggggaaccagacagaaaactacacatcagacgagcagtcccgacgtatcaaggagtcagaccacaggaaggcgaaattgaaggcagtgtcgtcaaattaagttggttggctcaccatttttctcacatgaatattgatgaggataacgttgagcaattacaaaggtttacccgtgcgtggatccttcgattcataggaggtgtcctctttattaacaaaagtagtagcagagtttccttaaggtacctacaatttttacgtgactttgaacagtgcagcacgtatgcgtggggacctgccgtgcttgcgtatttatatagaaagatgtatgttagccacgacgaaagtttcgcatatgactcatcccaatcgccatattcaattgcaatgactttttgtttcgccaaccaagcttttttgtacgacaccttgtatgcaaattcactgttaatcctttcttcaatcaaagaaatttttattgatggatcttctttgatcatgcctgtcaataacataacaaaatttcaatga

SEQ ID NO: 45553 - DNA, 339 bp, Glycine max
  Peptide Sequence Number=SeqID_137238
atgtcgctgcatgttctttatctttatgcgttttctggatttcccccagggatttcctgtctgttgtatctctcgttacaatctttcaaagaaatgaacgtggatttgaggctttttagtcctcacgggcaggatcaccttgggctaccttctggagtgaagacaaaacatgaacggcagaaaccaatcaaggtacttaaggatgaacgcaagcagggatggggtcacgaccgaccgatcgttacctttttctgtgcgaaacaagcagggaatgtcgctgcaaggcagccccgtatcctttgtattttgcggctttcttttactatttgtttgttttaa

SEQ ID NO: 45554 - DNA, 393 bp, Glycine max
  Peptide Sequence Number=SeqID_137239
atgggtgaagtagaggaggtgcaagagcagatgaaggccaacatggaggccatgaaagagcaaatggccacaatgatggaggccatgatgagcatgaagaagataatggaagccaatgcggttgcaattgccgctaccagcgctactgctgaggaggacctgactcccccatatggcctcaaccaaataaatcatccaacccctgatatggtaggtctggaaggcaaagagttgggaggtacgggcggcccccattatgcgcaaattcaaaacaaccacgtcttcccgccatatggcttgcctcccaactatacaccacccaatgtggcatacactcccagtgaggatgtcaataactctactcccatacccattgagagccgacaaccctaa

SEQ ID NO: 45555 - DNA, 135 bp, Glycine max
  Peptide Sequence Number=SeqID_137240
atgccacttcaaggagaagataagtcaagaacaagctcaccaacattggaaaccatggataagagcttgaaggtaggagaagatgaaaggagggagaaggagagaaggggcacgaaattttgtgcctcaaatgag

SEQ ID NO: 45556 - DNA, 231 bp, Glycine max
  Peptide Sequence Number=SeqID_137241
atgcatctacgtgatcaaggaagccttcttaacaacaaagagaagaacaagatgaaagattgcaaaaatacaagtggtgaggatgtctccttcacctctaggatctcacaatcactcacaaactcatctcaagctcttaaaccggctcttgcttcgagctctggtctctacagatctttatatagcaaaatctctcaaaactctctggaacttggacctttctctctctag

SEQ ID NO: 45557 - DNA, 342 bp, Glycine max
  Peptide Sequence Number=SeqID_137242
atgatgacaacaaaatatgatgacaaaagtgatgaacaaaaagctcaagtgaatcaaagaacatccatctcaagaatcaagattcaagattcaagttcaagaatcaagaagaattcaagactcaagaagaaagcctacaaacaaagattcaagatctcaagaatcaagatcaagattcaagatctcaagaatcaagatcaagattcaagatctcaagaatcaagatcaagattcaagaatcaagaatcaagaatcaagactcaagatctcaagatctcaagaatcaagatcaagattcaagactcaagattcaagaatgaagaaaagactcaatcaagataa

SEQ ID NO: 45558 - DNA, 298 bp, Glycine max
  Peptide Sequence Number=SeqID_137243
gccacttgtctaacaccataaaccctaagagaataaaggtcattcctgagtggcccactccaccaacaccactcattgagatggtgaggaaccatgatccttcatgggaagatgcccaggaaatgggttttcagactttaccttacttcaacataccaagcaccactaatacatatgtttttgttctttttacaagtgttgaggaaaaaagcccagagtttcaagaaccttgggatttgaggtcaaatccttttcaagggggagggaatgatgcaatgtattttgtgcctcaaatgag

SEQ ID NO: 45559 - DNA, 48 bp, Glycine max
  Peptide Sequence Number=SeqID_137244
tggaactctcaagcgggttgcttggggactggacgttgaagcacaagg

SEQ ID NO: 45560 - DNA, 324 bp, Glycine max
  Peptide Sequence Number=SeqID_137245
acttatcaaggtaatccttgtggcgtctacccagacttatcttccttcattggaagtggcgtctacccagacttatcttccttcaccggaagtggcgtctatcctgacttatcttccttcaccggaagtggcgtctaccctgacttatcttccttcactggaagtggcgtctacctagacttatcttccttcatcggaagtggcgtctaccctgacttatcttccttcaccggaagtggcgtcatcaaaaccttcgtagcctgtatcaaacaatccgctcctactcaggtttacatcatctggtatcagagcttcggctcttga

SEQ ID NO: 45561 - DNA, 339 bp, Glycine max
  Peptide Sequence Number=SeqID_137246
gcactggaagttgtgagcaatgcttacatggagtctctcccaatgttgctgtgctcatttggtgtcgctttgatggtggctcaggagaatggcatagcaagtttggtggagttcatagagaatcgcggaaggttcgggttgggttacgagcctacatgcaccgacaagaggaaaatcgccttagaaaggagggagagaagctcgactcaatcgcaagggctaaaagtggagagaatccctttttgccacatcgatgaaagctttgttagtgcagggtggatgtgcaagggatgggttgccgtgatagatgaagaaacccctcaagaccaaccgatttag

SEQ ID NO: 45562 - DNA, 141 bp, Glycine max
  Peptide Sequence Number=SeqID_137247
atgagattgccgattgatgcaatccttcgtaggaagggaccagtcactagagccatgagcaagaggctccaagaggattgggctagagctgctgaagaaggccctagggttctcatgaacctcaggggctccatattgtag

SEQ ID NO: 45563 - DNA, 303 bp, Glycine max
  Peptide Sequence Number=SeqID_137248
atggccgaaaagggaaaggcggatcatctaaaggaaaggctcagggccattgaaggaggtgaagattatgcctttgctaacctaggaaagttgttcctagaacccaatatcatcacccctcccaagttcaaggttctggactttgacaagatgcaactacagaacatgtgcaaaaagggggacggatctttcaaagaacatgcccaaaaggtggagggatctggcggcccaggtggtacccccaataatggaaagggagacgataatcgtgatggtagacacattatcggtactctactatga

SEQ ID NO: 45564 - DNA, 205 bp, Glycine max
  Peptide Sequence Number=SeqID_137249
atggccgaatatgaggcgttcgcccttgggattcaagctgccattgattttgatgcaaaactactcaaagtatatggagactcggctttggaagagcgagatgggaaaccttggtatttcgacatcaaacagtatgtcaagaacaaagaatatccaccagggatttccgagcatgacaaaagaacgttaaggagattggctactg

SEQ ID NO: 45565 - DNA, 321 bp, Glycine max
  Peptide Sequence Number=SeqID_137250
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatggtgatcttgatttgaatgcttcccctcaagcacttgacaaattgttgggtcatgtgcttgcttttaaggcatgttccaaaatagatccttccaatgttgattgcaatgatgctacacaagctgaacgttttatgctttatgcagcaatctctgtctgtcacagctga

SEQ ID NO: 45566 - DNA, 276 bp, Glycine max
  Peptide Sequence Number=SeqID_137251
atggagtcaaaatgggtttttcaaaggaagcgtaaaaacatacaatggtggttccaaagtaagaaaagatgcaaagacaagatgaatataacaaggaacaagcgtagaatcacggttacctcgaacaaaactgtgaagggtttcaacggagaactatggcggttcgtggtggctactagtggttgtggggtggtgaagaagaagcttgggacattggggaagggttttggaagaaagaaagagaaagtaatggttgttttccaaggctacacgtaa

SEQ ID NO: 45567 - DNA, 846 bp, Glycine max
  Peptide Sequence Number=SeqID_137252
atgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcaggagataaagtggctggggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcggtgggatcctctag

SEQ ID NO: 45568 - DNA, 309 bp, Glycine max
  Peptide Sequence Number=SeqID_137253
atgtcgcgggggtcaggagaccttggggacgtcaggtggggtgctattgcccaaaaccaagcttggccaatcccgacccaacccgggcatagtcagttagtgagaacctgtggcgtacctaagcagtgttatatgctactggtaatcgattaccaattgtgtgtaatcgattacacagtgtcatatgctactggtaatcgattaccatttatgtgtaatcgattacacggtgtaactttcaggttccaatgtgtaaaggctgttgtaattcatttttgggcactggtaatcgattacatactgtggtaa

SEQ ID NO: 45569 - DNA, 162 bp, Glycine max
  Peptide Sequence Number=SeqID_137254
atgctttctttttgcattatcaacttcaaagcaaccaccattcaccacccaaaggcgttctctgaagaactcactaagcgcgcctatcgcgctaagcgagttcatcctttgaggatgaatactcatcctcttgctgaactacctgtggctaagcgaggttga

SEQ ID NO: 45570 - DNA, 255 bp, Glycine max
  Peptide Sequence Number=SeqID_137255
atgacaaatacgttcaacacacgagacacactgaggtacacagtggcagaagtgttggaacaggaagccatgaaagaaggcagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 45571 - DNA, 388 bp, Glycine max
  Peptide Sequence Number=SeqID_137256
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaaagcctagacatatgaagcttaaaggtccccagctaaagaagaggagatactcggggatcctctag

SEQ ID NO: 45572 - DNA, 318 bp, Glycine max
  Peptide Sequence Number=SeqID_137257
atggagcaaaaagatttagaagcagcaacaattctagaggaagaacctcaatcttctaaggcatcttctagttttcctattgcaggacattttcatttagatcctatcaaagaccacatcatggctaaagatccaagaagagtcaccctggaagattattcaagttctaatatgccacaattttttagcagcattgcacaaccagaagttcaagcccaaaccattacatatccaccatcattgattcaattgattcaaaataatttgtttcatggattaccaaatgaagacccatatgcacacttaccacctacatag

SEQ ID NO: 45573 - DNA, 285 bp, Glycine max
  Peptide Sequence Number=SeqID_137258
atggagaagtctgaaaagaaaaatattaatgaaaagaaattgaagaaagcatacattacatgggatgaaaacgatatggaatcttctgaagattcagaaaatgaagaaataaacccctgccttatggctaaaagttatgaaagtgatgaagaggcaatagatttaaatatcttgggaccaagaacaagttatgttccctctatcaatagccggaaagtgcaatcaaatttagaaaaaccttcaagcaactgtgagaagcaaagattagatctcttagtacaatag

SEQ ID NO: 45574 - DNA, 458 bp, Glycine max
  Peptide Sequence Number=SeqID_137259
attccttgacttttgagtccttcagcccagccattaacttggcttacataaagaagaactgctggaacttggacgaccccacggtcagctttccagggacccacaaggccagggctagaggatctgagggtccatcttctgctgctccccagacatctactacaccagctcctattccttcaacactagttcccgttacttccggtccctccactcagagcatagacctcatgatggcgatgctgcagagcattcatcagggtggcctggccaggagtctagccttcttctcatggaggagaggaaaatccagtgattacggaggccagtccataggcatcaccaatatatacaccagtgttggagctgagcacccgcaaggatcaccaacaggcacacttgtgctgcatttgacaaatgatgaggccatggaccaagacccaccgcaggaccagtga

SEQ ID NO: 45575 - DNA, 471 bp, Glycine max
  Peptide Sequence Number=SeqID_137260
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcccacttgggccttccagattcttcctccagaaggttgttgcttctggaggaagcaaccttactcgcctgggcgggctgagctcgcctgggcgaggagaaggggttcagccttcttggcacttcttattctctcgaaattgctgaggaaaattgtttccgtgaagaaaatccaagccgaggcgcttcctcttcaactg

SEQ ID NO: 45576 - DNA, 351 bp, Glycine max
  Peptide Sequence Number=SeqID_137261
atgaccgaccctctcaatgagtcaatctcttgctttctcataaaggtgagcccttgggtactagtacctatcgccttaagagggttgcatgccctcgccttcagaggactacacgtcctcaccttcaaagggctacacgtcctcaccttcaaagggctacacgtcctcaccttcagagggctacacatcctcgccttcagagggatacacgtcctcaccttcagaggactacacgtcctccccttcagaggactacatgtcctcaccttcagaggactacacgtcctcaccttcaaagaattacatgccctcgccttcagagggctgcgtaccctcatgatgaggacatga

SEQ ID NO: 45577 - DNA, 168 bp, Glycine max
  Peptide Sequence Number=SeqID_137262
atgggtcaatcatttgcttcattggtttcaacggtggcagctgcggaatccgctattgggttagccattttcgttatcactttccgagtccgagggactattgctgtagaatttattaatagcattcaagggtcagggcctttctcgctggcgagcgcatccgattga

SEQ ID NO: 45578 - DNA, 453 bp, Glycine max
  Peptide Sequence Number=SeqID_137263
atggaagatagccatgagtggtggtctgtggttgttgttcaaccattacttaatcgtgaagacatgattgtcggagttcattacggagtgtttggcaaacccattaaggtggacctgaataccttgaatgcggaatatagacgttttgccagggtctacgttgagtttgcacctcctatggccattatggtcatcggagtagggagtgcactcacaaacctcaagtggagacgatggctgcaaactctaatgcaaggctggcggtggcagaagccaaaaacaaccacttttgtatctcatacggattttgcgagatcaaatcctatcaatgaaccacattcgaacactcccttaacccccgctaaaggaaatttcattaacggctccaccaagggtaaaggagtagcagccacaactcttcagactagcacagaaccctttcgcctatcctag

SEQ ID NO: 45579 - DNA, 759 bp, Glycine max
  Peptide Sequence Number=SeqID_137264
atggagttcttctcaaatgagaattttgaatgcttccaagcatttgaaaactccaatcttattccattcatgtctctgaaattacctgtctattctgagttagtcaaagctttctattctaatttagaaattcatgaaggtattctaatgtctgaaatctatgggattaagatggtcattgaccaatccctattttatgatttaacaaaattgcctagtgaaggtgtgccttttgagggtgcactgattgatgaatggaaattcgatttctctatgcatgatgcccgccgggtggtttgcaccaaccaagcggatatgaccagaaggcttcttgccggttcattggcttttgaaagccgcatcctccattatcttatagttctcattttgcttcctagatcttcaaaccttgcccaggtttctgaagaagatctcattgtcatgtgggcctttcataaaggcgcttcagtcattgcatcctttggttatcaaaaagagcatgatggctcttgggtgaaaaagggtgctcaacatgttgatgaagaaggacatggtggagaagattcatctcttcttcaaaagattttggataggttcgatggtcttcaaacctttgttggtgaaaggtttgatactttggagttacaagtggacatacgcttcaatgagatggagtcaagaatcaccaaggtcaaagaagatgtttcttatatttgttcaagctttgatctaccaccaccgtcgccaccatcatcttag

SEQ ID NO: 45580 - DNA, 414 bp, Glycine max
  Peptide Sequence Number=SeqID_137265
atgattataaagggccaagacatttatagtagccaagatgagactactacttcagcttcctctagtgaaagtgaagaagcaaaagcggaagaatctagtgaagagatctacccccaagaagaaggacaacctttaatggttaaggaagagtgtaaggaggtaagtgtctcctccaagaggttagctaagaaggaaagacattttgaaataaagacaaatactaaagaaatttcccctcttagacaacctccacattttgtcctttgtaaaaagacatttgttagcattgccacacctcttaggcttgagtttattcctcaagtaaaggagttgttggatgagggtttaatttgcaagagtttaaatccttgtgctttattggttcccaaaatagtgatcaaggggtttccatga

SEQ ID NO: 45581 - DNA, 303 bp, Glycine max
  Peptide Sequence Number=SeqID_137266
atggaaatcatatccaaacgatttgaagagcttgatgtttgtggcaaagttactctaaagagtaaactctgggaaattgcctactcttatctaaactcgatgtgtcctcctccagaaaaggtcaacaccaaaggtgctcagaagaaaccgaagatggaaactgctaattttcttatgtcacctctccacaaaatcgatataagtcctcgatcgccgatattcaatgaacatgcgatcaaaggacttaatcttgtggcaacgactaacccttcaatctcagcagcaggactcccgaatttctaa

SEQ ID NO: 45582 - DNA, 231 bp, Glycine max
  Peptide Sequence Number=SeqID_137267
atgagaaagcgccaccgcttcccgaagggagaaaggcggacaggggggcggagcctatggaaaaacgccagcaacgccggccttttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 45583 - DNA, 525 bp, Glycine max
  Peptide Sequence Number=SeqID_137268
atgccttccagcttcgtggacttgggatttgccgggaaaagaatcgaagtagggttgaaacgagggaagttcgattatgtttcctccacaggtgccaatgctgggagaatcggagcaactggggcaaagaagaaggagggagatacccatgccgtcacttcggcgcccgcatgggtcaagctcccgcaggcctctcatggtacacatcagtacgcgcaacatcatgctagcttctcagctcacgccgggaatttctccaatgcagcacccgcgcagcctagagcgcccgcccccatccagaggggggcccccctaagctccggctccaaccacgactcgcccggccggcagtgcccactttggttccagttccaacacgatgagaacctttcccccgaagccaattccagaattcaccccactcccaatgacgtacgaagacctcttgccgtccctcatcgccaaccaaatggctgtgataactcccgggaagatctaccaatcccctttcccaaagtggtatga

SEQ ID NO: 45584 - DNA, 507 bp, Glycine max
  Peptide Sequence Number=SeqID_137269
atgagcattacgaccaccacacctgctgtctacgttggcacctggcataaatacaactgcggcagcattttcggcaaatggtttgatctgacagagtttgacggacgggaggatttttacgaggcctgccaggcgctgcatgccgatgaatgggatgccgagtttatgttccaggactgggaaggcattccgtcacagtttgcctctgaaagctccattgactgggattttatcgccgcttacaaacgcgccgaagaagagggcagggaagccgcttttatcgcctgggcggagtataccggcgagtgtgactatgacgcgttcgatgatgcgtaccgcggcgaggcggaaagcgaagaggaatttgctcatgggtttgtggaggacaacgctctgttaaacgatgtgccggagtccctgcgcgtgtatttcgattacgaggcgtatgcgcgtgacctgttcagcagcggctatgtgttccatggcggctacgtcttcagcaactga

SEQ ID NO: 45585 - DNA, 264 bp, Glycine max
  Peptide Sequence Number=SeqID_137270
atggttatggcagcactgcataattctcttactgtcatgccatccgtaagatgcttttctgtgactggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 45586 - DNA, 234 bp, Glycine max
  Peptide Sequence Number=SeqID_137271
atggtttttcatttaaggcttgtagtgagcttcaaaacaaggaaagggaaacaaggctcaaaagggctatcaaaggaattaattcaaggacgcatcaacagaatcaagccaaggctatgtgcaagcatcaatggggcaaacacaccaaatgattataatgatgatggctcaaattctcacaaaggtaaaatcatcactttcaaattgagctttcaaaactatcatgacatgtag

SEQ ID NO: 45587 - DNA, 1195 bp, Glycine max
  Peptide Sequence Number=SeqID_137272
atgtggagattgttagataaggcgcctatgtcaatgctagaggttaaagctgtttatgaaagcatgccgtcagatttgagatcgatatttgttgagcccgaatacaaaatcaaggggatattttggaagcgtctgtccgaaccagagtcgtttatagaagctttgaggaaattccaaccactaccagtttttattgctctgttagccatggttaaagaagctgaaattactcaagaccaatggacgcattatcttgctctgaagaccgccattgatattaatcttgggacagaagaatcgaagaaaaaacagcaagcgaagccaaccaagcccaaaaacacgactcctgtagatcctgtggttttaatcataggcaaactccagaaactttaccccaaagcattccctaagaacccgacacctaaagtaccattgaagattgggattctagaagaccttcaagcaagatccgaagagattagcatttcaaaggaagacttacagctggccattaaaacttggtgcaaaagctcacgttactggcaagcatgcaaagaaggcgctgatcgtttggatttagatggtaatcccgttggcgtggttgagacgaccggagcagcacatgcaaaagggatggtgcgaaaacaagccaaggccaaacaaactccgacagagaccacacaaaattatcctcacactcgaaattcaatcggaacagtggcccatccatcaagaggcgtatcaccacgcttagctggtgcaaacattcatgccttcacaacatcttgcgcctcttcatcaagaatttttcgtccacttgactgttttacctcaactgaaccggccttaccattagcaagcacacgaacacgtactggcggtggctgcacaactggaccggcagccacagactcagtcgatgttgttggtgctgcagctacaggcccatctctgagactttctcaaaagaagctcggtattgcagcaggtattgatgagttcacagccagcccaagaatgaatcagtatgagcgtggcgttcacattccagactattcaacacttgagcgtctagcacaggtattagaagtgcctgtgccttatttctatgcggctgatgatgaattggctgactggataaagtgctttccaagactaggcaaagctgagcgagaaaaaatcattgctgcatcta

SEQ ID NO: 45588 - DNA, 46 bp, Glycine max
  Peptide Sequence Number=SeqID_137273
atggttcaattatttcagcacgaaatacagaaagatcttcatatgg

SEQ ID NO: 45589 - DNA, 191 bp, Glycine max
  Peptide Sequence Number=SeqID_137274
tgtatcagcaaggatcggactacaacattggaactgcaaatgaacataaaacgttttcattggccatgagttctaaagaatcaaacttgtggcacaatgccatgaaagatgagatggattctatggcgtttaaccaagtctgggatctcatacaattgcctagtggtgtaaaagtcattggatgtagatga

SEQ ID NO: 45590 - DNA, 229 bp, Glycine max
  Peptide Sequence Number=SeqID_137275
attcctccagaaggcggttgcttctggaggaagcaaccctgctcgcctgggcgagctgggcggcaaccacctcccctattttgctataaataggggaggaaggcaagaaggaagggctgaggcgcctccgaaacgtttccgtaacgttttccgtgaggaatctcgcaaagctttcaaccgttcttcgacgttcttcattcgttcttcatcgttcttcgatcttcaacgg

SEQ ID NO: 45591 - DNA, 435 bp, Glycine max
  misc_feature (14)..(14): n is a, c, g, or t
  Peptide Sequence Number=SeqID_137276
atgtttctctcccngagaaaaataaaatgggatgaagtaactcttcccgaaagatgggttatggataaggcaacaccgtctattccccgacccgctccaaccatagagcatattaagcaagataactccggaaagactaccctaattggaacagtcgaagacatcataggactaaggtccaatatatttcaacaatgtatccataacaaaacagtgagtctgatggacagaaatccagttcttgactctctgcctaaacatccagtctttcatggccttgacatgaaagaaggatcaatcccagcagccttaatatataggatccagtacaaggtcatgaatacttgtgcatctagagtcctgttaaaacctcaaaaaggagaaacaactttgtttatcactgatatgacgaagcttcgccgagtgtcccgctaa

SEQ ID NO: 45592 - DNA, 219 bp, Glycine max
  Peptide Sequence Number=SeqID_137277
atgcctatagattggacctcccaaaagagtggagctgatattgaggaggaggaactaacatatttgaggtcaaatcctcttcaaggggaaggggatgatgcaatcctccctaggaagggaccagtcactatagccatgagcaagaggctccaagaggattgggcaagagctgttgaagaaggccctagggttctcatgaacctcaaggtagaactttga

SEQ ID NO: 45593 - DNA, 105 bp, Glycine max
  Peptide Sequence Number=SeqID_137278
atggcttcctatggtgaagcaaaggactccattgatgaagaagatccaaggcctacaagcttcacatggagctacatcatgtggtatcagagcattttcatctag

SEQ ID NO: 45594 - DNA, 534 bp, Glycine max
  Peptide Sequence Number=SeqID_137279
atgaacctagaaaagagagttgatacttggaatgggcgtataacaaaaatcttggcatccttggggatcttgattggtgctgagctaacgatagcgcaaagtcgtatttctttggttaataaaattcaaaaagtttatcgatcccagggagttcacattcataatagacatatagaaattattgtgcgtcaaataacatcaaaagtcttggtttccgaagatggaatgtctaatgtttttttgcccggtgaactaattggattgttgcgagccgaacgagcagggcgttccttagaagaggcgatttgctatcgagttctattattggggataacaaaaacatctctgaatactcaaagtttcatatctgaagcaagttttcaagaaactgctagagttttatcaaaagccgctctccgggggcgcatagattggttgaaaggtctgaaagagaacgttgttttagggggaatgatacctgttgaaaaaatggcccgatcatttatcaaaggccaatcttcggtagaagagaag

SEQ ID NO: 45595 - DNA, 798 bp, Glycine max
  Peptide Sequence Number=SeqID_137280
atggccaagtttgatccagaaatagtccttgagttttacgccaatgcttggccaacagaggaaggcgtgcgtgacatgagatcctgggttaggggtcagtggatcccgttcgatgccgacgctatcagccagctcctgggatatccgatggtattggaagagggccaggaatgcgagtatggccagaggaggaaccggtctgatgggttcgatgaggaggccatcgcccagctgctatgtataccggggcaggatttcgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatatatatttttgcaggtatggcacccactaggcaccctttggacccagataagtccaacagggccctgggattccccgcactgatcacaggactctgccagtcgttcggagtccccgttgcacctaccaagatgagccttagcatgcagagccagggcttcgctcctttttcatgccctactccagaccagttcagggcagaggttgcatggcccggagattggcccgaggcccaagcaggagaggcacccccagaagcgcccggcgatggagaagaagcccacgaggatgaggagatggctgatttgcttgacttcttgggagggagtggagacacgtga

SEQ ID NO: 45596 - DNA, 186 bp, Glycine max
  Peptide Sequence Number=SeqID_137281
atggagtcgccaactgtcgcaacctacccttcggcgggagggcgacgcggggctcacgggttcgtcttccatgggaggaaaatgcacggagtcaccaccaatgtttattcaaggaaaacgtcggaaaaaccggaaaaggtcgacaagggtgtttccctcgctcctacgtatcctcaattgcgatga

SEQ ID NO: 45597 - DNA, 138 bp, Glycine max
  Peptide Sequence Number=SeqID_137282
atgcagtttgcggagcacttactacctgcgagtcagctttgtctagtgcctgggcaggacagtctgacgatcgcgagagggggacccagtgctgatgggactgtcagggctcgtcagagacgccgcacggaccattga

SEQ ID NO: 45598 - DNA, 774 bp, Glycine max
  Peptide Sequence Number=SeqID_137283
atggggaaccaagaactccttgattgcttctgtgactatgctgcattgaaggctcgacactcgtatggtccacaagggcaccgagggatgagtgccttaatatttgaggaatccacgataggttatctagaagccttgcggctccacaagcattttaaagagcaaggaatagatagggaggcttgggattgctatcagaatccatttctcccaggtgggaagcgccaactttatggttacttggcttctaaagaagatttggatattttcaacaagcactctagaagaaagacaaaattgaagtttgaaatgagatcatatcaagagatggttgagagcaagataaaacatattaatgatgatagtcagaatcttgactattataagagcatggtagccaaagaacaaatcaaatcacaagtaggtacagactctttattgagaataagtgagaagttaagcttgacaaccgaagaaaaccgtgttgaccaacaaaacaaggagggagaccagtcagggtcacgatgttttgcgagaatgctccaaccatatgggatcagcataggcttaaaggagcactcaaacccggtgacccccaaggcctacactccgaagagtccatcagggcccctccctcctgattcaggtccaacccctaaaatcattttagcacacagacactgctcgcgaattatacaatacccacgacctcacactcgtgtgttaaacacgtacaacatattacgctataatttaacactggttcctaaatag

SEQ ID NO: 45599 - DNA, 453 bp, Glycine max
  Peptide Sequence Number=SeqID_137284
atgggtgaagtagaagaggtgcaagagcaaatgaaggtcgacatggaggccttgaaagagaaaatggccacaattatggaagccatgatgagcataaaggagataatggaggtcagtgaggcttaccgaacccgtgctagagctagagtaatgggtgaagtaaaagaggtgcaagagcaaatgaaggtcgacatggaggccttgaaagagaaaatggccacaatgatggaggccatgatgagcataaaggagataatggaggtcaatgcggcttaccgaacccgtgctagagctagagtaatgggtgaagtagaggaggtgcaagagcagatgaaggccgacatgaaggccatgaaagagaaaatcgccacaatggtggaggccatgatgagcatgaagaagataatggaagccaatatggttgcagttgccgctaccagcgctgttgctaag

SEQ ID NO: 45600 - DNA, 591 bp, Glycine max
  Peptide Sequence Number=SeqID_137285
atgattttaagggtccaagacatttatagtagccaagatgaggctactacttcaccttcctctagtgaacgtgaagaagcaaaatgggaagaagctagtgaagaaatataccaccaagaagaaggacaaccattaatggttaaggaagagtgtaaggaggtaattgtctcctccaagaggttagctaagaaggaaagtcattttacaataaagacaaacattaaagaaacttcccctcttagacaacctccatattttctcctttgtaaaaagatacttgttagcattgccacacctcttgggcttgagtttattcctcaagtaaaggagttgttggatgaggatttggttcgcaagagcttaaatccttgtgctttgttggtgcccaaagtaggtattattaggcatcaaatccctaaaataggaggggttcccatgaaccctaagagaataaaggtcattcttgagtggcccacttcaccaagtgttgaggaaaatagccaagagtttcaaaaacctcgggatttgaggtcaaatcctttccaagggggagggaatgatgcaatcctaccccgcaagggcattggataa

SEQ ID NO: 45601 - DNA, 651 bp, Glycine max
  Peptide Sequence Number=SeqID_137286
atgcggagtcaaattatggtcatttcgcacaccttttcgtcattcagacacagtcgtgtccgatggcacgcagagactaacgtcatcttatacacctttttgtcatgcaaaggcggtgtgcccgatgacatgccgagacaaattatggtcattccacacaccttttcgccattcagacacagtcatgttcgatggcacgcagagactaacgtcgtcttctacacccttttgtcatccagaggcggcgggcccgatgacatgtggagacagattatggtaattccgcacacctttttgccatttagacacagtcgtgtccgatggcacgtagagactaacgtcgtcttctgcacctttttgtcatccagaggcggcgggcctgatgacatgcagagacaaattatggtcattctgcacatctttttgccattcagacacaatcgtgttcgatggcacgcagagactaacgtcatcttctgcgccatttgtcatccagaggcggcgggcccgatgacatgcggagtcaaattatggtcatttcgcacaccttttcgtcattcagacacagtcgtgtccgatggcacgcagagactaacgtcgtcttctacacctttttgtcatccaaaggcggtgtgcccgatgacatgctga

SEQ ID NO: 45602 - DNA, 690 bp, Glycine max
  Peptide Sequence Number=SeqID_137287
atgaaggttgtttatcctcaggctgaggaggagttaattgatttcttgaacagatgcaaactcgaaaacaagattgtgatgctctgccctcgctgcagtgcagtatgtgataaggaggctactgagggcctcaagaaataccaagttgttaataagggggcaaggcagaaccaacgtttcgataaaggcaaaggagttatggtgcagtcgaatactaatcagaagtcgggtcgaaggaatactttcgttcctcctggttcagtgccggtcgaaaaatggatgcaccagggactcataaggttcaacaaagggattatggaagtaggtggttcgagtggaacgaagcaaattggcccacagaaggccaataggtactcgtataggaacaattacaaaggaaagaatcctatgacgaggacccaatggcgtaggttccagcgtcagaagaagttggcccagcagaacccgcaaatgggccaatataaagaagtatctaggaggccggtaaaggagagactcctgcctccagtggatgaagacaagatggaggatgaggatctactggattctgagccagatttcgatgtcatctgtgtggtatccatcttgccatctgaatatgatgtccaatctgaagttactgagatcgaaagtgagttcgatcattttgatatggctgacccaaagcca

SEQ ID NO: 45603 - DNA, 131 bp, Glycine max
  Peptide Sequence Number=SeqID_137288
atgtgtgccatcaacttgtatgattggcttacagtacttgaaagcctctttacattggccaaaagttcaaaaaactctatgaaactgacggtgtttgtgacttaccgtattcccaacgataaaatcgtcat

SEQ ID NO: 45604 - DNA, 339 bp, Glycine max
  Peptide Sequence Number=SeqID_137289
atgaattgccattccttggattatagggttgaaccaagctcatgcttttacaaaaaggttcatcaagtcaagttgaaatatggaagtaaccgtcttgcaaaattggggcaaacgatgaatcgagtcacatcactgcttcgtctactgccaaacatatttaggattattgatgtccttgttacttccagtttcaccttgacaaagatgtcatggacctctaaaatgattcaaccccatatcctgcgtaaaaattcgcaatacttcgattgtacatcattcgcatgcatccatgcttttcactggttgcattgctcattgcattctttccttgaaaaataa

SEQ ID NO: 45605 - DNA, 396 bp, Glycine max
  misc_feature (98)..(98): n is a, c, g, or t
  Peptide Sequence Number=SeqID_137290
atggtatggggggacattttggctaaatttgatatcccagaagctgaaaaggccaagaaaaaagtaatgtccacgatgggcactagatggaggcaatntaagtcttcactaaccactaaatttgtctatgctgacacacaagccggacaggaagaaaatccttcagtaaaatatggtatggataaacaaacttgggacgaatttgttgcaagtcgcaagaccccggattggcaggaaattcggaaaaaggcaaaggagagtcaaaaatacaatgactgcccccacgtactgtctcgtgggggttatgacttgcttgagaaaaaattgttagatgagaaaacaaagcaaagacaacaacagacacttgtgtctggaggagccgccatatcccattaa

SEQ ID NO: 45606 - DNA, 471 bp, Glycine max
  Peptide Sequence Number=SeqID_137291
atggaggccatgaaagagcaaatgaccacaatgatggaagccatgatgagtatgagaaaaacgatggaggtcaacatggctacagtcgttgccgtaagtaccgccattgaggtggacccgactcacccacctggccttaatcaacattccttcccaccatatggcttgcctcccaactatacaccacctaatgtttcccacgctcctgatgagaatgtcgataactctgctcccataccctttgagagccaacatccccaatctggtcatgcacaagtccctcaacccatgggggagacacatgaagtaccccgagaccacactctagccgacttcgagcctcacctcagatatgccactgaggggcaagcatttggtggcgttaccctgccaaacactttggggggccctcagtatcgcccacaaacacaatccttgcattttgcggtgggaagagttcctcctgctatg

SEQ ID NO: 45607 - DNA, 829 bp, Glycine max
  Peptide Sequence Number=SeqID_137292
gtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccccttggacggaatttactcgcctgattggggctgcattcccaaacaacccgactcgccgacagcgcctcgtggtgcgacagggttccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcatt

SEQ ID NO: 45608 - DNA, 93 bp, Glycine max
  Peptide Sequence Number=SeqID_137293
aatttcagagacgatgcaaaagaccttacatggcatgcaaatgggagaaactgtgatggattgctccgtcatccggctgattccacccagtga

SEQ ID NO: 45609 - DNA, 325 bp, Glycine max
  Peptide Sequence Number=SeqID_137294
gaggaagcacgaaatgcaatacagaagcataaaccaaagagggtggagagtgtcaatgctgatgcagaagcctttgctgaagcactagaacatacgaagaaaagagatacaggccatcaaagtgtgtcattggataataagacaggagattcaactgtgttgaagataggaaatttggctaaagttgtgataaaacaagacatgaagggaagaaggcataaatatgggtttaacaacaacaaacgtgagaaggcagagaagaaaagagtggtggatgatgaaactggcgacaaacatcagctgcatgaagtcctaaggatgccat

SEQ ID NO: 45610 - DNA, 345 bp, Glycine max
  Peptide Sequence Number=SeqID_137295
atgtggatctccccctgcgaaagtatcggttggggttgcaccaacaagacacccagtggacccagagaagtccagcagggcccatgggtttccagctctggttacgggcctctatcagtcctacagggtgcccgtaccccccagcaagggatcgtgcccgcaagacacccagtggatccagagaattccaatagggtcctggggtttccagctctgattacgagcctctgtcaattttacggagtgcctgtcacccccaacaaggtcattaggccccgcattaaccaggcttccatcaagaagtactgcgcccccaggcaggcgcagggcaagacaccacagtag

SEQ ID NO: 45611 - DNA, 324 bp, Glycine max
  Peptide Sequence Number=SeqID_137296
atggcggtttgtggtggctactggtggctgtgggtgatggagaaagagcttggaacgttggaaatggttttggaagaaagaaggagaaagaaatggcatttttccaaggctacacgaaaagcaaaggctgaaacactcaagtgcttctgcttgcgggaaaggaagcgttcctcacacgctagacattgtaccaaagatcgcaatggtcagatcatggacatatgtcctatgaacctccagaccaaatttcgagaagatccaatggttaacgaaggatgggaagcatttttaccgagacagcttcatgtagcttctcgcatttga

SEQ ID NO: 45612 - DNA, 408 bp, Glycine max
  Peptide Sequence Number=SeqID_137297
atggcacccttcatatgtgcatgcggcaaatacaataaggaagttgtgcttagaaggtataggcttgaggtgatgatcaaccacggagatgaaaacacaaaattcctgctttgggaccgtgaatgcagtgaattaattggtcaatcagctaatgcagttaataagcttaaaattgaagatggtgatgttgatttaaatgtttcaccccaagcacttgataagctattgggttatgaacttgcttttaagataaaggtgcaacccaagttcaggaattttgttgttttgaaatgttcaactgacacaagcttaataaatgttgtgatagatatgctagctgatgctgagacatcttcaaaaatcaatatcccagcctttgattccaatcattctacccaacatgaatct

SEQ ID NO: 45613 - DNA, 85 bp, Glycine max
  Peptide Sequence Number=SeqID_137298
atggcgtcttcagaaactcctgttatcttcaccgtgttacagatttcgatgtatgtggccagatgtgcgtacggatcttcacttg

SEQ ID NO: 45614 - DNA, 708 bp, Glycine max
  Peptide Sequence Number=SeqID_137299
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccaccattttgttatccggcatggccgcccacgtgtcggcgagaccgaacaagagaccgtacatgaacaaatgtaccctgctgggtttcatgtcctcgggaatcacgaagagtggcgcggagaacatcaggcccgtccacgtgtccggttccgatttgaagtacatgaggagcgtggcgagtcctcccatggactcgccgaagaggaatgccgggaggtttttgtaggggtggctattgcggacgtggaggaagaaggagagggaggtggcggcgattttgtccatgtcgccgaggtagcactggagaccgtcggagcggggtaccgagctcgaattcgtaatcatggtcatagctgtttcctgtgtgaaattgttatccgctcacaattccacacaacatacgagccggaagcataa

SEQ ID NO: 45615 - DNA, 599 bp, Glycine max
  Peptide Sequence Number=SeqID_137300
gcgggtgactcagataggtgcggcttgtacatcgaagcagatcatgcccgcttggttgccctagggagagtttatgagggatccactgttgttcataacactcctttgttgcttggccaagtaaagatgcaaatgctccagttcatgtacccactgatgaggttccttagtggggcaagcaattcacaccttctttgcttggtcgacacatctggtgaagtctttatcacagcagctatgtctccggcaaaaccacctcaaaagcccgattcggaggttgatgatcctctttatctgatgacattgaccatcccagaacttttcttgaggccttatcaggttacatgggatgccaccgtgttcgaggtctttaatccagacttcccgctatacataaagcacgaagacctctcggaaatcgcccacggtggtcaatgtctcagcatatcagtgtcacagttgtggattctgcatctcactgaaacaagtatgcaagcggggaattctgatatctatggattcttcaagccacaatccattcagagtgctttaaaaggtcttgatgatgctccacaacctaaatcaaaggctcctgctag

SEQ ID NO: 45616 - DNA, 438 bp, Glycine max
  Peptide Sequence Number=SeqID_137301
atgttcataaatggcttgaatcctatttacttacggcaagaatgtgaaaaacggaaaatcttgagaactattcgaaactcagaagaattacgggaaggggccattgaacagctggaaaaagcccaagcccgcttaaggaaagtcgaaacggaagcagatcgttttcgggtgaatggctattctgagatcgaacgagaaaaattgaatttaattaattcaatttatacgactttggaacaattagaaaattacaaaaacgaagccattcattttgaacaacaaagagtgattaatcaagtccgacaacgggttttacaacaagccttacagggagctctaggaactctaaagagttgcttgaacaacgagttacatttacgtactgtcagtgctaatattggcatgtttgggacgatgaaagaaaaaataactgattag

SEQ ID NO: 45617 - DNA, 711 bp, Glycine max
  Peptide Sequence Number=SeqID_137302
atggagatttggttttcatgtactgcaattatttgtttctcgattgtcgaatggcatcaaacaaatcgtgtcaagctacagtttggactacaacaagatacctctgttgatcccatgaatcttgatcgacttcaccaaattgacatgcgaggcaatcattacatagactggatggaataccatgcagagtggattaatatctggaaaaacaaacacaatgatgttttagctaggcaatgggttgaaggaatagtgacacatacaccagcgtacatggaatggtataggaaaaacactactctattcttgtctgttgcacaacagctacatgatccacacacaaaaattaccataatgctgcagggacaatcaatgtattgtattccttcacttgttcatcaaacttttggtcaaactggcgagtcagtcaccgcaaccagccatgaatggatgagcgatttatttgacgttgatttcaatacaccaaatttaacgacatcatatttagcttctttacaacagttcaatgcaccacattcgtttggagaacaaggacaaagttcttctgctacaacaaccaacattggatatactaacatagaacaacaacatcatcatgacatgggagaaccagtcatacaggaaagaagaaatccacgacgtaatcggcgtccaccaccttgtgggactggtcatcgtcttggtcattga

SEQ ID NO: 45618 - DNA, 417 bp, Glycine max
  Peptide Sequence Number=SeqID_137303
atggatgagaagagaaagaaaaaactagaggaagcaactcaatccggaagcactgacaccatcattgatcctccatctcccatcaaacgacacgtgaagtggaagctagcccgcaccaagaaaactggtgacatgacatctgaagcagcaaaggaaattgctgacaagattgatgcgcttgaggagcaggcctcacagggttcctttgttacccatggacgtcatgatatactgactgctgccattgggcgaccagaacaccctggtcgtgtgcgtgctgtaggagccggtataaccatcaaacaatactttggatcagcttcaaggacctcctccattgctcccgaatacctgcaacagttgacgcaacaaatcaaggaccaactagaggattcaatcacagaaaaagtcacttga

SEQ ID NO: 45619 - DNA, 309 bp, Glycine max
  Peptide Sequence Number=SeqID_137304
atgtggaccaccacggcaatttcgagagagagagaagtgcctaagaagctgaacctcttcttcttcactcctccccctatttatagcaaaataggggaggagcttgccacccagctcgcccaggcgagcaaggttgcttcctccagaagcaacagccttctggaggaaggatctggaaggcccaagtgggctagattgctatttctttcgaagaagttacggaaacttacggattgcgcaaaaacacctcttttcgatttccgccacattacggaatttcacggattgcgcaagcctacttccttttga

SEQ ID NO: 45620 - DNA, 403 bp, Glycine max
  Peptide Sequence Number=SeqID_137305
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacgaagttgattaggacgctgtcagttgcctttgctggagacactgatctgggactccaatatgttcttgaaggatgtcctaatctgcagaagcttgaaatcagagacagtccatttggggatggagctttacgttctggcttgcatcatttttacaacatgagtgaagaggacaaagccgatgatattgagattctgtacatgtatcggtctctggacaggccacgggatgatgctccaaaagttgttaccatcctttgctga

SEQ ID NO: 45621 - DNA, 333 bp, Glycine max
  Peptide Sequence Number=SeqID_137306
atgagttcaagatgttcaagattgatcaagaacacttcaaggttcaagaggaaatttgattcaaagaatcaagaatcaagattcaaggttcaagcttccaagaatcaagatcaagattcaagactcaagattcaagaatcaagagaagacttaatcaagataaggtacatcctttgtggtacaagtagagggtacatctacttgggtttgactgagaacaagagagggtatatctcttgtggatcagttctagtggagggtatatccactaggttcaaagagaacaagggagggtacatccctagtggatctttgcttgtaaaaggattttaa

SEQ ID NO: 45622 - DNA, 489 bp, Glycine max
  Peptide Sequence Number=SeqID_137307
atggagctgattgaaaacatggctgctagtgatcatgccatcttgcatgatagagtgcatgtacccactaagaagagtttgttggagttatcgtcacaggatgcattgttggaacaaaataagtttctttccaaacagcttgaagttgtgctatttgtggcagagctcatgaattcggctgttgtatttccactgaagaacacaatcatgaagttaactatatgggaaatcaacaaaggcatggttacaatcaaggtggatactcaggtgggacagttagctaagcaaattgtagagaagtcatcaagcagttttggggctaacactgagaaaaatcccaaagaggaatgcaaagctgtaataaccagaagcaggaggcctgtgttagctgagaatgagggtgaggttactgtaaaaaaaccagttgttgtggaggatgtcattgaggaggaagatgatgagaaacagaagagggaaacaccaataact

SEQ ID NO: 45623 - DNA, 81 bp, Glycine max
  Peptide Sequence Number=SeqID_137308
atggctccaaccacggaaatcactggaatgggaaagctagtccaactgcaaggacttcctagtctgaacaaagtactgctg

SEQ ID NO: 45624 - DNA, 279 bp, Glycine max
  Peptide Sequence Number=SeqID_137309
atggctaccattgcattatcaagtagatatgggagcaagttggcatatgacaccggaatttgggggatggcctttgtggataacttggtggtgggtaaggagaaggtttgttattggctaagtaatgacattgttgggttggtgggaagtttccatgtaggaatgacagtcacaacattgacccgcttcgatccttttccaggcgaagaccaaatccgcaaggctttgaaggtgccacttgagctgccaggtctctccatctttgggcgtattctttga

SEQ ID NO: 45625 - DNA, 236 bp, Glycine max
  Peptide Sequence Number=SeqID_137310
ggccctggggtttccagctctggttacgggcctctatagtcctacagggtgcccgttccccccgacaaggtcacatcatcatagggatcgtgcctgcaagacacccagtggacccaaagaagttcagcagggtcttggagttggcgaaacaccacagcagcctggggatggccagcagagggcaacagacacaccgccatcacctctagatttcacctcagctcatccacaaaaag

SEQ ID NO: 45626 - DNA, 312 bp, Glycine max
  Peptide Sequence Number=SeqID_137311
atgtcagcattttccgatggagactttccaagtctcacaagttatccagaactacgtaggtctgagttcctcattggaggatacgtaggagcaagagcctcgcttttgtcgaccacaccgccttttgtcgccatgactcaagagctggtagcccgcggagataccttatggttattcgcacccttttgtcatccagaggcggcgggcccgatgacgagcagagaccaagtttggtcattctgcacccatgatacgcggagataccttatggttccacccttttgtatcatccagaggcggcgggcccgatga

SEQ ID NO: 45627 - DNA, 216 bp, Glycine max
  Peptide Sequence Number=SeqID_137312
atgataacaaaagatgatgacaaaggtgatgacaaaaagctcaaagatagaataaagaacacttcaagattcaagaggaaagttgaattcaagaatcaagattcaagagatcaaggttcaagactcaagattcaagaatcaagaaaaggctattcaagaatcaagaaaaagcttaatcaagataagtatgaaaagggtttttcaaaaactaagtag

SEQ ID NO: 45628 - DNA, 120 bp, Glycine max
  Peptide Sequence Number=SeqID_137313
atggctggaggaaaaattgggggcgagggttttcgagagagtgaaaggttgcagggacgcgttgtaatcgattacacaattatggtaatcgattaccagagagcaattttgctatggtaa

SEQ ID NO: 45629 - DNA, 327 bp, Glycine max
  Peptide Sequence Number=SeqID_137314
atggggacaaggggttgcaacagttacaatcccgtcattgctataagacaacttggctacccaatgagaggggcaccgctagaggaagagatcgcgcctttcatttcacgaggtttcgataagaccaacgtggagacgcttcagaaggacaaggaactcaggggcagtaacaatgggcccatcggtggctatcgtaagtggttgaaagcccacgtgcaaggtttggattggctcccgagtttgagaatcgctaaaagggaggaagttgaggcaccagaggaagaaacagaggtgcaggaccttagggcagaactcgagcaagcctaa

SEQ ID NO: 45630 - DNA, 324 bp, Glycine max
  Peptide Sequence Number=SeqID_137315
atggtgaacgacattttcacaccatctaggtacaaagaaaccatcatggtgcagcctaaaccaagtgctggcctaaaggggaaatctctccaacatgctctcactttcatgccttctcgcattcaaaaatcaaaggcttgggtccctaggcctaagtcatgttttggcatctatcctaacttccgcaaaatttccatatatccaaaaatggcgcaaacagcattgaggcatttcaccgagcacttggtgggcgcacttttgggtaccaacaacaaggggataggggcaatgtggcttgccccatcatttcagaacacaacctag

SEQ ID NO: 45631 - DNA, 481 bp, Glycine max
  Peptide Sequence Number=SeqID_137316
atggctacctcaccaaaagaaacttccgctcctggttcacccgctgtaccatcatctccatcatccaccaaagcaccatcaaaccaggaacgacttgaattcaatatccagcccatacagatgattcctggtcaagcccctgttcctgaaaaactggttcccaaacgacaacagggagtgaagattgctgaaaaccctagccctgcaacaagtcctagggaagtagacccggagatggacaagaagatccgcagtattgtgagtaacattctgaaaaatgcgtctgtccctgaagctgatgaagatgtcccaacatcttccaccccaaatgtttctgtgcctgatgttgataaagatgttccaacatcttccgctccaaatgctgaagccctcccttcacccagtgaagaggaatcaacagaagaagatgatcaagccacagaagagacccctgcaccaaaggcaccagaacctgctccag

SEQ ID NO: 45632 - DNA, 348 bp, Glycine max
  Peptide Sequence Number=SeqID_137317
atgtctcctccacctttagaacctcacaatcactcacagactcatctcatgctctcaagatggcttcctctttttgctcagttctctcgtgcattagtgaatttcggcttagcacgcgtcttctcgctcagcggatggactcaagcggtgcacttaacgggattagccctcgctcagggaacatgcacagctcatccttcttccaaattcttcctcgcgctcagccaaaggagtgttgcgctcagtgaatggctcgctaagccagcagattggcttagcgagcagatgaaaatcagcatttcacaaacttgcctaattaatctgaaattgagaggaaatgattattaa

SEQ ID NO: 45633 - DNA, 270 bp, Glycine max
  Peptide Sequence Number=SeqID_137318
atggcaaaattctatgcaattccggaatttctacaaacattattgacaacaacgaaacaagtactaacgaaaaaatggaaacataaacataagaatggatgcgacctctaccctgaactgatccggagtagggcatggaaaagaagtaaaacccaggctctgcaggctgaggctcaactggtaaagacaatcatgggtctgtacatgcgcccggtggttggccgactgctggcgaaccaaatgcccgtaatactgctccgtatcaaatga

SEQ ID NO: 45634 - DNA, 210 bp, Glycine max
  Peptide Sequence Number=SeqID_137319
atgaaaactaaaggctcagcccaacacgcgctaagcatgcaaggcagcacaggcgctaagcgaggcgttaagcacgaagatgcgggatccattacgcgcgctaagcgcgagccacgcgctaaccgcgtgatccaacagaagcacacgctaagcctgcagcaggcgctaagcgcacgatctgaatgcgctaagcgcgcggtgtcgcgctaa

SEQ ID NO: 45635 - DNA, 408 bp, Glycine max
  Peptide Sequence Number=SeqID_137320
atgtcggcctccatctgctcttgcacctcctctactttacccattactccttctctagcacagattttcaacatggtccatgacatcttcttcaaggtgaaactggaagtaacaaggacatcaacaatcctaaatgtgtttggcagtagacgaagcagtgatgtaacacgatccatcttttgccccaatttttgcaagatggttacttccatacttcaacttgactcgatgaaccttttcgtaaaagcacgagctcggttcaaccccataacccagggaatggtaattttgatcgccaatacttcatcaacatttcatagggatgaaagactcgggaatacacatgctatgcatggaaaatgtaattatgagattgagatgcctgaagaaacatcctttcttagttaa

SEQ ID NO: 45636 - DNA, 393 bp, Glycine max
  Peptide Sequence Number=SeqID_137321
atgaatttgttgcctagcgctgttcatgtgtcctccaccatcgagtctggagccccgcgaattcattgcctagcgatgttcgccaattctccattctccacttttattcggagccccatgaatttgttgcctagcgctgttcatgtgtcctccaccaccgagtctggagccccgcgaattgattgcctagtgctgttcgccaattctctattctccaatcttattcggagacccatgaattcattgcctagcgctgttcatgtgtcctctgttatcaagcgcggagcctctgaagaaaaaaaaagaaggagcagagacgagagtcgtcatcacggaaagggcaggatggacgaaatcagtgtcttatcttttctttcctcttatctccgatga

SEQ ID NO: 45637 - DNA, 540 bp, Glycine max
  Peptide Sequence Number=SeqID_137322
atgaagcaactgctgcatttcaatgatgcgacgacgttggtctattcgagtttgtccagtctttgcgctgcattggtgatgccgttcggtggcatgtttaccgatcgatatggccgcaagccattcctgatcgtcaccggtctgttcgccacggtctgcatgatctggttcttcgccgttgccgacggcgcgacaccgtcgaccttcatctggccgttgatggctacagccatttcatttggcctgtatgtctcctccacgtatgcaacgatgagcgaactgctgccgaccaaagtccgctcgacgggcatcgcgttggcctacaacctgcctgttgccttgttcggaggcacggcgcccatggtgtccacctggctgatccagcgtacaggcgatatctcttctcccatgtatttctttgctgcgacgggggtggtgtctcttgtttcgttgaccctgttgcgcaagcaggactttgtcgccggcggaagttctgcttccatcgaacggccgtcggatccggccatgcgttctatctga

SEQ ID NO: 45638 - DNA, 192 bp, Glycine max
  Peptide Sequence Number=SeqID_137323
atgaaaggaaaccaacaaagggtccccagtggagtcgccactgtcgcaacctacccttcggcgggagggcgatgcgagactcgcgggatgcgtgttccacgaaaggaatacgcgcggagtcgccaccaacgtttatttgaggaaaacgtcggaaaaaccggaaaagacgcgatctacgaactttttaagtga

SEQ ID NO: 45639 - DNA, 676 bp, Glycine max
  Peptide Sequence Number=SeqID_137324
atggggacgaggggttgcatcaggtacaatcccgttcttgctataagacaacttggctaccgtatgagaggggcgtcgctagaggaagagatcgcgcctgtcatttcacgaggtttcaataagaccaacgtggagacgcttcagaaggtccgcaaggcatgggaggttgtgcaaaagaaggacaaagaactcagaggcagtaacaatgggcccatcggtggcaagcgtaaaaccgctaaaagggaggaagttgaggcaccggaggaagacgaagaggtgcaggcccttagggcagaactcgagcaagcccaaacagtcaaagaaaggttcaaatcagtagctcttaagatccgaaaggagaatgccgaactgagagatataaatatagctaccaccaaggccttggaacaagagaccaagagggctcgtaggtttgctcaaggtccaaaagaaacttgtctcagcggttatgcgagacagagaccaacattgtacgcggaaaaggaggctagaggaagggtgatcgactcgttacatcaagaggcaacaatgaggatggaccgatttgctcttaccttgaacgggattcaagaacttcctcgattgctagccaaggccaaagcaatggcggacacctactccgcccccgaagagatccacggacttctcagctatt

SEQ ID NO: 45640 - DNA, 314 bp, Glycine max
  Peptide Sequence Number=SeqID_137325
ccagatccgatgatgagtccctcgaaggtactagtacctgggacccgaccatcaattttgagcaagaaacgaatcagacggaggatgaagaggacgaggatgtgggacttcccccggagttggagaagatagtcgcccatgaggaccaagagatggggtctcatcaagaagagacgaaactagtggacttaggaaccggcaatgggaaaaaagaagtaaagataggcacagcaccgattacctctaaatcccgagtgttccccgaatgggttgccaacattgtaccagtccctaagaaagatgggaaggtgtga

SEQ ID NO: 45641 - DNA, 282 bp, Glycine max
  Peptide Sequence Number=SeqID_137326
atggggatacaaaagaattctcaagcggttaaacctttgaacgcttttggagaagagagacaaaaagaattcaggcggttagtccttggcaaattctttttggcaaatggagaagagaatgaaaagatgaatagcacaagttttcaaggtttggaaaaccagaaaacttcagaaatcttttggtacaaagaagaagaagaagttcaaagagattcaaggcttgtaaaggattgtaatgaaaatgattggaaaagaattcaagattcttgttcgaaagattga

SEQ ID NO: 45642 - DNA, 791 bp, Glycine max
  Peptide Sequence Number=SeqID_137327
cggatgccgggagcagacaagcccgtcagggcgcgtcagcgggtgttgccgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccttgcaggcttggtttcttgattgactttttgtcccatgctgccattgtgggattcatggctggagctgccattactattgcactgcaacagcttaagggttttcttggcataaaaacgttcaccaagaaaactgatattgtttctgttctgcactcggttttcgatgcagcacaccatgggtggaattgggagacaatagtcattggagtatcattcttggctttccttcttataaccaagtatattgctaaaaagaataagaagctcttttgggtggctgcaatttctcctatgatctctgttatagtgtctaccttttttgtcggtaccgagctcgaattcgtaatcatggtcatagctgtttcctgtgtgaaattgttatccgctcacaattccacacaacatacgagccggaagcataaagtgtaa

SEQ ID NO: 45643 - DNA, 597 bp, Glycine max
  Peptide Sequence Number=SeqID_137328
atgacggtgaaaacctctgacacatgcagctcccggagacggtcacagcttgtctgtaagcggatgccgggagcagacaagcccgtcagggcgcgtcaacggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccggcctgcaaaacaaaggactccgacgctcaagtaacttgtttgttcgggagctcgactgctaagggccaggtgtccggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagccggtatcagctcactcaaaggcggtaatacggttatccacagaatccggggataacgcaggaaagaacatgttgagcaaaaggccagcaaaaggccaggaaccgtaa

SEQ ID NO: 45644 - DNA, 687 bp, Glycine max
  Peptide Sequence Number=SeqID_137329
atgcagaactatcaaaatgcaaagagatctaattctgcaaaagccaggatcaataggaaacgtatcatgcagcagaaacgacatcctcatgctcagtcatcttcacaaccaacaattaactgcacttcggaatatgataaaagtgtaaattctgaatccacacaaggttcgggctctaattttttaactgcctatgaggattgtcaatctccaactaatcaacctgtaatcaacactgaaggatattctgatcttggtgatcaactcatgcaatgtaaatattgtaatgcacaaatgtggtatgatgaaagaatatcaaaagataaaaattatgggagtccaaggttcagcttatgttgtggagatggcaaagttgaactaccattattacaaaatccaccccaatatctccaacaacttctgtttgatgataatacaattgatattaaaaattatcaacataacttacgagcatacaacatgatgtttgcctttacttctgctggtattaagctagacaaaacaattaatgattcgagaggacctcctacaattagaatacagggccaaccatgccacagaataggcagtctattatcaatgtctggaaaaaaactcaaatttgcacagctatatatctttgacacagaaaatgaagtgcaaaatagaattaatgccatgaggtag

SEQ ID NO: 45645 - DNA, 462 bp, Glycine max
  Peptide Sequence Number=SeqID_137330
atgggaacaaatcaaactggaaaaaggttctatcaagtcaagattaagggcctagatgtcaccagccttaaggagttggggcgattgatgggacctctccaaatgcaagccttccgcagggcgtacagaaagattttagatttgaccatagcagagatattcacggaagccgttgtatcactcacccaatactatgaccagccattgagatgcttcacgtttggagacttccaattaggattcggcaagagagttggatcgtgtaaagcaaactcgaaacgacgtagtgggcctaccacgaaagtacttagaaggcaaggcaagggatatggcgaatcaagaggagtgggtctcgtttatggacgtattagcattgctaatctttggagttgtcctctttccaagcatggacggtttggtggacctagccgcaatcgacgttttccttgcatatcaccatag

SEQ ID NO: 45646 - DNA, 756 bp, Glycine max
  Peptide Sequence Number=SeqID_137331
atgacatttttaggagaaactagcagtcagacgattgtcaactcaaggttggctttcattttaccaaatggatcgattattcacaatgatactggggtttacttccaaaattcaactccggtgcccattcgagtaccaaatagctgtgattttgcaagcctaaaaaccagaatacacaatacccttcagctatccgacaaacaatttttggatgaaattcactactggaagccattcaccgatacaggtaaccaaattcgctttgagtgtatgaaattgataaatgatgacgatgtcaacacaatgttaatgtgtaatgatcaattttcttgtgttggtccgattgagttattatgcactgttggaagaacaccagatggaataataaacttacttgaacacactatgccccgtattcatgacacgatcctgtattacaacgggaaatggaacatgccaccgcagaacaaatttgttggatgcgcgttcacaggaaaaaatcctaagaaatttcaaattccttcaacatgtaccatcgatgaactgaaaaatttaatcaagcaagttgcacctaaagggattccccctcatggaattcacgaatcacaaacgctgatgaccaacgaagaactgctgaaggtgttagtacaatctaactacaggaaaaaatatggaccaatagaaattttagctgtctttactaaatatgttgtgaaaatcgaagaagaggtcactgggacgtcgctaaacaactga

SEQ ID NO: 45647 - DNA, 372 bp, Glycine max
  Peptide Sequence Number=SeqID_137332
acttatcaaggtaatccttgtggcgtctaccctgacttatcttccttcattggaagtggcgtctacccagacttatcttccttcaccggaagtggcgtctaccctgacttatcttccttcaccggaagtggcgtcatccaaaccttcgtagcctgtatcaaacgatccgccccaagtgatgaggacatgaccaagagcaagggcaaggatccacttgaaggacttggaggacctatgacaagggctagagcaaggaaagccaaggaagctcttcaacaagtgctgtccatactgtttgaatacaagcccaagtttcaaggagaaaagtccaaggttgtgagttgtatcatggcccaaatggaggaggactaa

SEQ ID NO: 45648 - DNA, 492 bp, Glycine max
  Peptide Sequence Number=SeqID_137333
atgatcatgaggggtcaagacatttatagtagtcaagaggagactagttcttgcccttcctctagtggaagtgaagatgaagtaaggggtgaagagtctagtgaggaagtctacccccatgaagaaggtgacctcttaatggtggccaaagatcaactaactatgaaagataagagggatgaggaggaaaaattagataaacaaaagaaaaagaaggatagtaaggccttgtcttcaaaggccaaggggaaggaaaaggaggaaaaggattcctccaagaagattgttaagaaggaaaatcattttgcaacaaaaggtgatattaaaagggcactccttcttaaacaatctttctaccttctcctatcaagggaaacatctcttagcactgccatacctcttgagcttgaggttattcctcaagtaaaggagttgttggatgaggtgtttggttcacaagagcttaaattcttgtgctttgttggtgcctaa

SEQ ID NO: 45649 - DNA, 276 bp, Glycine max
  Peptide Sequence Number=SeqID_137334
atgacgccgatcgaacatttcctattagtcattgatgcaagctccattggagcttgtaggcctaggatcttcttcatcaatggattcctttgcttcttggaagatgaatggcagcggaatggagaaaggaagagagagaggagacgccacttcaaggagaagatgagtctagaagaacctcaccaccataggaggccatggataagagcttggaggaagaagaagatgaatgaagggagagggagagaagagcacgaaattttgtgctctaaatga

SEQ ID NO: 45650 - DNA, 327 bp, Glycine max
  Peptide Sequence Number=SeqID_137335
atgactagggggctgtggtgggaatccatgtgctggattcaggctataggagctttctcagctgatcctgctagccactttatccaattctgtgatggatttggtgcagggagaaatcatagtaggaggggcgggtggtggattgctttatctattacaatttggcagcataggaattccttgctgtttcagggcattccttttgaacctcaaaaagtgttggatgatgccttatttctagcttggtcttggctaaaagttggagagaaaggtttcaatacattatttaaccactggtctaccaatcttgtggaggcctttggttaa

SEQ ID NO: 45651 - DNA, 168 bp, Glycine max
  Peptide Sequence Number=SeqID_137336
atgctttggctgcgcagcagctctgatttcgtattggtaatcgattacaggcctaataagccttatggtaatcgattacaggatgttgtaatcgattacaggctgcctgttcatgtgtattcgattacactggatggtaatcgattaccagagcctatcctaagctag

SEQ ID NO: 45652 - DNA, 528 bp, Glycine max
  Peptide Sequence Number=SeqID_137337
atgggtgaagcagagaagttgccgctattaagcgctgtcgctaaggtgaacccaatgctcccatctggcctcaagcaaatgaatcgtccaacctcaaatatggtagacaaagatttgggaagtacggatgaccccatgatgtgcaaattcaaaacgagcacgccttcccatcatatggcttgcctcccaactatacaccacccaatgtggcatacactctcaatgaaaatctcaataactccactccgatactcattgagaaccaataacctcatcaggcacatatctctcaaaaccatgggaaagacacatgaaattccccaccacaatctagctgacttcgagccttggctcggatatgccactgaagggcaagcagttggtggtataccctttgaaaaccctttggagggccctcagtatcacccacaactgcacctattgcattccacagcggataaaaaccctcatgactatggcaggaatgggaaagttggatcatctaaaggaaaggctcagggccattga

SEQ ID NO: 45653 - DNA, 190 bp, Glycine max
  Peptide Sequence Number=SeqID_137338
cgcacccgtgagcctcgcctcgctcgcccgcaaaagggcatgttgcgacacatattctgaaaggtcatttgcctcactaactcttctaaggaaggttgaggatgagcctcagttgcttgttgtcttttttgtgactgctgctgctgctattgcattggaggaggaacatatggcttgcttggaccagtag

SEQ ID NO: 45654 - DNA, 1320 bp, Glycine max
  Peptide Sequence Number=SeqID_137339
atgacgtcaggcagcgtggtgacgattgataacgataccgtcacccttagccaggatgttgtccgcggtcataagttcgcgctgcgggccattgcgaaaggtgaaaacgtcattaagtacgggttgccgattggtcatgcgctggcggatatcgcgccgggcgagcatgttcatgcgcacaatacgcgtaccaatctgagcgatcttgacgcgtatcgctatcaaccagaccgggttgaacaaccggcgcaacctgcggatcgcgacgtcgagatttatcgtcgcgccagcggtgaagtcggcgtgcgtaacgaattatggatcctgccgaccgtgggctgtgttaacggcatcgcccggcagatccagaatcgtttcctgaaagagaccaacgacgcggaaggcaccgacggcgtcttccttttcagccacacctacggctgctcgcagttgggagatgaccatatcaacacccgtaccatgctgcaaaacatggtccgccacccgaatgccggggcggtgttggtgattggtcttggctgcgagaacaaccaggttgatgccttccgtgaaacgctgggggattttgacccggaacgcgtgcacttcatgatttgccaacatcaggaagatgaagtggaagcgggaattgagcatcttcatcagctctatgaagtgatgcgccatgataaacgcgaagcgggtaaactgagcgaactgaagtttggccttgagtgtggcggctcggacggcctgtccggcattaccgctaacccaatgctggggcgtttttctgactacctgattgcgaacggcggcactacggtgttgaccgaagtgccggaaatgttcggcgctgagcaactactgatgagccactgtcgcgacgaagagactttcggcaaactggtcaccatggtcaatgattttaaacagtattttatcgcccacgaccagcctatctacgagaacccgtcgccgggtaacaaagcgggcggtatcacgacgctggaagataagtcgcttggctgcacgcagaaagcgggttccagccaggtggttgacgttctgcgctacggtgaacgtttgaaagtccacgggttgaatctgttgagcgcgccgggtaacgacgcggtggcgaccagcgcgctggcgggcgccggctgccatatggtgctgttcagtaccggccgcggcaccccttatggcggtttcgttccgacggtaaaaatcgctaccaacagcgagctggcggcgaagaaaaagcactggattgatttcgatgccgggcagttaattcacgggaaagcgatgccgcag

SEQ ID NO: 45655 - DNA, 225 bp, Glycine max
  Peptide Sequence Number=SeqID_137340
atcgcgctgacgttcggcaacttccgccttctgtttagcgattttcccctacagatcggccctgactttactgtcgctgcagttagcgcgaacttcctgcagcgctctgttcaggccgtcaatgcgatgctgattatggtgtttttcggcatagctgatctcccgttggatactctgttctttttcctgacaaggagaggctgcgaaggcgctggcgctaagtga

SEQ ID NO: 45656 - DNA, 144 bp, Glycine max
  Peptide Sequence Number=SeqID_137341
atgtgggatcggcacaagcttaaaggagcactcaaaccgggtgtatttacctacactctgaatagtccgttaggacctctccctcctgattcagacactgctcatgaattatacaatattcatgacctcacactcgtgttttaa

SEQ ID NO: 45657 - DNA, 315 bp, Glycine max
  Peptide Sequence Number=SeqID_137342
atgccctcgtctagtctgtctattctttgtttaggagctcgtaggtctcaagggttgtttccaactcgaccggaggacttgagatgtcaattgctaagtcctttaacgcaatccactgcggaatccgctattgggttagccattttcgttatcactttccgagtccgagggactattgctgtagaatttattaatagcattcaaggcttcatcatattcagtcggaagagtttaggtaagactttcaaagtgactctcgacgggagaatccaggctattcaggaagaatcgcagcaattcccctatcctaacgaa

SEQ ID NO: 45658 - DNA, 896 bp, Glycine max
  Peptide Sequence Number=SeqID_137343
gaaacgatcctgagaccggtgactctgacaggtgcggcttgtacatagaagcagatcctgcccgcctcgttgccatcgggagagtttatgagggatccactattgttcataacactcctttgttgcttggccaagtaaaggtgagtgtggaggaggttagagatgcagatgctccagttcctgtacccactgatgaggtttccttagtggggcaggcacttcacaccttccttgcttggccgacacatttggtcaagtctctattacagcaggtagctgtgtctccgccaaaaccacctccgaagcccgatccggaggtcgatgatccgctttatctgatgacattgaccatcccagagcttttcttgaggccttatcaggttagatgggatgccaccgtgttcggggtcgttaatccagatttccccctgtacttaaagcacgaagacctctccgaaattgcacacggtggtcaatgtctcagcatatcagtgttacagttgtggattctgcatctcactgaaacatgtatgcgagcggggaattctgatatctatggattcctcgagcctcagtccattcagaggtttgggcaatcgcagtttgaatctgaaagttacataaagagttggatgcagagttcacaacgcgatgtgtatcttggagcctacctaaatgggttccactgcagcggacactggcagatggtggtcatcctgcccaaggaacatgctatcaagggtcttgatgatgctccacagcctaaatcaaaggctcctgctaggtggattgtcgtcaagtgtaatagacaaaaaggaactactgagtgcggctactatgtgatgcactggatgtccaccatcattttaggaacttttagaaataattgtgaagcg

SEQ ID NO: 45659 - DNA, 285 bp, Glycine max
  Peptide Sequence Number=SeqID_137344
atgacggtgaaacctctgacacatgcagctcccgtagacggtcacagcttgtctgtaagcggatgccgggagcagacaagcccgtcagggcgcgtcagcgggtattggcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 45660 - DNA, 294 bp, Glycine max
  Peptide Sequence Number=SeqID_137345
atggataacaaagagggagtgcaagaacagatgaaggttgacctatcggccttagaagatcaaatggcttctatcacggaggccatgctaaagcttcaaaaaaccatagaagacaatgctacagcggtcgcttccaatacagctagggaagcagaaccggtgctacaacctgcaataaacttgggccgagacagaaacgcgacgggtttcaatcggaggtatagtcctcaagcctacccttatggtttgcctctggacttcactccacgtaccgctccagacgatttgagctaa

SEQ ID NO: 45661 - DNA, 201 bp, Glycine max
  Peptide Sequence Number=SeqID_137346
atggacccccaaagtgaaatatccttgcctagggtgctgaacccttcccttcagtctcccacgcccttttatagccaaaataggggaggaggttgccgcccaggcgagctggtagcttcaaccagaagcaacatgctcgccctggcgagctgttgcttcctccaaaaggttcctgatgggcccaaatgggcccagggctga

SEQ ID NO: 45662 - DNA, 108 bp, Glycine max
  Peptide Sequence Number=SeqID_137347
atgagtacggggcatagtgcgttgaagcttaaaaatcacagctgtttggtactcgaatgggcaccagagtcgaagtttggaagtaaaccccagtatcattgtgaataa

SEQ ID NO: 45663 - DNA, 249 bp, Glycine max
  Peptide Sequence Number=SeqID_137348
atgccttccaatattattttgatgatgccagagaatcaagagtcaagaaagttccaaagaattaacagtcaaacaagtttcaagaatcaagatcaagattcaagattcaagaataatcaagatcaagattcaagattcaagaataatcaagatcaagattcaagtaaagaatcaagactcaagattgaagaatcaagagaagactcaatcaagataagtataaaaagagtttttcagaacattgaatag

SEQ ID NO: 45664 - DNA, 594 bp, Glycine max
  Peptide Sequence Number=SeqID_137349
atggagcgctctgctaaggagagggaagcactcgatgccacggccaagctgaaagaatctgagcgtgaggtggtaaggaagaataaggcgaacaaagagcttgaggatgagctcatcatgtttaagaaagaggcggaactctttattgagggtctcgatctgaacctcttagacccattcaaagacgagaaggacgggcaactttttgatgaggatgagattgccgctatggaggaatctgatggaggagagaaggatgatggggccgatttctggcttggtttaggcttatcggttagatgtgttaggtatgaaactatcatgcttgacgggcccaccaaggaggaaccttgggtttgtcgagcctttggagattcaaccaggaacacgtttatcctgggtgtggcgagcctcaccatgggtgaactttgggaatttattggtcctagatttggcaagactcaccaagggcggaccttaggtttaagagcctttggagattcaaccaggaacacatttgtcttagactcaccaagggtggaccttgagtttgacgagcctttagagattcggctaggaatgcgtttgtcttag

SEQ ID NO: 45665 - DNA, 399 bp, Glycine max
  Peptide Sequence Number=SeqID_137350
atggaatcaagaaaaagagctagaacagaagacatccctttgtcatccactccagctcctccgtcagtaactgtaggacaggagcctgaagctcaacttccattggtgagacccaacaaggctgctccgcctgagcccacacctgtgcaggtcaatacagagccatctgacccacaatctctagtggtgaatccaccttcttcacctgagcttgaagcagttccgccatctcctcctttgattgtcatttctgacgcatcatcatatgaagcggctgcccctcctgattcaccagttgcagaaacagctgacccctctgtttccccaattggaggaattgctgatctttctgattcatcatctggagaagctattgctctcaccgattccccagtttaa

SEQ ID NO: 45666 - DNA, 717 bp, Glycine max
  Peptide Sequence Number=SeqID_137351
atggaaccgggaagtcttacaaggtgcaacggttttgattgggtcaggttgagaaggaatcaaacccaaattaagagcctcaacgaaacagtcatgttcagaggagaaagaggaatttgggttagggctatagagtctgtcgtattcgtgcatcatgtgtttgatttcatcatcgttggtggcggagatgagggcgtcgaggtcttcgctggggagttggtacttgaaggtgaggtcctgtggcagggagctgcagagggcagcaacgaggatcttagtgtcattgccaacatagaagagctagttgtcatgggtgcggggcgggatcttgtcatcgtagctacacatgaacttggcctttcaatctcgtgtgagcgtgtgaaggacttgccagagtcagagtacgataagagcaagagaggtttaaggattttcgcacaagatcaagctcgagtgtttcagaaactagtggtagttcctgtactcatggtgaacatgcttacaagcaacaacaatgaaagagcatggcatgtgcaattttgggaatttgccacagtcacaccacctttcctccaacctaatcgtgaaatttccatcgggccgaacctctctcgggttaattgtctcctagaccaagaatcgtgtgtcacatcaattgaacttaagaataatgtgagcattttcctttctctatgcgtcttccatggccttgtttag

SEQ ID NO: 45667 - DNA, 606 bp, Glycine max
  Peptide Sequence Number=SeqID_137352
atgactaggggtagggggactcctggttatgctgcacttgaactttggatgcctaattttcctgtgactcacaagtgctatgtttatagttttggaattctattatttgaaatcataggcaggagaagaaaccttggcgttcaacttgtcgaaagccaggagtggtttccaatatggatttggaaaaggtttgatgctggagaatttcagaagttgataatagcatgtgggataaaggagaaaaatagggagattacagagagaatggttgacgtagctctatcctttgttcaatataggccagattcaaggcctataatgagtgatgtggtgaaaatgctggaaggttcagtggaaattctgaaacctttgaacccatttcagccatttatggatgggaatttcacttctcatccagtccaagtgccactaacctacactacagatactaatggtttttctgatgtgcttgtaggcctaggatcttcttcatcaatggattcctttacttcttggaagataaatggcagcggaatggagaaggaagagagagaggagacgccacttcaaggagaagatgagtctagaagaagctcaccaccatag

SEQ ID NO: 45668 - DNA, 1671 bp, Glycine max
  Peptide Sequence Number=SeqID_137353
atggatgagtattctcgtaaaagaggtgtagatgggatggtattccctagaaaggggatgggccatgtatttagagatactgctaatactagagatcgaaatggtcaaatttgtagtcgattgggttgcagtagcagagccaatcttcccaaagttgctcacgtcagatcttctgaaaaaggtaaatctttgaggccttcatttcagtcctcttcaagtagcaaggatgcaattggaagttcctctagaactactagttacccagcaaaacgacttatagaacctcggaaaacattatcctctcagtttgaggcacattcatctgaaactagtagtgtacaggacggaccagaattttcagtgcccatccctccaacagaagaaattcggagagggcctctagttgaaggagaaagtacagagtctagtaatgcaatattgatggaagtaggaagttccagtgcagtatcaaatactagatctcaaagagctggattgcgtgcgcaagaaattaaaagcactggtgcagtgaggcgggctgtttccagcaggtatgggttgagaaacctcaaatgcaactctatatctgacgtcgtcccagctggttgttcaccgttggattcaagccttaatagaaggaaggatacaataaaaaagggaaactgtgaagggggaaatagttccactgttagggggaaaaatatcactgggtcttcactggaaggacggaattctggctccagaaatggcatatctatatccgattcaagaagatctagaaatgttccttctcaccggagcaccagcgtggcatcagtaagaactcaaagatcaattagtggtcaagccaggggaaggttttgtagccaaggaaacgaaaaccctgtggcaagcagtgattcccctcttaacattcccctttcacctcattctggtgatcttgatgctcctggcttttcatatcatacttctatggagactcctctaagtggctcaagctcttatggtagaccaggcaatagcagtgagcagttaagtggtgttatgcctgcatctcctgcagaagatgacaacactcattctctaataaatagggatagctttcgacattacaacatgggtggtattgcagaggtgttattggcacttgagaggattgaacaagatgcagagctaacccatgagcaaattcttttgttggaggccaacttgttcctcagtggattaaacttttatgatcaccacagagacatgcggttggatattgataacatgtcctatgaggaacttttagctctagaagagagaatgggaactgtgagcaccgctctgccggaggaagcacttgcagaatgtctgaaaagaagtaaatatcagtctgcacctttagatgatgcagatgagagttgtaatgaggataaggatgatatcaaatgctgcatttgccaggaggaatatgttgttggagatgaagttggggatctgcaatgtgaacatagatttcatgtggtttgcatacaggagtggatgcggcttaagaactggtgccctgtttgtaaagtacgatacgagctaattatgccctgggttggggaacatagcataaggaaaatgaatgctctattcaagcctaatcattacttgagcaccaagtgcaatgcaacttactag

SEQ ID NO: 45669 - DNA, 315 bp, Glycine max
  Peptide Sequence Number=SeqID_137354
atgcaaaaccagatttatcctggttcggccacaatccgtgcttacatccaatccccaatgattacaactaagaagttatgcccactccttgcaatgaacccaaaagcggttagtgttttgagtccagttataacaaccaagaagttgtacccacttcttgcaatgaacccaaaagcggttagtcttttggatccggtgatcaaccaagaagcaaatccacttcttgcaatgaacccaaaagcggttagttttttggatccagtgatcaaccaagaagcaaatccacttcttgcaatgaacccaaaaagtggttag

SEQ ID NO: 45670 - DNA, 1185 bp, Glycine max
  Peptide Sequence Number=SeqID_137355
atggtgtcatgtggtctgtggacggtggcaaggcttgggggaagaagagggttggtaattgcgtttgaaaaagactcaaagggagtaattatgatgtggaaaaaggcactcgctccctattttcggacaatacggcagagttggggcactgtaatcagtcatgatgggcccaagggtcttgagccactggacacccaaaaccacattggcaccacacaggggcaagacatgaaggtccaccacaaattggatgcgcttgatagtaatggtgactgcttcacagagttggtcacaatgaagatgttgaccattcccgaccatgacgcaaagcgaaggagtggtgcgagtagtgaggcccaatttctacaccaatggttcctgaataaagttgtgggtgctgcccccatcaagcaggttaaccaattggtgagtggcgatgtggcccaacagacacaagtcgggttagtggcatcaagtgggtcgggtggtagctccaactgggtcgggtcttctaggtttgcgtcttcctcatctgctattaagaggaacattcgagagacacatttgtgccctcgatggaattgtttgtcacaattgaaacacagaccgcgttccctacgcaaagccaattcctccggggagaggcacttcagaggcattggtggtggggttttcggtggggctggaagcaatggggtcacgactgccggcaagggcggcagaggtggcgcggtgagagggggtggacgtgcgcggctcaaggaaccgaatctccagagtcaacctcgatataaagcaactcaaaaggaacaatgcaggcaagccgacaatacgattcgcaagatcttcgaattccgaaaggtgggcataggtggagtggaattggacgcgaacaaagatggagaggaggtctcaggctgggctaatttctggattaattcgtcgagtttcagggtcattgtgtgtactgtttctatcaaggaaagagcaccaaaattgatagactattctggtatagaggaccagaaacctcccaagaagagaagaagaggaaactcaaggcatcatcctaacggaaaatacagaatccaaggaaatgacagacaagctaaggaaaatgttgattctgttgctggaagggaagattttgatgcctactcagcaatatccactctgtctcagtga

SEQ ID NO: 45671 - DNA, 135 bp, Glycine max
  Peptide Sequence Number=SeqID_137356
atggagatttctttgataagagcaaacattgaagagactaatgaggctacaatgggttgtgaaagtggagcaacaattgaagaggaaacaaacctacaagaagacttcatacacttattcttcttggaaggataa

SEQ ID NO: 45672 - DNA, 384 bp, Glycine max
  Peptide Sequence Number=SeqID_137357
atggtttctagtatagaggagttctttattctcaagctttttaagattgatgaaaatgctagaaaggctcatcaagaggtttcacctggagcagttgctagtggaactatttttcaatataactctagagatttcttaggagcctttgttgttcatttgggcaattctttctcgttcaatgctaagatttttgtagctttgatggccattgagatagccagggataagcaatggttgtctcttttggttggagacaaactcaactttggtggtagaagttttcaagattccttctttggtaccttggagcctttcacaacagatgaaaaatgctatttcttgcacaaaatctatgcatttttagatatctcatgtctttcatga

SEQ ID NO: 45673 - DNA, 627 bp, Glycine max
  Peptide Sequence Number=SeqID_137358
atgttgcacctcctttcttcctccttcattttttgcttcctactgtgccgttgttgtcgtttgcattcattctcgccgttaagccaggcgctgccactgtcgtcacgcgttcgccattgcctacaatgccatagggtatatgttcgattatcctggctgcaagacatttatcgtagcaaatgtgacgtaagacagtggactgtagcagctcgagcatatttgttgcatctgataagttgttcactttttgctaacaagagtgccacatgcgtgcatgtgatattcttggatgcatttcgtgacctcacccatactggaagctacgcatgggtagttgctacattgatccatattgttggatctacgagcactttcattatgttgcttcttctattgctgccaaagattatcatgagaggaaaccatttgcctgctattggaagtctaggaaggcattatcagtatcgatgtaacataagcgtttggaccattcctccacaccctgttgctccttctctatgtatagaagatattgatgatagatggattcagttttctaaataccttgcatcggtgggtcagatatgtgttgctcttggacagtgtgcagcagactacatgaagtga

SEQ ID NO: 45674 - DNA, 306 bp, Glycine max
  Peptide Sequence Number=SeqID_137359
atgttagaccagagagcacatgctatcaagataatagtcgaagcaattggtagagataatcgattacaactcacatcacttgctatgactatgactattgctacgacttcttgttctacttctcctaattgtaactctaaattgttacctacactcaccaaaaaagaagctaacatgaacaagaatgcacatgtttgtctcaaagagatagttattactagtggtggtagtgatgagcttaccaagatatcttcggttgaaacaaatccattgatcattccaactaccaaacatactcaagtttag

SEQ ID NO: 45675 - DNA, 1332 bp, Glycine max
  Peptide Sequence Number=SeqID_137360
atggaaggcctaaagggcatggataacttgattcaaatcctctctcaccatccatcttacataaacaccgaactagccaacattattgtttcaaagtttaagaagctcaatgcgcttttaaatcgaaccggtcatgcccgatttaggcgcaccccaattcactctaccgcaccggttcactcaactaatccggttcacaatgcttccacctcatcaactcaagtccctttgtcagaaaaccctaacttgttcgcgttggtgcagtctcctgtgccggtgcaagtgcaccgcatgccggcgagcgtggcactcgatttcatggagccacacaacccacttataagcttcaatgcaaaatctgttgaacttgaattctcaaaggagactttcaatgttccctcaaaatcttcattcatctcccctgccatcaccaacaacggcaatgtctccaacaaggagatcttcctagcatcggcgccaccgacaacctccgtcgaaaaagtgttggcattcaagaagcaatgctatgaacaccatgaacagtctgtagacatttctggatccagcaaatgccactacctcaagcaaagacgcgccccggttcagtactcatctccacacgcacccgttcacaacactaacgcttccacctcatcaattcaactccctcctccgccgcaaaaccctaatattcccgcgctggcgcagtttcctactccggcgccggtggccgtgcaccacacgccggtgacgctcgatttcacgaagccgcacaacgcgcttctgagctccaacgccaaatccgtcgagctcgagttctcgaaggaaaccttcagcgtttcctctaactcctctttcatgtcctccgcgatcaccggcgacggcagcgtctccaatgggaagattttcctcgcgccaccggcgacctccgccggaaaacgtccggcgttcaagaagcggtgccacgaacaccgcgaacactccgacgatgtctccggcaacagcaagtgccactgcgttaagcgaaggaaaaatagggtgaagagcactgtgagagtgccggcgattagttcaaaagtcgccgatattccaccggacgagtactcgtggaggaagtacggtcagaaaccgatcaagggttccccatacccaaggggttactacaagtgcagcacgattagagggtgcccagcgaggaagcacgtggagcgcgcaccagacgatcctgcaatgctgatagtgacgtacgagggggagcacaggcacgcggttcaggctgcgatgcaggagaacgcagccggggtggtggggttggtgttcgagtcaacgtag

SEQ ID NO: 45676 - DNA, 454 bp, Glycine max
  Peptide Sequence Number=SeqID_137361
gaaatccaagtttagtcctagagatgatggaccttttcaggtcttggagaggatcaataaaaatgcctataggactaagggtggagatggtactaaggaggaggaaccaacagatttgaggccaaatccacttcaaaggggaggggatgatgtaatcctccctaggaagggaccagtcactagagctataagcaagaagctccaagaggattgggctaaagttggtgaagaaggccctaaggttctcatgaacttcaggaggggtgtgagtagcccccatctagcttctcaaggaagctttcttccttgcttcccaaggaagctaccttccttgcttctcaaggaagcttccaattatatttttggcatgggggtgagcttagctattggagggcttcccaaggaagctaccttccttgcttctcaaggaagcttcccgtgtgctaggctataa

SEQ ID NO: 45677 - DNA, 369 bp, Glycine max
  Peptide Sequence Number=SeqID_137362
atgtgtcctcttccaatacatttaaaacattttatggagctagtcttttcttgcatactagtcttaaggggttgcttttctattgtctttcccttatcatctttgggcttagaagaaaatactgaggacaacaaggtagttgtggaggaaaaagggttgagtggtgttggggacaaggttgatttggaggaaaaagtgactagtgttgaggacaaagtggttgtggaggaaaaagtgagttgtgttgaggataaacaagtggtttcgaaaacgattgagcaagagaaaaaggtggtggaacctgtggagaaagaaaaagttgtcacacggtggatgctcttccctattatagggcaaaggtttgtgtga

SEQ ID NO: 45678 - DNA, 363 bp, Glycine max
  Peptide Sequence Number=SeqID_137363
atggctattataataagagccaaggaggaagaggttgaaaggaagccttgtgtgaaggctcttcctttcaaggtgaaagcgatgtcgagaggatcatcgtcgcagaaagcaaggatgtgcgttgaaatctacaaaggcgtcaccactagccagctcaatgaattggtagcggaaaccaccgcggctatgatcgccaaccaccctgactattcttctgtgaggctcttctcttttcttgcgtttttttgtggtttttacatttttggagtagctaaatcagatgaggcaaggtggtcttttgttaattacttcaacttaggtaaacgaatctgccttggtgaatctgtcaagattgaagaatag

SEQ ID NO: 45679 - DNA, 258 bp, Glycine max
  Peptide Sequence Number=SeqID_137364
atggcaaccagtaagtatttgattgctcctggggcctttggcagtggtctcaatatgtgcattccacacatgacaaaaggtcaaggggagctcagactgtggagattgtcaggaggggtgtgtggaatgcattttaacgagggtgctatcaaccctcttttggatatctctccatcgaggatgaccgtctatggtgggagtttggagcgtctcttggatgatagtattgaggtgctcgacctttttggtgctagctag

SEQ ID NO: 45680 - DNA, 579 bp, Glycine max
  Peptide Sequence Number=SeqID_137365
tgttggatatatgagcattttccctctgttgctgagtctttgagtgatccagactatgatgagatgtcaccacatgtctgtcggtggatttctacaaaggcttcttcaaagtcattaccaacatcggtgtatcggaaacatctagatggactgacgattgttgatgtttgctggatgccttacggtgatcactgtgtagttatatatgatgggatcccgttgtcgtcagacactgaccagagagggtggtgtggcaatttggatatgttcagaccattcctccacgggttcaatcctactgatccggccaaacatccacctgtgacgcaggatgacacatatatggagccacgtatccttgaggtcctagtggcaccagcagcagcaccagcacatgccccttctgatgtggagcagcctagacatgcagtggcttgccaagcaatcaaagaaaggtttgagtgtttgcttaacctaaggatagtcactgcaggcacagaaatacacgaggtcatgaaagactgcttaatgatcgttaggggtgtcacagcagagggcaatgtttatgtcaggtcgtga

SEQ ID NO: 45681 - DNA, 354 bp, Glycine max
  Peptide Sequence Number=SeqID_137366
atgatgacattcaagattgagttcaagactgagtcaagaacgcttcaaggatcaaaatttgatttcaagaatcaagattcaagaatcataaagatcaagatccaagactataagattcaagaatcaagagaagacttaatcaagataagtattaaaaagtttttcaaaacattgagtagcacaagaagttttcacaaaatcattaccaaagagttttactctctgaacaagagaaggtacatctcttgtggattagttctagtggagggtacatccactaggttgttcaaagagaacaagggagggtacatcccttgtggatctttgcttgtaaaaggatttttacaaggttga

SEQ ID NO: 45682 - DNA, 339 bp, Glycine max
  Peptide Sequence Number=SeqID_137367
atgggcgaaattgtccttccgcaaagattctttccggaagaatcttcttccggaaccattctggaagacactttttttgaaaattttttggaagaaccttctttcagaagaagatggtgtcattccggaagaactccggaatacattccgaaagaacgtgttccagaatgttttcggaagaagggtctttcggaagacaaccttcttattccggaagaagctctagcttctcatctcaaggaggtgaacttagctattagagagcttctcaaggaagttttctcaaagaagcttctcaagaaagttttctcaagaaagcttctcaaggaagctacctag

SEQ ID NO: 45683 - DNA, 273 bp, Glycine max
  Peptide Sequence Number=SeqID_137368
atgcattactcggaccatctagcagctgcgagattgatttgtcttgtgcctgggcagtgcttagcagattacatggagtggttcttcaggatatctcattcgttcatcacacccacacaggcagctgatcagcccagacatccacttgtcccacagcatgaggcatacgtggagccagatatcccagaggtcccagtggcaccagaagctggaccgtcacaggcagctgatccgcccagacatgcagtggatgcttgtgaagagatcgcataa

SEQ ID NO: 45684 - DNA, 456 bp, Glycine max
  Peptide Sequence Number=SeqID_137369
atgactgaggatgtacctgcacccagtgtaaaagctagtgatgttgctaagggattagctggtgatgatgctgaaggatcagctggtgatgatgctgagggattcccaggtgggccacgtgacccatcagtgctgacttcgtttgttgaccatgttgcacatagcatatggaatggagagaggtggcacaaggagactagcagcttccatcttccagtaggagagctgaccatcacactggattatgtggtgtcactgcttcatcttctgatcataggcgccttccatagctttgagcctctgcatgtggacaaggtgatcattatgttggtggagttgctagaagtctcgggtgaggaggctagagctgagactgcacagtgttatggggcatatttaaatgatgcttctcagagcactggccgacagcttgctggttacattactttattacag

SEQ ID NO: 45685 - DNA, 228 bp, Glycine max
  Peptide Sequence Number=SeqID_137370
atggccaataggttcacacgcttggtggaattggactactcccaattcgctttacgtgacttttgtgccatcaccgatttcgacctcgttgtcatcgccaatcactttccatgcttaagggttctcaatttgtataattgcgaagatgaggatcacatgcttctcaaagctttattcaagacaaagaaattaaagatattcaagatggatgatcaagacagtctctag

SEQ ID NO: 45686 - DNA, 180 bp, Glycine max
  Peptide Sequence Number=SeqID_137371
atggggatagtaggaaaagggtttatgggacatggttgggtagaaggtgtggttgagtggtcattgttgaatgtggacaaggtagaagacgaaggggaagacaaaggggcaataatgaaaggatggaagaaagacctagaccaaaaggaaaaggttgaggtgggagttgtgggggaatga

SEQ ID NO: 45687 - DNA, 474 bp, Glycine max
  Peptide Sequence Number=SeqID_137372
atgaagcttaccttgacggcagaagcagcacaaatcggtggagactcctcaatgacgacaacagaagaactcaacgacgacgacgcggaggaaactaaggaagacgaagcaagaagaggattaagtcctctgatcacatgtttgttggacactggtgatcagggacttatgtttgctttcatggagaggtggcataaggaaactagtagtttccatctgccagtaggagatatgactatcaccttggatgatatggcaatgttgctgcatttgcccattacaggcgcgttccatacttttgagtctcttcatgtggacgataccatcttgcaactagtggaattgcttgaagtaagtgctgaagaggcacgagctgagacaatacaatgccatggggcatatgttcgactttcctggctgcgagacgtatatcggagcaaatgtgacacaacacagtggacacccgcagctcag

SEQ ID NO: 45688 - DNA, 147 bp, Glycine max
  Peptide Sequence Number=SeqID_137373
atggaagatcgcttagaggatatgattcgtgatcttggacaagagtcttttcagcaagcacatgctcctatgtatgatacattgcaaactgattcaaagaagcctttgtacccgaagtgccagaattccttgacgctgttgtcagcg

SEQ ID NO: 45689 - DNA, 114 bp, Glycine max
  Peptide Sequence Number=SeqID_137374
atgtacctaggtaaggtggcgatggagaagaaaaagagagttgtcacggtcttgagcgcaatggagaagaagaagcttagacgaagaacaagagaggaggataggcaggagtga

SEQ ID NO: 45690 - DNA, 141 bp, Glycine max
  Peptide Sequence Number=SeqID_137375
atgggtgaggtggttgatactttgaagatcgtgaaccttcgttcgtgggagcagacggacaacagtagattacatggagtgagatgtcttttactggagccgccaagccgatgtgatgatgttgagattattttgggatag

SEQ ID NO: 45691 - DNA, 2082 bp, Glycine max
  Peptide Sequence Number=SeqID_137376
atggctccaagctttgattttgccaataggtggatgaaggagactcaaaagggtaccccagttgtggtcacaatggagaaccctactttctctgttgtggagattaatggtgctgatgctgcattcatgccagtggagaaaacacgtggcaagaatgctaagcaagtcacatggttcttgtttctcaaggcttaccatgctattggctgtgtaacttggtttgccacagttttgtggtctttcatgggagctatagggaagaggttgattcatagggagggtttggccttggagagtgagaagttggagaaggggaagattctgtttagggtcatcaaggtgttcgttgtgagttctttggtggttatggtgtttgaggtggtggcttacttgcaaggctggcattttgggaatccaagtttgcacattcctcgccctgtggatttggaaggactgatgtacttggtttatgttgcttggctgacctttcgtggcgagtacattgctccaccaatgcaggcactttcaaagttttgtattgttctgttccttatacagtcagtggaccgtatgatgctttgctttgggtgcttttggataaaatacaagaggattaagcctaagattgacggggatgccctcaaggttgatgatattgaaggatctgcgtgtaaccatcccatggttctagttcagattcccatgtgtaatgagagggaggtgtatgagcagtctatttctgcagtatgccaaattaattggccaagggactgtttactaattcaagtacttgatgattcggatgatgagagcatacagtggttaattaagactgaggtcacaaaatggagccaaaagggaatcaacataatctacaggcatcgcttagtcaggacgggatataaagctgggaatctcaagtctgcaatgagctgtgactatgtgaaagactatgagtttgttgcaattttcgacgcagatttccaaccaaatcctgattttcttaagcaaaccgtgccatatttcaaggacaatcctgaattaggccttgtccaagctagatgggcttttgtgaacaaggatgagaacttgttgacacgtctccagaacattaacttatgcttccattttgaggtagaacagcaggtcaatggggcatttctcaacttttttggatttaatggaactgctggtgtttggagaatcaagaccctagaagagtccgggggctggctcgagaggaccaccgtagaagatatggatattgccgtccgagcacatctcaatggctggaaatttatctttgtaaatgatgttaaggtactttgtgaagttcctgagtcctatgaagcttataggaagcagcagcaccggtggcattccggtccaatgcaacttttcagattgtgtcttccagcaattttgagatctaagatatcaccatggaagaaagggaatttaatactgctattctttctgttgagaaaactcattcttcccttttactccttcaccttattttgcataattcttcctttaaccatgttcgtcccggaggccaagcttcctctatgggtgatctgctatatacctgtatttatgtcattcctcaacattcttcctgccccgaaatcttttccttttcttgttccataccttctttttgaaaacaccatgtctgtcaccaaattcaatgccatgatctctggactcttccagttgggtagttcttatgaatggattgtcacaaagaaggctggcaggtcatcagagtccgatttagtggcggcagcagaaagggaagccaagtcaataatagaacaacaaaagatccatagaggagcttctgaccgtgtacttgttgagtcaaaccaaagtaaggaacataaagaaacaagtggaaaacctgttaagaaagctaacaaaatatataagaaagagttgactttggcattcctcttactcacagcttctgtcaagagtctgttgtctgcacaaggagttcacttttactatcttcttttccaaggagtgactttcctccttgttggtcttgatctaattgggcagcagatgagctag

SEQ ID NO: 45692 - DNA, 492 bp, Glycine max
  Peptide Sequence Number=SeqID_137377
atggttttgatgcatgatagaaactatgtgacagtaaaaagtcgagttctgtctccagagtttcgtggttgcatggtttcagcttttctgtcgcatcatttttcagaggtcatggactacggttttactgccgatatggaaaccgagctggataatgtttctggtggattaactgaatggaaaggcctccttagagactattggacacgatttaaatcatattgtgagcgtacatctaatgttcatattcatcaggttgagaagatgttggaaaaaaaatttggcgattatttatttgcttctctcccagatcagagccgggtgtgtccaagttgggctggtggcagttgtatggaaggcacacttatttttaaagctgtgatcaacatcctaggtgcaatgttgtacatgttatgtactacattgcacatgttatatactgttagttacacatttggaagaatggagtatttaaaaattgtgttctactga

SEQ ID NO: 45693 - DNA, 474 bp, Glycine max
  Peptide Sequence Number=SeqID_137378
atggctgtctctggacttgttttctccttctccgggactccgaccatcactactgctaaactgaactggaagaattatccctcatggtctgcttctgtgaaactttggtttctcggtcaaggacatcatgaccacttggagaaagcttccgattccattccaatgacaagagatctgaatgggagaagcttgactaccagctctgcgctgtattatggcaaaatttttgccaatgatatccaaagcctgtttgacgcaaccatgaaggttacagccctcaagcaaactagtcatgacatgattgctcatgtgggtaaggctcgggctgccgtggaagagctgaggaagttccttgtagctgattcattggaagaagtgaacaggaaacttgataagttctacatggtccttattctgaggagcctacattcagactttgattatgttcgtgatcaagtacttgctagggaccaa

SEQ ID NO: 45694 - DNA, 984 bp, Glycine max
  Peptide Sequence Number=SeqID_137379
atggtggcaaatacaaccattttcatggaaaatatgctattcatccatttaatgattacatctgcccatgatccaaatgattttgaagtgggaaaacgtcacaaccttgaattcattaatggcctttatagaggatctgaaaacaatgagatgcgccctggggtctgtttaagaagaaatgatgtattggagcctatgataaagccccggtggtatgtcaattgcaatgatttggaaaaacaagctcttcctactgttgtggatgaggaaaacaaaaggatagagattattccaaaacaatatttggctgattggaagagatacttatatctttgtttgctttttgcaaattcttgtaatgagcatggtaaaatttatccaacagagcatttctctataatgatttatttgcatcccatggtttgtgatgcacatggacacaagatgtccaagcccttaggaaatgttattgatcccattgaagtgataaatgggatatcacttgaaggtctacataagaggttggaggttggtaacctggaccccaaagaactagccactactatagagagtcagaagaaggactttccaaatggtattgatgaatgtggtgttgatgctctccgttttgcactggtttcatacatagctcagtatcaattgtgtgatgcattcatcgaagtgattaagccttacattattggtaatgatcctaagtttgctttcgaaaaatgctttgcaaaagatactttgtggttttgtttgggcaatggtcttcgattgcttcatcctttcataccttttttcatagaagaattatggcagcgccttccttcaaccagggaatatgacagagcaaaatctatcatgatatgtgattatccatcaactatagaggttagttttgctcttcaaaatattgcaaggatctcacttcacgtaatctattgctatccatctgctcccacgaacgaaggtttgtga

SEQ ID NO: 45695 - DNA, 483 bp, Glycine max
  Peptide Sequence Number=SeqID_137380
atggataagagcttcaaggaaggagaagatgagtggagggagaaggagataaggagcatgaaatttagtgcctcaaatgaggtttttcccaaggctttgactttggctactgagttatacgaggcattggtgaaagtgataaacaaaggagaaatagaacaactagaaaaggatatgctattgattgaaggtaatgccaattgctctcctttagagagcaaggcaaaagattggacacttcgattggagattgtagcgaaacaaaggtggctcgggaaggcacaaagaggaagaagaagacgcaaacgtggactgaaccatttccacacaaaggagaagaagaagaagcgaagcggccatgaaggaagagtgagagggagtcgaagagtgggagcaccaacagttgtatttgtggcttcgaaccctggaggggagtcgaagagtgagagggagagtcataatacagggagtgcgagagagtaa

SEQ ID NO: 45696 - DNA, 216 bp, Glycine max
  Peptide Sequence Number=SeqID_137381
atgatgacaaaggtgatgaatcaaaggatgagctcaagatgttcaagaggaaagttgaagaacacttcaagattcaagaggaaagttgaattcaagaatcaagaatcaagattcaaggatcaagcttcaagaatcaagatcaagattcaagattcaagaatcaagagaaggcttaatcaagataagtatgaaaaggttttttcaaaaactgagtag

SEQ ID NO: 45697 - DNA, 222 bp, Glycine max
  Peptide Sequence Number=SeqID_137382
atgaaggttcatatcacaaaatttgaaagcaatgaaatgcttcttagtccaatagctcttaaggtggtgttccccttgcttcttgactcaaattcttcaagggatggcaccaatcctcctttccaattccctaaatggcaattcacaaacaaggaaacaaagagacaagcaataaccaaagacccaaaaaatgaaatgaaagctaaaccaatagagttttaa

SEQ ID NO: 45698 - DNA, 333 bp, Glycine max
  Peptide Sequence Number=SeqID_137383
atgggtcgtcgtcccttgcctagctctggacaaatgaaaagcgccgctgcaaggcaacctaagggcgccaactgtgcgaatacaactagagagggaggctatcacgcagctactatgcatactggggcaagatttcacccgtgccgctgcaaaaagacaagtgcggatcgtgcgcaccaacatgaccactcttacacagatatgggtcatgcccacaagacacccagtggactcggagaagtccaacagggccctggggtttccagttctagttacgggcctttatcagtcctacaggttctcgtaggcaagtatgcatatagttcaaactga

SEQ ID NO: 45699 - DNA, 518 bp, Glycine max
  Peptide Sequence Number=SeqID_137384
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgttgcgccttatccggtaactatcgtcttgagtccaacccg

SEQ ID NO: 45700 - DNA, 987 bp, Glycine max
  Peptide Sequence Number=SeqID_137385
atggcacagaagaagagcactccaatcactcctaccacatccagaaggagcaaagttgcaatcccttccaagaagaggaaagaaatttcctcatctgattctgatgatgatgtcgaaccagatgttcccgacatcaagaggaccaagacatcagggaaaaaggtgcctggaaatgtccctgatgcaccattggacaacatctctttccactccattggcaatgttgaaaggtggaaatttgtgtatcaacgcagacttgccttggaaagagaactaggaagagatgccttggattgcaaggagatcatggacctcatcaaggctgctggactgcagaaaactgtcaccaagttgggagattgctatgaaagtctagtcagggaatttattgtcaacattccctctgacataacaaacagaaagagtgatgagtatcaaaaagtatttgtcagaggaaaataccaaacagatggagtggtggacattgctgtttctgagcatcaaattgccaaggaaatcactgccaaacaggtccagcattggccaaagaaagggaagctttctgcagggaagctaagtgtgaagtatgcaatcctgcacaggattggcgctgcaaactgggtacccaccaatcatacttccactgttgccacaggtttgggtaaatttctgtatgctgttggaaccaagtccaaatttaattttggaaactatatttttgatcaaactgttaagcattcagaatcctttgctgtcaaattacccattgccttcccaactgtattgtgtggcattatgttgagtcagcatcccaatattttaaactacactgactctgtgatgaagagagaatctcctctatccctgcattacaaactgtttgaggggacacatgtcccagacattgtctcgacatcagggaaagctgctgcttcaggtgctgtgtccaaggatgctttgattactgtactcaaggacacatgcaag

SEQ ID NO: 45701 - DNA, 435 bp, Glycine max
  Peptide Sequence Number=SeqID_137386
atgatgaaacataaaactgaaaagaatacgagtctggggatcccacggtcatgtagatccgctccccccaggaaatcgaacaggctccccccctgcctaggcatcgggccagtctcccggccatgcgacctcagccgcaaactgctccggggtagggcatacaaaaggggtggaactctgcccctgctaactgcggctgaaatgatactgctccatgcccagtggctcagccggatcagcctaccgaggtggtggcggtgcgcccgtgccctgaggtgcgtcaccctgtgtctacctaggcgtgcagtacttctcaatgaaggctcgggtgatcagtggtcggatcacttcgttgggggtgacctaaattccgaaggattggcagaggcctgtgatcagagccggaaaacccagggccatgttagacttatccgg

SEQ ID NO: 45702 - DNA, 222 bp, Glycine max
  misc_feature (155)..(155): n is a, c, g, or t
  Peptide Sequence Number=SeqID_137387
atggaatgccccagggctcccccacgatatgcacatgttgcgttcgagtcatatcctcagaaaaatgggggtttgagggaacctagcaggggttatggctaccattgcgttatcaagcttttcgctacaaaatccatttcttggttggtgtcaancccggtttgtgctaaaggtggtcttcgtcattggaagtgcggtagacaggctttgtggttgatttag

SEQ ID NO: 45703 - DNA, 186 bp, Glycine max
  Peptide Sequence Number=SeqID_137388
atgcctacactccgaagagtctgccagggcctctccctcctgattcagggtcttatcattaactcgtcgccctttaagggtcttatcattaactcgtcgcccttaaagggacttaacattaactcgtcacccaaaaagggacttagcatcaactcgtcgctctcaaagggacttatgatcgtgtga

SEQ ID NO: 45704 - DNA, 555 bp, Glycine max
  misc_feature (544)..(544): n is a, c, g, or t
  Peptide Sequence Number=SeqID_137389
atggagacacttcagaaggtctgcaaggcatgggaggtggtgcgaaagaaggacaaagaattcaggggcagtaacaatgggcccatcggtggctaccaaccgctaaaagggaggaagtggaggcacctggaggaagacgaagaggtgcaggcccttaggacagaactcgagcaagcccaagcagtcaaagaaaggttcaaatcagcagctcttaagatccgaaaggagaatgccgaactaagagatataaatatagcaaccaccaaagccttggaacaagagaccaagagggctcgtagggaagagcacggccggaaaaagttccgaggggctctgtccaagagaagtttgtctcagcagttatacgagacagagaccaacatgttagctatcatcaccaagtaccaagaagaactatatctagccacggcccacgagcatagagtggcggacgagtatgcccaagtgtatgcggaaaaggaggctagaggaagggtgatcaactcgctacatcaagaggcaacgatgtggatggaccgattgnctcttacctag

SEQ ID NO: 45705 - DNA, 183 bp, Glycine max
  Peptide Sequence Number=SeqID_137390
atgccaaaagatagggggacttgtcttgatttcagggattgtcatcatcaaagagggggagattgtagacaaaggatcaagctgaatgttttgatgatgccaaagtttcacatgcgtctcaaagctttattcaagacaaagaaattaaagatattcaagatggatgatcaagacagtctctag

SEQ ID NO: 45706 - DNA, 157 bp, Glycine max
  Peptide Sequence Number=SeqID_137391
atggcatcagcggaactgagccacatgaatgctcatccgtgtcaggatggcgtacaccagctgacacttcggcagggggaggtcggaattacgatcgccgggcaggatgttgctgagcagcaaagtcatccatatctgagtgagggtggtcatgttg

SEQ ID NO: 45707 - DNA, 369 bp, Glycine max
  Peptide Sequence Number=SeqID_137392
atgccaatctccgcctgcagatgtatcggttgggatcgcgcccacaagacacccagtgaacccgaagaaagtccaacagggccctggggtttccagctttggttacgggcctctgtagtcctacagggtgctcgttccccccggcaaggtcacggatcgcgcctgcaagacacccagtggacccgaagaagtccaacagggtcttggagttgtcaagctctaattacgggtctctgtcagttctacggagtacctgtcacctccagcaagggcatcaggccccctactaatcgagctttcatcaagaagtactgcgtctccaggcaggcgcagggcgaaacaccacagcagcctggggatggtcggtag

SEQ ID NO: 45708 - DNA, 216 bp, Glycine max
  Peptide Sequence Number=SeqID_137393
atgtcacatcctatcctatcagagcattgtatgcccgtgtcctctagcatcaggttactcccactaagtaaaatcatagggatactagttagggtaacgctgttttgcaagaatgctccaaccatgtgggatcgacataagtttaaaggagtactcaaaccaggtgacccccaaggtctacactccgaagagtccgtcagggtctctccctcctaa

SEQ ID NO: 45709 - DNA, 246 bp, Glycine max
  Peptide Sequence Number=SeqID_137394
atgtatttgctggttgtggaaagagtagtacagaatcagttctggatgttttcaaagtttctgcttttgccctattttgcttggttttgttggtccatgatgattggatgtggaattacctggatgttgtggaagcttgagaggattgatggggacctggcgttgagaggaacgaggataagggctacgtgggagtacgtgagctcagttggaggtgggcaacaggggatggtgggttatacgtga

SEQ ID NO: 45710 - DNA, 288 bp, Glycine max
  Peptide Sequence Number=SeqID_137395
atgaagaaaaagttcattataaaagcttgggaaagatctaatagactcagcctaatgttaatgagaatgactgttgcagacagtattaagataactctccctaaaatcgaaagtactaaaaagtttatggaattagtgggagagtgttctcaaacagctgataagtctattgctgggacattaatgagtacattgaccaccatgaagtttgatggttcacgtactatgtatgaacatgtcattgagatgacaaacattacagcaagacttaagaccttgagaatataa

SEQ ID NO: 45711 - DNA, 385 bp, Glycine max
  Peptide Sequence Number=SeqID_137396
atgaagctttgcttctacactaaccgcctgaattcttttgtgtctcccttctctctttccaagagaattcaaaggactaatcgcctgagatatcttttgtttccccttacaaagattcaaaggactaaccacctgaaaattctttgtgttaacacattggagggtacatcctttgtggtacaagtagagggtacatctacttgggttgttgtaactgagaacaagagagggtacatctcttgtggatcaactcaagtggagggtacatccacttggttgttcaaagagaacaagggagggtacatcccttgtggatctttgcttgtaaaggattttaccacgttgaaagaaatctcaagaaccggtggttgcttggggactggat

SEQ ID NO: 45712 - DNA, 447 bp, Glycine max
  Peptide Sequence Number=SeqID_137397
atgggtgaagtagagaagacacaagagaatatgaaggccgacatggaggccattaaagagaaaatggccacaatgatggaggccatgatgagcgtgaagaagataatggaagccaatgcggttgcaattgccgctaccagcgttgttgctaaggtgaacccgacatccccatccggcatcaaccaaatgaatcatccaacctcagatatggtaggcaaagatttgggaagtacgggcggcccccataatgtgcaaattcaaaacgagcacgccttcccgccatatggcttgcctctcaactatacgccacccaatgtggcgtacactcccaatgaaatctcaataactccactcccatactcattaagagccaacaacctcaatctgatcatgcacatgtctctcgacccatggaggagacacatgaaattccccaccacgatctag

SEQ ID NO: 45713 - DNA, 126 bp, Glycine max
  Peptide Sequence Number=SeqID_137398
atggataagagcttgaaggtaggagaagatgagtggaaggagagggagaaagggaaacataattttgagagagagaagagggagaatgagcaagcaaatgctcacctcccccttgggctggtctga

SEQ ID NO: 45714 - DNA, 666 bp, Glycine max
  Peptide Sequence Number=SeqID_137399
atgaccaccctgacccagatatggatgacgttgctcctcagcaacatcctgcccaccgatcataattccgaccttcctatgccgaagtgtcagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgagcttttattgagaagtactgtacccagagacaggctcagggtgatgctccacaggccgcaggcacgccaccaccgcctcatcaggctggccaggctggggcatttgacatggagcagtatttacggcatttggttcgccagcaagcggccaaccaccgagcacatagccagggcttcgcttctttttcatgccctactccagaccagttcagggcagaggttgcatggcccggagattggcccgaggcccaagcaggagaggcacccccagaagctcccggcgatggagaagaggcccgcgaggacgaggagatggccgatttgcttgacttcttgggagggagtggagatacgtga

SEQ ID NO: 45715 - DNA, 504 bp, Glycine max
  misc_feature (453)..(453): n is a, c, g, or t
  Peptide Sequence Number=SeqID_137400
atgctgctacttaaagaattaccgacctccaaaagcctggaaaagtttgtgacgcgctatcccggcacagacatttcggccatttctgatttcgtcagcatcttgcgtgcggcgtcggatatttcgtctgcgcttgatgcgttgctggcccaacatgggttgttacaaggtcgctggtgggtgctggtattgctgatgcgccaggatgacctgacctcttccccttccgagctggcagagaaagccggcgtgaccaaggcgaccatgactggctttattgatggcctggaacgtgaagggctggtgtcacgttttatggataccaatgacagacgcaaatttcttatccgtttatcggtggccgggcagcaaaaactggacgaggtgatgccagtgtatgtgcaatgcgtcacgcagtttatgaatgtgctgggtaagccggaaagaaatacnttgattaccgatctcgccagattggccagtcgggtcgatttaatcaagtaa

SEQ ID NO: 45716 - DNA, 279 bp, Glycine max
  Peptide Sequence Number=SeqID_137401
atgtctcttgttgaacttatcctaaccagacagcattacggttacagcataccgaaaaaccaagttaccacactccctgtccagatatacgataaattagccctgtccattcaaattctaaggatcaaaccatttcccaataaggatgatcctaactacatatgtccgcacactcaaaactcccttccaattctgtgttttcaggctttatatggaaatccaatcggtggcctctcgctaagcgccaatctcgcgcttagcctagaagatgacggatga

SEQ ID NO: 45717 - DNA, 174 bp, Glycine max
  Peptide Sequence Number=SeqID_137402
atgaccaccggtggccgccgcaagccgccgttgcttgccactgaaccccgacaccaagaggagcactttaatcggagcggaatcctcataatcctcctcaaggatttggtggagaaaattcccccaatccaccatttcatagcttctctaagggtgtttttacacttcctttga

SEQ ID NO: 45718 - DNA, 327 bp, Glycine max
  Peptide Sequence Number=SeqID_137403
atggggagacgggtgcggatcatgcgcactagaatgaccaccctgacgcagatctggatgacattacttctcagcaacatcctccccagcgatcataattctgaccttcccctactgaagtgtcagttggtctatgccatcttgacccagagccaagatatcatccctttcccgtggcctacccccaaccagttcagggccacagttgcatggcctggagataggcccgattttcaaacagggccaggactcgcagggacccccagagataaagatggagcacaggatgatgatggcatggccgatgtgatggacttctttctttga

SEQ ID NO: 45719 - DNA, 204 bp, Glycine max
  Peptide Sequence Number=SeqID_137404
atggagacaaaaagtgaccccccaaataagacctccaaggccaatggcccccgccggaacccttcccccccaaacccccccttaggggatgtaggggaggaggagccccccttcctcccccttatttctctccccccaggcctcagggaattttctttttctatccccttctttacttttattccaattgtccaaatttattga

SEQ ID NO: 45720 - DNA, 722 bp, Glycine max
  Peptide Sequence Number=SeqID_137405
gaaacagctatgaccatgattacgaattcgagctcggtacccccattgagtacgctcgtcgatttaaagcattagcggaggaggtcagcgatagcctctacctggtgatgcgcgtctattttgagaagccacgtaccaccgttggctggaaagggttgattaacgatccgcacatggatggctcgtttgatgtggaagccggtctgaagattgcgcgtcgcctgctggttgagctggtcagcatggggctgccactggcaaccgaagcgctggatccgaacagcccgcagtacctgggcgatctgtttagctggtctgcgattggtgcgcgtactacggaatcacaaacccaccgtgaaatggcgtctggtctgtcgatgccggttggttttaaaaacgggaccgacggtagccttgccacggcgatcaacgccatgcgcgccgcggccatgccgcatcgctttgtaggtattaaccaggcgggccaggtttgtctcctgcagacgcagggtaatccggacggtcatgtgatcctgcgtggcggtaaagcgccaaactacagcccggcagatgtggcacagtgtgaaaaagagatggagcaggcgggactgcgcccggcactgatggtagattgcagtcatggtaattcgaacaggggatcctctagagtcgacctgcaggcatgcaagcttggcactggccgtcgttttacaacgtcgtga

SEQ ID NO: 45721 - DNA, 477 bp, Glycine max
  Peptide Sequence Number=SeqID_137406
atgctctcacttgaagtatctgaaaagactgagatgaaagtttatggcgcggctaaagttggtggagtgtatctgagtggaacccttaattgggttaagggaaaagaaaccattcattctgaaatcataattatttctgtagacctggagaaggagacttgcagatcactgtttcttctcgacgatttttgcttttttgatacaaatattggagtttttagagactcgatgtgcgtttggcaagatagcaacacccatcttggcttgtggcagatgaggaagtttggagatgacaagtcttggattcaattaataaattttagttatttacatcttaatattcgtccttatgaagaaaaatcaatgattttaccattctgcatgtctaacaatggagacttcttcatgctgaaattcactagaaatgctgatgatgaataccaaacaattttgtataaccagagggatgatgtttaa

SEQ ID NO: 45722 - DNA, 452 bp, Glycine max
  Peptide Sequence Number=SeqID_137407
atggccaatcaaggagactgggtcccgtttatggatgtgttagctttgctaatttttggggtcgtcctctttccaaacgtggaaggtttggtggacctagcagcaatcgacgctttccttgcctaccaccatagcaaggaaagtccagtggtagctgtcttggcagatctatttgacacatttgaccgaaggggttgtattaactacaatcccacgctcgctataagacaactagggtaccccataaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtggttaccatgaatggctgaaagttcatatacgaggtttagattggctcgccaa

SEQ ID NO: 45723 - DNA, 196 bp, Glycine max
  Peptide Sequence Number=SeqID_137408
gaagttcttgtagggggtcatccagtttcgttcctcctctttgtcgcaacgtgcccttttgcgggcgagcgaggcgaggctcacgggtgcgctttccaaaggaggaaaagatgcgcggagtcgccaccaacgaaggtcgacaatagcggggctcttgctcctacgtaccctccatcaaagaggaaatcagacctac

SEQ ID NO: 45724 - DNA, 78 bp, Glycine max
  Peptide Sequence Number=SeqID_137409
atggaatcatctgaggatttaaaaaatgaagacataaacctatgtctaatggctaaaagttatgaaagcggtgaagag

SEQ ID NO: 45725 - DNA, 111 bp, Glycine max
  Peptide Sequence Number=SeqID_137410
atggctcatcagatgggacgatcgcatcgtcattcccaagaggccatcattgtgcggaaagttgatgctaacagtaccacacgcagcaatgatatgagagcacggatagtg

SEQ ID NO: 45726 - DNA, 393 bp, Glycine max
  Peptide Sequence Number=SeqID_137411
gatagctggagcccgtggtgcgagttctatcggctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 45727 - DNA, 333 bp, Glycine max
  Peptide Sequence Number=SeqID_137412
atggttgctcacatcccagatccaagggttgatccttctcaatatcgtgatttagtacattattggtgttctgggaaaggacagaaaataagcaacatcaacaaaaggagctgctcaaaatataaggacttgcattgcatgggaaccaataatcttccaagacggattcatgagatgacaacaaaggctaagggagtgcaaccttctagggagaaaatttatatcgacactcgaactcgtaaagatggaagcattgttactgaaaaggctgctattgtaattgatgaactgaaaaagaaaatggttgaaacagagagttcacaaaatttataa

SEQ ID NO: 45728 - DNA, 357 bp, Glycine max
  Peptide Sequence Number=SeqID_137413
atgagtcttcattcttcatctagtgttaatggtgagggttttactcctaaggaccctttttataagatattagatgagttgagatcccttaagttgtggaaagaaaaacaagagagaaaagaaaaagagggcgtcatagttcacatactaaacatcactcccaaagaagagaaaaggatagaaggcctcaagaggttaacattagcctcccatatttccatggaaaagataatgttgaggccttacttagattgggaaatgaaggttgaacaactctttgcttgccttcatattagcgaagagagaaaagttccattggctacccttaactttcaagcgtatgccctctattggtag

SEQ ID NO: 45729 - DNA, 177 bp, Glycine max
  Peptide Sequence Number=SeqID_137414
gcattttgtgacatagaagctatctacacatttgaaggcacgtatgacataaacaccttggttataggcagggaaattactgcattaggcgttgtgttgaggaaaggaccaaaaagacccctaagggagaaacttactttgatgcaatgtcaaagtgagtgggacattgaaaagtaa

SEQ ID NO: 45730 - DNA, 390 bp, Glycine max
  Peptide Sequence Number=SeqID_137415
atgacgtctaggggtagcgaaatgccccaacgcacgtttttaagaaggcgacacggaccctccgttgggaaaccaacaaaggagaaaagtcatgataaaacattgcacaagattaaatggcctaaactctctaaaaaacagtccccagtggagtcgccaactatcgcagcgggcccttcgacgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaaggttcgggagttgtatttacgcgcggggaaggtattagcaccccacacgtccgtcccaagggacgacaacctttaa

SEQ ID NO: 45731 - DNA, 324 bp, Glycine max
  Peptide Sequence Number=SeqID_137416
atggtttacaataatggtacaaacttgaaaatcctgatgagtcatttagagacatctaacaacagctttcaaaattgccccatccagcatcaattagaccttgcaccttacgcttcagagccctacaatgctcaatggaacgccccgaggcttctccgtgacaagcacacgttgcgttcgagtcgtattctcgaagaaatggaggttgatgaaccttggctagggttatggctaccattgaattatcaagtagatatgggagcaaactttgtggctgatttagggattgcctttgtggataactgggcggtgggtaaggagaag

SEQ ID NO: 45732 - DNA, 409 bp, Glycine max
  Peptide Sequence Number=SeqID_137417
tcaccaaatacctgggcagaccaactgacggagtggcggatattgatgtttctgagcatcagattgccaaggaaatcactgccaaacgagtccagcattggccaaagaaagggaagctttctgcagggaagctaagtgtgaagtatgcaatcctgcataggattggcgctgcaaactgggtacccaccaatcatacttccactgttgccacagggaaagctgctgcttcaggtgctgtatccaaggatgccttgattgctgaactcaaggacacatgcaaggtgctggaggcaaccatcaaagccaccacagagaagaaaaatggagctggaacggctgatcgaaaggactctcagacagtggcattgatgatggtgaagcagctgagggaagaagaagcagctgagga

SEQ ID NO: 45733 - DNA, 183 bp, Glycine max
  Peptide Sequence Number=SeqID_137418
atggtatccataacccctgtcaaggttcctcaacctccatttttccgaggatacgaatcgaacacaacatgtgcatatcatggaggagttcttggacatttcattgagcactgtatgaccttgaagcgtaaggattttcaagtttatgccattattgtaaaccacagttacaatgctaaataa

SEQ ID NO: 45734 - DNA, 453 bp, Glycine max
  Peptide Sequence Number=SeqID_137419
atggatttcttttcaaatgagagttttgaatgcattcaggcatttgaaaactccaatctcattcctttcatgtctttaaaattgcctgtttatactgaattagttaaagccttctgttctaaccttgaaattcaagaaggcactttgatttctgaagtttatgggataaaaatgatcatttaccaatccctattctatgacttgacccaattatttagtgaaggtgtaccatttgaaggtacactgaataatgattggaaatttgacttctctgtgcatgatgcccgccggttggtttgcaccaaccaagcggatatgaccggaaggcttcttgccggttcattggcttttgaaagtcgcatcattcattatctcattgtgtgttgcttccaagatcttcaaatcttgaaaagaaatctcaaggactgcaggtcgcttggggactggatgtag

SEQ ID NO: 45735 - DNA, 522 bp, Glycine max
  Peptide Sequence Number=SeqID_137420
atggccggctctctcgatgagtcaatctcttgctttctcataagggtggacccttgggtactagtacctattgcctttggaaggctgcatgcccttgccttcagaggactacacgtcctcgccttaagagggatgcatgacctccccttcaaagggctacacgtcctcgccttcagagggctacacgccctcaccttcagagggctacacgtcctcgccttcagagggctgcacgccctcgtcttcagagggctacatgcccttgcctttagagggctacacgccctcaccttcagagggctgcacaccctcacctttagagggctacatgtcctcgccttcagaggactgcacctcttcgccttcagaaggctatacgtcctcgccttcaaagggcagcacatcctccccttaagagggctacacgtcctcaccttaagagggctgcatgtcctcccctttagagggctacacgtcctcgccttcagagggctgcacgctctcgcctttagaggacttcat

SEQ ID NO: 45736 - DNA, 416 bp, Glycine max
  Peptide Sequence Number=SeqID_137421
acgtcctcgccttgagaggactacacgtcctcgccatcagagggctgcacgccctcacctccagaggactacctgtcctcgccttgagagggctacacgccctcaccttggggctacacgccctcaccttgggtactagttaccctcaccagttgagaggactacacgtcctcgccttgagagacacgcccatcagagggctgcacgccctcgccttcagaggactacatgtcctcgccttgagagggctacatgccctcaccttgggtattagttaccctcaccgtgagaggactacacgtcctcgccttgagaggactacgcgtcctcaccatcagagggctgcacgccctcacctccagaggactacacgtcctcgccttgagagggctacacgccctcaccttgggtactag

SEQ ID NO: 45737 - DNA, 219 bp, Glycine max
  Peptide Sequence Number=SeqID_137422
atggctgtagtgaaccccgagaagatctacctgtctccctttccctcgatgagggacagcccgaatgtaaggactaattccctcaccagtcatggaggctcgatggttaatgcggtagaagagtgtggacctcgggggccaaagcggatggaagatgtgttaacctctaagaggttcatattggaagcgctgcacgaagcggggtatgatttgccttga

SEQ ID NO: 45738 - DNA, 492 bp, Glycine max
  Peptide Sequence Number=SeqID_137423
atggccccgaggaagcttgcctcaaagaggtccaggaaggacaaggcagccgaaggaactagttccgctccggagtatgatagtcaccgctttaggagtgctgtacaccagcagcgcttcgaggccatcaagggatggtcgtttctccgggagcgacgcgtccagctcagggacgacaagtatactgatttccaggaggaaatagggcgcccggcggtgggcatcactgaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgacgggttcgatgaggaggccatcgcccagctgctatgtataccggggcaggattttgcccggactgctgcagggaggcgagtgcgaatcatgcgcaccaacatgaccaccctgacctag

SEQ ID NO: 45739 - DNA, 285 bp, Glycine max
  Peptide Sequence Number=SeqID_137424
atgacagtacaaaatggaggcttcaatcccttctccttgtctctaacgttttggaaccctaatagagcaaccagaggaagatctttagagagcaccaaaagcaccgtaattgataatgtaaaacacttgagcgactacatcgagaaaaacgatgatctcagactccttaaccgttggattgtcgtgaaatttaagcaccagattcgcaacccaattccaagcattcccactaatgggaattttgatatcatgtctggaatgagagatatacccttcgcatcataa

SEQ ID NO: 45740 - DNA, 556 bp, Glycine max
  Peptide Sequence Number=SeqID_137425
ggacagtggagaactcaccctagtaatcagttcaataaagaccagggtgggccacttaataggcagcaacaagggcctagtctctatgacagaatgatgaagctagaagagactcttgctcagttcatgcaagtatccatgtccaatcaaaagagcacagagtcagccatcaagaatctagaagtccaggtgggaaaattggcaaaacaactagcagaccgaccttcaagaagctttggagccaacacagagaagaatcctaaggaggagtgcaaggctgttatgactagaagtaaaatggtgagcatgaatgaagaaattgacctagtggtggaacctttgagtgagactgaggaaaaagtggaagcagaagatgatcagcagaaggagataccaataatagtgagtgaaaaagaaataaatatgctcacgcagaagaataagtacattcacagtgaaaacatcattgtggaaggaaactgcagtgctataattcagaggattcttccacctaagcacaaagatcttgggagtgtgactattctgtgtgcaattg

SEQ ID NO: 45741 - DNA, 600 bp, Glycine max
  Peptide Sequence Number=SeqID_137426
atgtcgttcaccaaaggaaagatgtgtgtaaatgaaatggctcaaaagaaactttccacaaagaggtctagaagagacgccacgagagaaggatccagtgctgcctcagagtttgatagtcatcgtttccggagtgccgagcaccagcagcacttcgaggccatcaggggatggtcattccacagggagaggcatgtccagctcagggaggatgagtacacggacttccaggaggagatagctcgcaggcatttgacaccactagtgactcccatggcaaagttcgaccctaagatagtcctagagttctaccctaatgcctggcccacagaggagggagttcgggacatacgctcatgggtgaggggtcaatggattcccttcgacacagatgccctcagccagttcctgggtgacttgctgattttggaagaaggccagcagtgtgagttcggtcaaaggaggagccaggccgacggtttcgacgaggaagccatcgcccagttgttgtgcataccagggcaggatttctcctggaccactgcagggaggcgagtgcggatcatgcgcaccagcatgactactttgacccagatatga

SEQ ID NO: 45742 - DNA, 90 bp, Glycine max
  Peptide Sequence Number=SeqID_137427
gaccaaaaggacgccttacagaatggtttggtaaccatggaagatgttcaaatggcagttgctgattatttcattagtgactttgtttga

SEQ ID NO: 45743 - DNA, 153 bp, Glycine max
  Peptide Sequence Number=SeqID_137428
atggctcaagcacgtcaaaagggggggagaagcttgccgccccagctcgcccaggcgagcaaggttgcttcctccagaaacaacagccttctggaggaatcttctggagggcccaagtgggcctggttgctatttgcaccctttttttactaa

SEQ ID NO: 45744 - DNA, 681 bp, Glycine max
  Peptide Sequence Number=SeqID_137429
atgaggggagcgccaaccaaagaaagtctctcacctttccttgtgagggatctaggcacgcaaggtctcaaggttatacaaagaatccacaaggcgtggaggagtccgttgaagaaagacaaggagcttaggggcatccgaaatggcgtcatcggagattggctctccaaattgaaagttatcgatgaggagaacttcgaagctccgaaggaagatgaagaagtccgagctctaaatttagagttagggaaggcaagactcgccaaggagaagttcaagtcagctgctacacacatccggaaggagtgcactgagttacaagaggaaaacgcggccactgcaagagcccttgaacaagaaaccaaaagggcctgcaaggaggaatatggccgagagaaattccgaggagcattgtggggtagcaacaatgagctcaagcttcgaagagaggagagagatcggtcacgggttcatggcatgatcttaaaagaagagttagttgcttgcgcgaggtccaaaaggagtttggctcaacacttggaagccacggagcaaagcatgctagctatcatagggcaatacaaggaagaattgaaccagtccatggcccatgaaccaaaagctagtggaggattttgcacaagtgtataccgaaaaagaagcaagaggaagggtgattga

SEQ ID NO: 45745 - DNA, 368 bp, Glycine max
  Peptide Sequence Number=SeqID_137430
atggaaacaatatccaaaagattcgaagaacttgatgtttgtggcaagtttactctgaggactaaactttgggaaattgcataccctgatcagaattcgatgtgtcctcctccagcaaaggttaacacaaagggggcaccgaagaaagctatgagcaagaacccaaggtatgggtcaagactcttggtcggggtccacaaccatctgcttaaagaacttgcaaaattcttagaagactatatcaagctctttggtagcacagagagatttgaggaattaaggatgtcactacttgttgatgggttagccaaggtgactacagataagtggatggatataacggacatgggacatgtctttgcatcaag

SEQ ID NO: 45746 - DNA, 922 bp, Glycine max
  Peptide Sequence Number=SeqID_137431
ttagcaccaggcaggcaaaacgagagagagccgacgaacggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcggagggctaatccgcctcacgagggtcggcaacggcacgtgcctttggggggccgaggccccctactgctggtcggcaaacggacggcgggcgcacgcgtcgcttctagcccggattctgacttagaggcattcagtcataatccaacgcacggtagcttcgcgccactggcttttcaaccaagcgcgatgaccaattgtgcgaatcaacggaagagccgacatcgaaggatcaaaaagcaacgtcgctatgaacgcttggctgccacaagccagttatcccctgtgggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 45747 - DNA, 278 bp, Glycine max
  Peptide Sequence Number=SeqID_137432
ctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataatcagagattactcgtctcgcacgttggtgggggtgccgtaaagcaacga

SEQ ID NO: 45748 - DNA, 246 bp, Glycine max
  Peptide Sequence Number=SeqID_137433
atggggcatgccacattgcccccattctcttgcaatttatgtctaaacgaaatggccccaaggaagcttgcctcaaagagatccaggaaggataaagcggctgaaggaaccagttccactcccgaatatgatagtcatcgttttaggagcgctgagcaccagcagcgctttgaggccatcaagggatggtcatttctccgggagcgacgtgtccagctcagggatgacaagtataccaatttctag

SEQ ID NO: 45749 - DNA, 163 bp, Glycine max
  Peptide Sequence Number=SeqID_137434
atgacggcgacagcgacgaagtctatttcctcgacccctttgggaagagacggcaccgtcaggcgccatttggcgcaggagattgcgattgtggtgcctaggtacgctgtcaagcctctggcgacggtgacattggaaagcacggaccataggtggcgtggag

SEQ ID NO: 45750 - DNA, 135 bp, Glycine max
  Peptide Sequence Number=SeqID_137435
atgggtttgccaggcttaaaggagcactcaaacccgatgacccccaaggcctacactccgaagagtccgtcagggcctctccctcctgattcaggtccaacccctaaaatcattttagcacacagacactgctga

SEQ ID NO: 45751 - DNA, 78 bp, Glycine max
  Peptide Sequence Number=SeqID_137436
atgaaagcaaaatgcaaccaaaggtggcatgggggagcaaaaaccgtgagtcccgggatgctcgcccaggcgagctaa

SEQ ID NO: 45752 - DNA, 279 bp, Glycine max
  Peptide Sequence Number=SeqID_137437
atgaattgcgttttcgttcatgtgtcctctattggagctatgcgtagtgattgcttagtgcaattctccattctcaacctttttacgagccccatgaattgcgttgtcgttcatgtgtcctccatcttcgagtttggagctttgcgtagtgattgcttagtgcaattctccattctcaactgtcgcaacctacccttcggcgggagggcgacgcgagactcgcgggatgcgtgttccacgaaaggaatacgcgcggagtcgccaccaacgtttatttga

SEQ ID NO: 45753 - DNA, 162 bp, Glycine max
  Peptide Sequence Number=SeqID_137438
atgtcggaaaaaacccaaaaaggtgtggtctacgaacttttaagtgtgaaaggttcggaagttgtatttacgcacgaggaaggtattggcaccccacgcgtccgtcacaagggacggcagcctttaatcaagggtgtttcccttgctcctacatattcctga

SEQ ID NO: 45754 - DNA, 189 bp, Glycine max
  Peptide Sequence Number=SeqID_137439
atgatgggctgtccatttcatgacagttttgcaggttcgtgggatggagacaggttacttccttcgggcccggaagaggagtctgtatcactatcatggtttttgagccaacaagtctcgtattcacctgataagtcctcaagattagaggttgagccatgttggttgcctggtgtgtcattattgtga

SEQ ID NO: 45755 - DNA, 294 bp, Glycine max
  Peptide Sequence Number=SeqID_137440
atgaatagaggaaaaacaacattcataacagaggaaaaaagattgtccctcgtcagggtggacgtggcaaaggtaggctctaagatctcacgcgtcggactgagagtagcctttgttaaaaggacaagaggggggacctgcaaaataaaggactttgacactaaaataattgaatacttgccacaagataaaaaggtcacaacatattcaaataatgggtacttagagataatctgtcagtttgggaacccgcctactaagcgtggaacgtccatgctcatgaggcagggctaa

SEQ ID NO: 45756 - DNA, 234 bp, Glycine max
  Peptide Sequence Number=SeqID_137441
atggactcaagcggtgcgtttagtaggatgatccgtcgctcagcgaaaatgtacagctcatctttcttccagattcttcctcatgctcagccaaaggagtggttttatacacaatgtggaagcaaagctttccaagtttattttgatgatgccaaagactcaagtcaagaattaagagtcaaacaagtttcaagaatcaaagagtcattcaatcaagaatcaagatacaagtga

SEQ ID NO: 45757 - DNA, 513 bp, Glycine max
  Peptide Sequence Number=SeqID_137442
gccccgacgggtgcagagaaacgcgaggaactggaacccgagaggcggcacgcaaatcgaggcaggatttcagcatctaaaaagaaatttcagaagcttcttcctcccttccatgttgcttttcttccttcttcttctcccttcctcttcctttctaccccaaattgcaaggaaaatccattttcggagtcttggagcctccctctacttcgtggggctttaaatttcagaaaactggtagagatgatggggagagttaacttacggttaaatgtgagaatggtagtgttgacttgtaagaaagcttggacagagcaaatgagaaaaatgagtgacagatgtgaaaggaaagagccatttctaggacatggtttaggacttgtaggatccaatttgagtaaaattggatgtatgcaagttggatttcgaaatatgccaaattgtgcagcaaaagctgtcaaattgtgcagcaaatttgaccaaatgtgcagaaaaatggttgtgcagtgctag

SEQ ID NO: 45758 - DNA, 636 bp, Glycine max
  Peptide Sequence Number=SeqID_137443
atggacctcatcaaggctgctggactgctgaaaactgtcaccaagctgggagattgttatgaaagtctagtcagggaattcattgtcaacattccctctgacataacaaacagaaagagtgatgagtatcagaaagtgtttgtcagaggaaaatgtattagattctctcctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaag

SEQ ID NO: 45759 - DNA, 573 bp, Glycine max
  Peptide Sequence Number=SeqID_137444
atggcacatcaactacccagtcaaggtgttccttttgagggcactattgttgatgactggaagttcgattactcgaatcatgatgctcatcgtattgtttgtaatgaccaggctgatatgactggcagattgcttgcttggtcattagcctttgactgtcgcatcatgcactacatcattgcttttcttaccgatcgtcagatcgagtgggcccacttggttaggtaccatatgcataaggcattatggaccaatgcaccacttccgtatcctcaattagtcactctttttctttgtcactttcaaattcctctagatgatgaaccttttgttcaagtcaagaaatcttttgccattggtgttggagcgagagatgcttcctctactcttatgcatgaagtcctttatgagctacgtggccttcgagcattcgtcgctgactgttttgatggcatggatagtcgcctggatgccatgcatgcttgttttgaaggcatggctacacggattactcagcttgaagacgacatgggtttcatcctccattgcttcgatccaccggctgccccatag

SEQ ID NO: 45760 - DNA, 132 bp, Glycine max
  Peptide Sequence Number=SeqID_137445
atggctacaccaatgagtactgcttgctatttggataaagatgaaaccggtcagtcaatagacattaagaaatatcgagatttcaatcaaatcccaaagaatcacatcttagtgcagttaagagaattataa

SEQ ID NO: 45761 - DNA, 201 bp, Glycine max
  Peptide Sequence Number=SeqID_137446
atgtcccctcctttttcatgggttagcgtctcgcctaacttgaacttacttaacgacgttctctgtttgtttagcgccgggaaggggcaacgatcagtcggtcgtgaccctagccccacttgcatccgtccctatgtacctgcaagtaggaaacaaaaatacgcgaccaatcgtgaccggtcatcgtcttaccttggttga

SEQ ID NO: 45762 - DNA, 459 bp, Glycine max
  Peptide Sequence Number=SeqID_137447
ttgcttgttgtaccatctgtggtgaggctcatgaaacaggccaatgtattcccattgaagaaaacactcaaaaagttcattatatgggaaatcaatagagataaggatatactcaaggaggattctcaagcttccagcaggggtggaccttctaacaggccaatccaacaagggcctaacatctttcagaggactactaagctggaggagactttgactcagttaaagcaggtgggacaactggccaagcagatagctaacaagtcatccaacagttttgtggtgaatacagaaaagaatcccaagttggaatggaaagctatgatgacaagaagtaagaagtttgtggaggcggaggatgaggataatgttgtatccaagaagaaagctgctgaaaagaaaggtattgatgaaaagaaatatgatgtaagaggtgaaagcaatcaggaaaataagtag

SEQ ID NO: 45763 - DNA, 390 bp, Glycine max
  Peptide Sequence Number=SeqID_137448
atgggaaatgcaagatttcttgaggaagttgagtttgggaaggaagagaacataaggaaagttgtctttgagaaagaacctattattgacagtgctcaagtcctcatacctattgttgttcaagaaacaactccagtaatagaaaacaatgttcaaactattgttgatgacattgttcaagaacaagacaacgatgaggttcttcctcaaagacctatacaacaacctcaacaacctcaagaagtgttattaaggagatctaatagagagaggagaagtgcaatccctgatgattatattatctttctccaagaacatgaggatggcattggttttacagaggatgatctgattaacttctgtcaaaccatgcttagttctaactcttaa

SEQ ID NO: 45764 - DNA, 144 bp, Glycine max
  Peptide Sequence Number=SeqID_137449
atggacaccaaaggcttcctagccggagaaagaataacagatgccggaatgcttttgggaggaagggcacaaataggtggagatggattttcaaaaaaactctctaaaactttagaatctaatctaagagttctccctacctga

SEQ ID NO: 45765 - DNA, 165 bp, Glycine max
  Peptide Sequence Number=SeqID_137450
atggcaacggaatggagagggaagggagagaggagacgccacttcaaggagaagatgagtttagaaaaagctcagcaccataggaggccatggataagagctttgaggaagaaggagcccactaatccaagatcaagtccaagattctccactaagtgtgcttag

SEQ ID NO: 45766 - DNA, 258 bp, Glycine max
  Peptide Sequence Number=SeqID_137451
atggttacgctaattaatggagtgtttcatccatctaaggttgcagcaaaggttgtcactttgtccattaggcaacaatttggtcagccttggcctacatggggagcaattccaaaagatcatcaggaacttttttccagtattttaaggtggttctatcagcttgtaggatcacgccatttgcctgaggagcttggtcgaactgtatacgtagatgaggtctttcagcaaactcatttacgaaaggatactagttaa

SEQ ID NO: 45767 - DNA, 65 bp, Glycine max
  Peptide Sequence Number=SeqID_137452
atgtcgcgaaacttcacagattgcccaatgatgggtgttaagtacctcgaagcggtcaagcgaag

SEQ ID NO: 45768 - DNA, 780 bp, Glycine max
  Peptide Sequence Number=SeqID_137453
tgctggatttacgagcactttccatcagtccacaggtctgttgctgacgatggttttgctgaggctagcccacgtgcctgtaggtggcttacaggtaaggcccagatgatcagcattaaggaagccccttacagagcacgtattgatggcctgacagtcactgacgtctgttggatgctgtatgctgagcatcggggagttcggggctatgacttgatctcctcgtacatggggcaagtcagatggggtccgatcatcgtctaccttcgaccagagagggtggttcggcagatggggtacattcagacagttcctctgccatcggttcgtgattcgttgacaggtactgatatagacgaccggtgggtacagttttcagatcatgtagcgcctacaggggagctctgtgtagttcctgggcaggtggccccagactacatggagtgcttttttcagatttcacacccctttgtgacgccgacggaggacattgctgagcccagacctgcgcctccccttcccactcatgatgatgacttcgtggagccacctgtcgcccaagttccaatcgcgtcagacccccctacgcattctgtggttgattgcacagcatgtgtcaggatgggaaggattgctgagcatttggagcgcgtcatcaacctcaggatggtgactgcaagaactgacttatatgatatcatggatctttgcctgaggatagctagagatgacgacccagatgacagtcttaggccgcgacagagaccccgcataaattag

SEQ ID NO: 45769 - DNA, 237 bp, Glycine max
  Peptide Sequence Number=SeqID_137454
atggtacctaatgcatggttaactaggaaatggtgtttcttcgggcatctcaatttcataattacattttccgtgcataagcttaagggatgcccgagtcattcatcggtgtgggaggttgttgaagtattggcgatcagaattgccattccttggattacggggttgaaccgagctcatgcttttacaaaaagtttcaccttgacaaaagatgtcgggaccatgttgaaaatctaa

SEQ ID NO: 45770 - DNA, 51 bp, Glycine max
  Peptide Sequence Number=SeqID_137455
gacaagcaaaactgtaaatttggggagttgttagtcggtgaatacgactaa

SEQ ID NO: 45771 - DNA, 147 bp, Glycine max
  Peptide Sequence Number=SeqID_137456
atgttactgggaacctcaagccttagtattcacaatgccataaacgatgcttcatttgattgtaccggatgccgaacgacacctcacaaggacacaaagaaaggtcttgccaaatgtcatcaagcaaaggtccccggacgaaattag

SEQ ID NO: 45772 - DNA, 483 bp, Glycine max
  Peptide Sequence Number=SeqID_137457
atgatgacaatgatagtagacacattaccagtattctactatggagaatggtgggctacgcaccttcaaagctttgcggatttggtctttgccagtgaaaggatcgatgtgggtctgaaaagaggcaaatttagtcatcctgcttggacgaatgagaaaactggggcaaatgaagagggtgaggatgaaggagaagcccgtgctgtgactgccattcctatacagccaagtttcccaccaacccaacaatgtcattactcagccaataacaaaccttctccttacccaccgcccagttatccacaaaggcaatccctaaatcagccacaaaccataaccctagccaaggttcatcaacctccatttcttcgagaatacgactcgaacgcaacgtgtgcttgtcacggagaagcctcggggcgttccattgagcattgtagggctctgaagcgtaaggtgcaaggtctaattgatgctggctga

SEQ ID NO: 45773 - DNA, 543 bp, Glycine max
  Peptide Sequence Number=SeqID_137458
atgtctgaggtgcatggtacttctatggtcattgatcagtcacttttcttttctttgactcatttacccagtcaaggtgcaccttttgagggcaccattgttgatgactggaaattcgattattcgagtcatgatgctcgtcgcatgatcgactgggcccatttggttcggtaccgaatgcataaggcattacgggccaatgcacctcttccttatccacatttgattactctgtttttgcgtcattttcaaattccgattgatgatgaaccctttgttcaagtcaagcgttcctttgcaattggtgctggtgctgtgacctcctttgggtatcgtaaagatcggaatggacaatggctgaagaaggatgcactccctcctcaagatgaacgtactccttcacctccccctcaacgtgaagattccgcactcatgaatgaagtcctctccgaattacggggtcttcgttcttatgttggtgaccgcttcgacttcgttagattcacgctttgccggtatggacattcgccttacacagcttga

SEQ ID NO: 45774 - DNA, 537 bp, Glycine max
  Peptide Sequence Number=SeqID_137459
atgacccaagagctggtaacccgcggagacaccttacagttatccgcacctcgtcgttcagtgaccccaagtgtgattgatgagcagaggccaatgtggtcatctgcgccctttccggagatgtcagcatcttccggtggagactttttcaagtctcacaagttatctagaactacaggcggcgggcccgatgacatgcggagacaaaatttggtcattccgcactcatttgccattcagacacagtcgtgtccgatggcacgcagagacaaaatttggtcattctgcacccttttgtcatccagaggcggcgggcccgatgacatgcagagacaaaatttggtcattccgcacccctttgccattcagacacaattgtgtccgatggcacgcagagacaaaatttggtcattctgcacccttttgtcatccagaggcggcgggtccgatgacatgcggagaccaaatttggtcattccgaaaccctttgccattcagacacagtcgtgtccgatggcacgcagagacaaaatttga

SEQ ID NO: 45775 - DNA, 315 bp, Glycine max
  Peptide Sequence Number=SeqID_137460
atggcttatccacctacctcgcctcctcctcctccttcttctcctcctcctcctcctccttatcctctttcaaacgcatcagctttgtcggctatcgtgaagcggacacgcaaagcctcacgtctacgatccttgtctactagaccacctagtgttgagagacctgtggtccacgttgatcctgctaccagcaaggccgacggtccccacaggaagaaattaagaacatatttggggatagtgacgcgtgataaggtggacgtcacgtacgagaactggaaggaggtccctactgctcagaaggacttgatttag

SEQ ID NO: 45776 - DNA, 258 bp, Glycine max
  Peptide Sequence Number=SeqID_137461
atgaaggagaacttgaaaaaattaagagatatgaacaaagatggcaccaactcccaagctaatgtagtaaaaagtgttgaagatgaagatgatgtgtttttggcaacaaacgatgagcacatttgcagagatcgaaagatgtttgatactttgaaaatcgatggagaattcagccatttcaagttagggaatggtggaaaaatgaaggttgaaggcatagagagtgtgaggatgaagctccatgatcgtgctatttga

SEQ ID NO: 45777 - DNA, 273 bp, Glycine max
  Peptide Sequence Number=SeqID_137462
atgctcaatggaatgccccgggactcctccatgataagcacatgttacgttcgagttgtatcctcggaaaaatggaggttgaggaaccttggctgggttatggctaccattgcattattgagtagatatgggagtcagttagcatacaacaccaaaattggggtgaattctataggcttctttgctggaaaatttgttccctggttggtgctttggttcatgataagggtggtgtttggtatcggttatgcggtaggtgggatttacgactga

SEQ ID NO: 45778 - DNA, 150 bp, Glycine max
  Peptide Sequence Number=SeqID_137463
atgcaatgcatgaatatgtgccccatgtgtgcagttaagaaggtgatatggaccttccagcttcccgtgacaaaagacgagaccaacatacaacgcatgcgtgacaacatgatgcagatgcgcaaaagcgcaacagtgggatgtacatag

SEQ ID NO: 45779 - DNA, 216 bp, Glycine max
  Peptide Sequence Number=SeqID_137464
atggcccgcacgaagaagacaggggagatgacgactgaggccgcaaaggaaatcgctgaaaagattaatgccatgtaccactgtgtgttttctgtgcaagattcgtttgaggagcaggccacacagggatcgttcgtcccccatggacgtccagagcaccctggacgtgtccgtgctgctggagccggtgtcaccatcaagcaatactttggatag

SEQ ID NO: 45780 - DNA, 633 bp, Glycine max
  Peptide Sequence Number=SeqID_137465
tcaaggtgcaacgtttgagggcaccattgttgatgactggaaattcgactattctagtcatgatgctcaccgtatggtttgtaatgaccaggctgaaatgaacgatagattgctggctggatcattaacctttgattgtcacatcatgcactatattatcattagaattttgcttcctcgttcttctaatttggctcaagcctctgaggaggacttgattttgatgtgggctttccttaccggtcgtcagatcgactgggctcacttggttaggtaccgaatgcataaggcattacgggccaatgcacctcttccatatcctcaattggtcaccctttttctccgtcattttcaaattcctcttgatgatgaaccttttgttcaaatcaagcgatcctttgctataggtgctagtgcagtcacttcatttggttgtcgtaaggatcgtaatggtcaatggctgaagaaggacgcactacctccacaagaagagccccttatgactgaagttctttcagagttacggggcctttgcacctatgttggtgaacgattcgattccttggatggtcgctttgaaggcatggatacccgcatcacccagcttgaagaggatgtgacttatcttcgtcg

SEQ ID NO: 45781 - DNA, 648 bp, Glycine max
  Peptide Sequence Number=SeqID_137466
atggcaagagtagcaaaagtggtcaagatctcggcacaagagttggaccgagtgaagcaaaacaggaatggggtggtagggataccaaggaagcacttggaggagagggcagaagctttggcatatcaaggagagtggacctcgttcattgatatattagcactgttggtgtttggtgtcgtactctttccaaatgtaaacgggctagtggatttagtggtgattgacgcttttcttgcttatcaccacagcaaggaaagcccggtcattgttgttttggccgatgcctatgacacattcgacctgaggtgcgaaaagagaagtagacctgtctttcccctacaaggtcatcgcatgtgcactgagaaaggaaaagaaaattgggaagagctcttggtatgtatggtagaagcgtccattagttggttcccccaatggaaggaaggaggggctagagttttgtgctcatgtgaagggttcccaaacgtccccttgatgggaacaaagggttgtattaattacaatcccatactggccataagacaactaggctaccctataagaggggcaccgtcggaggagatcattgcgccttttgtcgcccggggtttcagagaaggcaatgcaaaaatgcttcagagaatctga

SEQ ID NO: 45782 - DNA, 792 bp, Glycine max
  Peptide Sequence Number=SeqID_137467
atgacttaccaactactgcaagataaagtcagtacccgagcggcaattctgccccaagaaagtgcatatgaagccagcctggttgaaggctgcaccatttttgcggcgggcagtttactggaagtatgcgcccacttatccgataagcagacgttaccagcgcacccactggtaacgccaaacaagagcgtagtattacccgattaccaagaagtaaaagggcaactacgcgcgaaacgcgccttggaaattgccgcggcaggacaacatagcctgctcatgagcggcccgcctgggaccggcaaaagtatgctggcacaacgttttgtcagcatcctgcccgaaatgtcgacacaagaggctctggaaagcgcagccattttatccctgactggccagttcccggcaacccagtggaaacagcggccatttagagcgcctcatcacactgcatccgcagtggcactggtgggcggtggcagtgtcccacgccctggagaaattagtctggcacatcatggcgtgctctttctcgacgaactccccgaatttgaccgcaaagtgctggaagtgctgcgcgaaccattagaaagtgggcatatcaccatttcacgcgccgcgaggcaagccactttccctgcccaatttcaattaattgctgccatgaatccttgcccctgtggctattatggccactacaatcagcgctgccgttgcacggctgagcaaattttacgttacaagaacaaactctccgggccgttactagaccgcattgatatgaatattgat

SEQ ID NO: 45783 - DNA, 171 bp, Glycine max
  Peptide Sequence Number=SeqID_137468
atggatgagtattacaaagagatgcagatttccttgattaggtctcaaattgaggagtctcaagaggccaccatggcaaggtttttgcatggtctcaatagggagatccaatacattgtagagttgcaccaccatgcttctttggagggtctcattcatcaagctatcaag

SEQ ID NO: 45784 - DNA, 90 bp, Glycine max
  Peptide Sequence Number=SeqID_137469
atggcgaaaggctcaccgcctctggatgacaaaagggcgcagaatgaccataatttgtctctgcgtgccaccggagacgattgtgtctga

SEQ ID NO: 45785 - DNA, 651 bp, Glycine max
  Peptide Sequence Number=SeqID_137470
gattttgcccggactgctgcagggaggcgagtgcgaatcatgcgcaccaacatgaccaccctgacccagatatggatgacgttactcctcagcaacatcctgcccaccgatcataattccgaccttcccatgccgaagtgtcagctggtgtacgccatcctgacacggatgagcatccatgtggctcagttgatcgctgatgccatctatatttttgcaggtatggcgcccactaggcaccctttggacccagataagtccaatagggccctgggattccccgcactgatcacagggctctgccagtcgttcggagtccccgttgcacctaccaaggtgattcggccgcccatcacccgggcttttattgagaagtactgtacccagagacaggctcagggtgatgttccacaggccgcaggcgcgccaccaccgcctcatcaggctggccaggctggggcatttgacatggagcagtatttacggcatttggttcgccaacaggcggccaaccaccgagcacataccagttcagggcagaggttgcatggcccagagattggcccgaggcctaagcaggagaggcgcccccagaaagctcccggcgatgagaagaggcccacgaggacgagagatggccgatttgcttga

SEQ ID NO: 45786 - DNA, 186 bp, Glycine max
  Peptide Sequence Number=SeqID_137471
atgatatgctttttcccatcctccgtatttttaaaaagtcctaaaaggtctgctcttgctcttgctcctgctcctgctcctgctcctgctcctgctcctgctcctgctcctgctcctgctcctgctcctgctcctgctcctgctcctgctcctgctcctgctcttgaattaaacgaggcccaatag

SEQ ID NO: 45787 - DNA, 170 bp, Glycine max
  Peptide Sequence Number=SeqID_137472
atgggggtgcaaatagcacccaggcccacttgggccctccagaatattcctccagaaggctgttgcttccgaaacgtttccgtaacgttttccgtgaagaatttcgcaaaggtttcaaccgttcttcgaggttcttcattcgttcttcatcgttcttcgatcttcaacgg

SEQ ID NO: 45788 - DNA, 1059 bp, Glycine max
  Peptide Sequence Number=SeqID_137473
atggttgtggagttagggcaacaggcggtggagctatccacccttgtcacacgtgccgctaacgatatgtcctccaatttggaaggcacgggttgtcacttgggaggtgttttgcagaaatacggtatgagcactccaagaacagaagctggtttggatacaatagctttgaaaggatttgttgatggttcctttgatttgaagttagcttatagtgttttttgtgatctgcaagtgacttctgatattaacttatttaagctgctgcatagatggccaggtccggaaagaattagaatgttcatatggaagattagtcatgaaagcatattcacaaatgcaaagagaatgagaattggcataagtgtgaatgatgagtgttctacatgtcaagctgaagttgaggctcttgcatcttttccaagaattttgaggtatctaagatctgaggaagtaaagaggcaagtggttgtgactaggcctgtgagaacgcattggactaccttccctaacacttatggagaggttcaagttgctcacatttctttcatggggcgcatggctagggatgacaatggtaaggccactgacgaaattgagttgacggctaatgatacaacaattaagaagcaatacaggaagttcgccctccaacttcattctaacaaaaacaagtttgctggtgcaaaagctgcatttaagctgattggggaagctcaaagagttcttttggtcagcaagcttttggtgtgcagaaccatagtcaaaatcatggtgctttcaatgtccaatacagaatcacataagaaaaaaggtcccactgttgatgtctctgtaaagctaaatggaaagaggaagagaaagcaagtagcacagtcaagtgaaagtgccgaatctgtcagcaacactgattctaaagagcagaagcaaaacttttattttgaagagagcttacaaaatatagatgaagaaattaaggaggtgagaaaacaacaggcagtgggcagctcaaagttagacaagccttcagagcattcacccccgaagtcaaccagatga

SEQ ID NO: 45789 - DNA, 273 bp, Glycine max
  Peptide Sequence Number=SeqID_137474
atgccgaggcgcttccataacgtttccgtgggtgatttcgcaaaggttttcaaccgttcgtcgttcgttcttcggtcttcaaccgctctcgaatctggaatattcttcatgaccggtttccttcggtttttccgacgttttccacaaataaacgttggtggcgactccgcgcattttcctcctttggaagacgcacccgtgagcctcgcctcgctcgcccgcgaaagggttggttgcgacagttggcgactccactggggactgtttttgtga

SEQ ID NO: 45790 - DNA, 252 bp, Glycine max
  Peptide Sequence Number=SeqID_137475
atgcatcatacacaagtcttccggaagttacgaagcccaattccggaagaaggtcttccggaagtagtttccggaagaacttcttccggaattggccttcatcacttccggaagaaggtcttccggaagttacgaagcccaattccggaagaagtgcttccggaagaacttcttccgcaattggccttcaccacttccggaagaccttcttccggaagtggtcattccggaccttcctccttctgtgcctaa

SEQ ID NO: 45791 - DNA, 729 bp, Glycine max
  Peptide Sequence Number=SeqID_137476
atgatcggctctctcaatgagtcaatctcatgctttatcataagggtagacccttgggtactagtacctatcgcctttagaggattacacgtcctctccttcagagggctacacgtcctcgccttcagaggactacacgtcctcaccttcagaggactacatgtcctcgccatcagaggactagacgtcctcgcctttagtgggctacacgccctcgcctttagaggactacacgccctcgccatcagaggactacacgtccttgcctccagaggacttcacgtccttacctttagagggctacacaccctcaccttcagaggactacatgtcctcgccatcagaggactacacgtcctcgccttcagagggctacacgccttcgccttcagaggactacatgtcccccttttcagagggctacacaccctcgcctttagaggggccaatagtttccttttatcagttcctgggccaccccctgatcctggaggagggccacctatgcaagtacaaccagaggaggaggctatcgtgcagctactatgcataccggggcaagatttcacccatgccgctgcaaagaaacgagtgcggatcatgcacaccaacatgaccactattacacaaatatggatgacgttgctacttagcaacattctgcccagcgaccgtaatgtcgatctccccttgtggaagtatcagttggtctgtgccgtcccgacatag

SEQ ID NO: 45792 - DNA, 432 bp, Glycine max
  Peptide Sequence Number=SeqID_137477
atggcagcacaattaatccatgaccgagtagagatggagtgcctagagggagtttgggagaccctcgaaggcaatccaaggtgccgattctggggcacgatttggttcacggctacttcattggtacatccagaggaactagcacgcacgcttcagcatactgtggagtggatattacctgcacctactccatatcgactagtggagccagtccaagtgatagaggtgacgtcctctgaggaagaccctgaggaggacccagaggagctacctcctgagcctgctgtggatgctcttgactttccagaaggtgatgaggacccactccctgaggtggattctcccgaggaagtcatgttggcatctgaggcagactctacggaggagagcggccctggagggatagcgactagtggaggctcttcatcatag

SEQ ID NO: 45793 - DNA, 300 bp, Glycine max
  Peptide Sequence Number=SeqID_137478
atgaagaacgctgaaatacatagccagggggctcagggatccttagaacagcccccttcagccttttataggaaaaagggggaggaggttgccgcccagctcacccaggcgaccttagctcgcccagcgagctgggttgcttctccagaagcaacccagcttcaaaaaacgttctggaaggcccaattcaaaatttcgaaattgctatttgcaccccccccaattttgataagttcaccccccctttttcgtaatttacggaaaagttacggaagccttacggaagcatataggacttga

SEQ ID NO: 45794 - DNA, 198 bp, Glycine max
  Peptide Sequence Number=SeqID_137479
atgacaatcaattcatggggcttcggacttgatggtggaggacgcacgaacagcgctaggcaatcaattcgtgggactctgtactcgatggtggaggacgcacgaacagcgctaggcaatcaatttgtggggctccagactcgatgcgctaggcaatcaattcgtggggctcaggactcgatggtggaggatgcatga

SEQ ID NO: 45795 - DNA, 889 bp, Glycine max
  Peptide Sequence Number=SeqID_137480
atggcaaatcaagaagattgggtcccgtttatggatgtgttagcattgctaatctttggggtcgtcctctttccaaacgtagatggtttggtggacctagccgcaatcgacgcgttccttgcataccgccatagcaaggaaagtctggtggtagctgtcttggcagatttatttgacacatttgaccgaaggtgcgagaagagtagcgcacggatcatctgttgcttaccccgctctctgtgtttgagccatcgctcgtgtactgaaaagagaagaatagattgggaccagtttttgactgggataggaggtagaacaatcaattggttcccccgatggaaggaaggaaaggagggagtccttttctcatgtggaggatacccaaacattccgctgataggaacgaggggttgtattaactacaatcccgcgctcgctataagacaactagggtaccccatgaggggagcaccgacggaagaaatcatgtctcctttccttgtgagggatttcggcgcgcaaaatttcaaggctatacaaagaatccataaggcatgggaaaccccgttaagaaaagatcaagaacttaggggcattcgtaatggcatcatcggtggttaccatgaatggctgaaagttcatatacgaggtttagattggctcgccaagttaaaagtcgtcagtgaagagagttttgaagcaccggaggaggacgaagaagtccaagctctcaaaagcgagttaggaaaggcgaaacttgccaaggagaagttcaagttggccgctacgaacatccggaaggagtgtgccggattacgggaagagaatgcaactaccgcaagagcccttgaacaagagactaagagggctcgcaaggaagagtatggcc

SEQ ID NO: 45796 - DNA, 234 bp, Glycine max
  Peptide Sequence Number=SeqID_137481
atggcggattgccttgagggttcgcacctaggcaatcatgaaacacagctccaaactcgaaagtggaggacacatgaacacttggcaataacattcatggggctccgaaaaagggggagaatggaggattgccttgtgggtccgcacttaggcaattatgaaacacagctcaaaactagaaaatggagtacacatgaacgcaaaacgcattcatggggccccgaaaaagggtga

SEQ ID NO: 45797 - DNA, 163 bp, Glycine max
  Peptide Sequence Number=SeqID_137482
atgggggtgcaaatagcacccaggcccacttgggccctccggaatattcctccagaaggcgccgaggcgcttccgaaacgtttccgtaacgttttccgtgaggaatctcgcaaaggtttcaaccgttcttcgacgttcttcatcgttcttcgatcttcaacgg

SEQ ID NO: 45798 - DNA, 129 bp, Glycine max
  Peptide Sequence Number=SeqID_137483
atgggcataaaggagcactcaaaccaggtgacccccaaggcctacactctgaagagtccattagggcctctccctcctgattcaggtccaacccctaaaataattttttcatccagacactgctcatga

SEQ ID NO: 45799 - DNA, 378 bp, Glycine max
  Peptide Sequence Number=SeqID_137484
atggaatcttctgaagattcagaaaatgaagagattaacctctgcctaatggctaaaagttatgaaagtgatgaagaggtgtctttgaggaaggagtggtacgtagatagcggatgctcaaaacatatgactagaaatgcatcaaagtttacacatatctctcccaagaaaagcgggcatgtaacatatggtgtcaacaacaaagtgtcgcaacgtgcccttcgcaggcgagcgagggcaaggctcacggatgcgctttccaaaggaggaaaggtgcgcggagtcgccaccaacgtttatttgtggaaaacgtcgggaaaaccgaaggaaaccggtcaaaatgagaattctaagttcgggagttgtatttacgcttga

SEQ ID NO: 45800 - DNA, 237 bp, Glycine max
  Peptide Sequence Number=SeqID_137485
atgcatgatggaatgcatatgacacagatgcaatctaggaatgcgggggccggaggaattgtctccttcttagatacaacgtctaggggtagcaaagcgcctcaacatacgtttttaagaaggcgacacggaccctccgttggtattatcctctttgaagaacatattgtagcagtagggactactagcaacaataagttttcaaagagaaaagctctagatgagggttcactgtaa

SEQ ID NO: 45801 - DNA, 219 bp, Glycine max
  Peptide Sequence Number=SeqID_137486
atgaagatgctcttgataccacatgatgttagctccattggagcttatgaatggcagcggaatgaagaaaggaagagagagaggagacgccacttcaaggagaagatgagtctagaagaagctcaccaccataggaggccatggataagagcttggaggaagaaggagatgaatgaagggagaggaagagaagagcacgaaattttgtgctctaaatga

SEQ ID NO: 45802 - DNA, 270 bp, Glycine max
  Peptide Sequence Number=SeqID_137487
atggaacaacataaatctgcatcccttcctgtggcatatgcaatacaaggcaaacctcaaggacgagacatgagtattgtccaatgtttctgctgcaaaggccatggacattttgcttcccattgtcctaaaaagttctgcaattacagcaaaaaagaaggtcatgtcataatcgaatcagaccaccacagagaaatgcaacaaccttcactacaactgatgcctcttctactactcttgtttatggggattagaattcgcctgctctag

SEQ ID NO: 45803 - DNA, 362 bp, Glycine max
  Peptide Sequence Number=SeqID_137488
caaagcttttcttgaggccttatcaggttagatgggatgccaccgtgttcggggtcgttaatccagatttccccctgtacataaagcacgaagacctctccaaaatcgcacacggtggtcaatgtctcagcatatcagtgttacagttgtggattctgaatctcactgaaacagtgcgagcggggattctgatatctatggatgtcccgagctcatccattcagaggttagggcaatcgcaatttgatgaaagttacataaagagttggatgcagagttcacaaagcaatgtgtatcttggagcctacctaaatgggttccacttgcagcggacactggcagatggtggtcatcctgcctaa

SEQ ID NO: 45804 - DNA, 489 bp, Glycine max
  Peptide Sequence Number=SeqID_137489
attctcaggaaggatttgactacactagctcaggtgtggagtgtcctctcatactccaacttggcctccacatcacatacctctaatttgacagtggacagagttaggctgatctttggcctagtctctcacttggatatgaacataggagcacggatctctggccagatgacctctatagcccagtctaacacctctagacttgggttccctactctaatcaccgcattatgcagagccagaggggttgtctctgactgccttacctttgagcgcctgagcccggtcattaacctggcctacattaggaagaactgttggaaccctgaggatctaacagtctctatccgaagggctaggagggcgaggacaaggccaactgagcttccttctacttttgcagctcctactccagcagccccttctgtccccgctcagatagattctcagcactttgaagccatgcttcaaagcattcatcagggatag

SEQ ID NO: 45805 - DNA, 138 bp, Glycine max
  Peptide Sequence Number=SeqID_137490
atgagaaaaatcacagaagctggcagaaaaatcagtgtccaggaaaaaaaaggaattggaaaggaggattggtgccatcccttgaagaattcgagtcaagaagcaaggggccaaccaccttatgagctattggactaa

SEQ ID NO: 45806 - DNA, 276 bp, Glycine max
  Peptide Sequence Number=SeqID_137491
atgcccttttgcggacgagcgaggcgaggctcatgggagcgttttccaaaggaggaaaatgcgcggagtcgccaccaacgtttatttgtggaaaacgtcggaaaaaccgaaggaaaccggtcgacaaaagcggggctcttgctcctatataccctgcatcgaagagaaaatcagacctacgtagttctttttaagggtgaatcaagcgattctttttacttggaaggtgatcattttaaggcgttggaccttaaaaatgatccatttacttggtaa

SEQ ID NO: 45807 - DNA, 414 bp, Glycine max
  Peptide Sequence Number=SeqID_137492
atgactcaagagctggtagcccgcggagacaccttacggttatccgcacctcgtcattcagtgaccccaagtgtgattcacgagcagagaccaatatggtcatctgcgccctttccggagatgtcagcattttccgatggagacttttcaagtctcacaaaggatacgtcggagcaagagccttacggccgccccttttgtcatccagaggcggcgggcccgatgacaagcagagaccaaggtcattctgcactccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 45808 - DNA, 276 bp, Glycine max
  Peptide Sequence Number=SeqID_137493
atgtcggacgccatttaccaatttgcagggatcgcacctctcaggcatccagtggactcggaaaagtccaatagagcactagggtttttgtccttgatcacaggcgcaacaacaggggcaggaccatcagcagagccagacgagatgcattgtcgccacctctacagcagtcgccatctctggagtccatctctattcacatgtagaggatggaactctatatgcaacatgtggctgaccaacaggcggccaatcacaagggacatgtatagctga

SEQ ID NO: 45809 - DNA, 459 bp, Glycine max
  Peptide Sequence Number=SeqID_137494
atggtgcgtaacaacgaaaacgacatcaaaggcatcgacgatctgaacggtaaagtggtcgcagtgaaaagcggcaccggttcggtggattacgccaaagcgcacatcaaaactaaagacctgcgccagttcccgaacatcgataacgcgtacatggagttaggcactaaccgtgctgacgccgtgctgcacgacacgccaaacatcctgtacttcatccacaccgctggcaaaggccgtttcaaagccgtcggtgactccatcgaagcgcagcagtatggcatcgctttcccgaaaggcagcgacgacctgcgtgagaaagtgaatggcgcgctgaaaaccctgcacgacaacgggagctttgttctccctgctttttacatttccactgcaacagattctggagtcacaccatggagtttgactggagcgtcatctggcccgccttaccgatcctga

SEQ ID NO: 45810 - DNA, 975 bp, Glycine max
  Peptide Sequence Number=SeqID_137495
atgtccgctcagatacctgccgcagattattcaggtgcagagaaacagcgcctgtcagaaacacgttccattgattacatcccgctcagcgagcgtcacgggcatccgtttagccagttcacgttgtggtttggcggcaatttgcagatcaccgccattgttaccggtgcgctggcggtggtgctgggcggcgatgtggtgtggtcgattgtcggtttactggtgggacagatcgtcggcgcggccatcatgtcgctgcacgcgattcagggcccgagccttggcctgccgcagatgatcaccagccgtatgcagtttggcgtgtttggcgcggtgatcccgctggtgctggtgtgcattatgtatgtgggcttctcggccagcggcacggtactggccggccaggcgctggcgaagctggtcaacgtcagcaatgcagccggcatgatcatcttcagcgccatcatcatcgtgattgcggtgctcggctatcgggtgattcataaactcggcaaagtggccagcgtcatcggcgtgctggcgtttgtttacctgttcatcaccctactctccagccacgatttagcggccgtctggcaaaatcagcacttcagcgttgccagttttctgctggcggtatcgctctcctcgtcatggcagattgcgttttgcccttatgtgtcggactactcgcgctatctgccggtggatgtctccgcgaaaaagctgttcagttcggtgttttttggcaccgtgctgggcacgcaggcatccatgacgctcggcgtcattgtggctgcaattgcgggtaaagcgttctccggtaatgaagtgggctacatcgtcgggctgggcagcagcgccaccatgggtaccgagctcgaattcgtaatcatggtcatagctgtttcctgtgtgaaattgttatccgctcacaattccacacaacatacgagccggaagcataaagtgtaa

SEQ ID NO: 45811 - DNA, 333 bp, Glycine max
  Peptide Sequence Number=SeqID_137496
atgcataccgggtcgcgcaagattcacccgtgcccctgcaaaaagacgagtgcggatcatgcgcaccaacatgaccactcttacatggatatggatgacgttgctatggttagccattctgccgcgattcctacaatgccatctccccctgcaaggatcgcgcccgcaagacacccagtggacccggagaagcccaacagggtcttggggtttccagctctgattacgggcctctgtcagttctacagagtgcctgttgcccccagcaaggtcatcaggccccctaccaatcgagctttcatcaagaagtactgcgcccccaggcaggcgtag

SEQ ID NO: 45812 - DNA, 376 bp, Glycine max
  Peptide Sequence Number=SeqID_137497
gttacaggttgtaccatttgtggtgaggctcatgaatcaggtcattgcattcccattgaagagcacactcaggaatttcattacatgggaaatcaacagaggcaaggatacaaccaaggaggattttcgggttccagcaaggccacatcaacaagggccaaatatttttcagaggaccaccaaactggaggacacactagctcaatttatgcaagtgaccatgtccaaccataagagtactgagtcagccctaaaaaaccttgagatccaggtgggtcaactggccaagaagcttatgccagctgaggatgaggatgttgtttctttgaaggagcaagttgctttgaaggacactgctgataaaaagaagaatgag

SEQ ID NO: 45813 - DNA, 51 bp, Glycine max
  Peptide Sequence Number=SeqID_137498
aaagcaaacggcctggatcatttaatacaacagtatgaacacgataccaag

SEQ ID NO: 45814 - DNA, 419 bp, Glycine max
  Peptide Sequence Number=SeqID_137499
atgacgggcgacggcgacaagggttcctacaagcgtaacggcttcgacggcggcacccgcttccgtttcgcggcggactactacctgttcgacgatatcagctggatcagctactacgagctgggcgtgaacattccggcgctgttcgactgggatcaccactatgccgacggcgcgagaaacaccagccgccgcatgctgtacaccggcctgaaaagcaacacctggggccagatgaccttcggccagcagaacagcgtttactatgacgtggtgggcgccaagaccgatatctgggactacgacatgttggcccaggcgccgggcaacggcatcaacggcgactacgacggctcttaccgttcacgcaagatgctgaagtacaagaaccgcttcggcgatgcggacgtttatgcctc

SEQ ID NO: 45815 - DNA, 295 bp, Glycine max
  Peptide Sequence Number=SeqID_137500
cctcttaaacgactatcagcccatgcatcctgaattcccggatgaggacatcatggccttgtttgaggaaaaattggacgaagatcgggacaaatggaccgtatggtttgacggagcgtcaaacattctaggccatgaagcgttggagcagtattggtcttctccggacaatcaagcggcctcctataccaatgtcacaaggggtgtggtggtcaggttcattaagaaagagatcatccttgccgatatggtttccaaggaagattatcacggacaacggcaccaacctgaataa

SEQ ID NO: 45816 - DNA, 454 bp, Glycine max
  Peptide Sequence Number=SeqID_137501
acacctactcatggattcacagagcctattcagttgaatatcttcattgatggtttgataccacagtccaagcaattgttagatgcttctgttggaggaaaaattaagttgaagactccagaagaagcaatggagcttattgagaacatggttaacaatctgttagctaagcagcttgaatcactcaccgaaacactcagcaaattgccaacacaactacaagcggctcaaccctctcattcagttgttatgcaagttggaggttgtagtatttgtggaagagctcatgaattcgactgttgtataccccaagatgattctgctaaagaggttaccagcaaggagggaacttccatcaaaatcaagggcaaggatggagatcacatccagggaatcaattcaacaaagatcaaggaggaccttccaacagacctccgaatcaagggcctaactt

SEQ ID NO: 45817 - DNA, 150 bp, Glycine max
  Peptide Sequence Number=SeqID_137502
atgtggaccaccacggaaaattgggggagaagcttgccaccagctcgcccaggcgagcaaggttgcttcctccagaagcaacgccttctggaggaaggatctggaaggcccaagtgggccagattgctatttgcaccccctttttactaa

SEQ ID NO: 45818 - DNA, 419 bp, Glycine max
  Peptide Sequence Number=SeqID_137503
ggatcgcgcccacaaagacacccagtggacctggagaagtccaacagggcctggggtttccaactctggttacgggcctctgtcagtcctacagggtgcctgtccccccggcaaggtcacgtcatcatgacataggtaaggatcgcgcccacaaaggcacccagtggacccggagaagtatagcagggtcttggagttgtcaagctctaattatgggtctctgtcagttctacggagtgcctgtcacctccagcaagggcatcaggccccctactaatcgagctttcatcaagaagtactgcgtccccaggcaggcacagggcgaaataccacagcagcctggggatgaccggcagcgggcaacagacacaccgccatcacctctagagttcacctcagctcatccacaaaaaggttag

SEQ ID NO: 45819 - DNA, 156 bp, Glycine max
  Peptide Sequence Number=SeqID_137504
atggagaaagtttataaggttttgggtagagaattgatgcattcctatcctccaagggcattggatagaagactccaagaagattgggccagagatgcaagaaaaggccctagggttctcatgagccttaaggtagatttcggacccatggcctaa

SEQ ID NO: 45820 - DNA, 987 bp, Glycine max
  Peptide Sequence Number=SeqID_137505
atggggtcggaccaagcgccctcctttaaaaagaggttctatcatgtcaaagtcaagaacctagaactagccagcttgcgagaactaggacaacggatggatcaagttcgacctcaagccttcaatgggctagtggacttagcaacaatcgatgccttcctcgcttatcatcacagcaaggaaagcccggtcatcgttgttttggccaatgcatatgatacgtttgacctaagatgcaaaaagagcagcacaagaattgtctgttgtacgcctactctttatgtatggttggtctcccatgtttttcgtcatgaaggtaggcctgtttgtcctctacaaggtcatagcatgtgcaccaaaaagggaaaagccaattgggaagaactcttggcaggtatggtaggatcgtccattaactggttcccccgatggaaagaaggaggggcaggagtgttatgctcgtgtgaaggattcccaaacatccccttgatgggaatgaggggttgtattaattataatctcatgctggtcataagacaactaggctaccctatgagaggtgtaccatcggagaagatacttcaaagaatccgtagagcatggaatacagtggaaaggaaagataaggagcttaggggaagtagcaatggcgccatcggcggctatcacaagtggttgaagtctaggacgcaagggataacttggctcccaaagctaaaaggcctaagtgggaaagaagctgaagtccttgaggaaagtgaagaagtgcaagctttgaaagtggagctcgaaaaaatgagagtggtcaaggaggcgctaaatatggtagtcactagggtctggaaaaagtgtgatgtgctgagagatgtcaacatgactatggtcgaagccttagagcggaaaaaccaaaagggctcgaaaggaagaatggagcaggaacaagctctgaggggctttatggggcagcagcaacgagctcaagcttag

SEQ ID NO: 45821 - DNA, 249 bp, Glycine max
  Peptide Sequence Number=SeqID_137506
atggcttctcgtaaaaggaaggcaccagaattttatgctaacctctatgaccctgaagacaaatcgcctaagcaggtgagggtgcgagggcacctaattaaatttgatgttgacgccctcaaccccttcttgaagacactagtggttatagaggaaagggagagcttgctcgcctactccaggtttgctaatatgaggcctgttcctcaagagcccgtctatgtctccctgggagaggatttgagttga

SEQ ID NO: 45822 - DNA, 300 bp, Glycine max
  Peptide Sequence Number=SeqID_137507
atgccgatctccccctgcggatggatcatgcccgcaagacacctagtggactcggagaagtccaatagggtcttggggtttccggctctgattacgagcccctgtcagttttacggagtgcctgtcacccccagcaaggtcatcaagccccccattaaccggactttcatcaagaagtactacacccccaagcaggcgcagggcgagacaccacagcggcctagggatggccggcagcgagcaacaaacacactgccaccacctctagagttcacctcagctcatccacaaaaaggttag

SEQ ID NO: 45823 - DNA, 222 bp, Glycine max
  Peptide Sequence Number=SeqID_137508
gggcaggatcatcttgggctaccttctggggtcgagacaaaacatgaacaacagaaaccaatcaaggtacttaaggacagatgcaagtggggatggggtcacgaccgaccgatcgttgccccttctctgcgcgaaacaagcagagaatgtcgctgcaaggcagccccgtatcctttgtatttggcagctttcttttactatttgtttgtttttaaaaagtaa

SEQ ID NO: 45824 - DNA, 328 bp, Glycine max
  Peptide Sequence Number=SeqID_137509
atggtgaaagttggaacctcaacgtccgatcaacgtctcattttcgccaaaagttggcccagggcttcccggtatcaacagggacaccaggatttatttattttgagaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccaatcaggctgtgcaactgttgggaagggcaatcggtgcgggcctcatcaaattaatcgataccgtagacctcgagggggggcccg

SEQ ID NO: 45825 - DNA, 100 bp, Glycine max
  Peptide Sequence Number=SeqID_137510
atgagaaagaatgaagatatgatggtggtgattaccgagacagtggaaccgggggagaaagagagggagagcaattacggggacgatgtcgtcgacgtgg

SEQ ID NO: 45826 - DNA, 718 bp, Glycine max
  Peptide Sequence Number=SeqID_137511
atgatgtttactgtttgtaaaggacctacctcaattgaggatttaagaactgttggtaatgttcagtatcctacatatagagaagcatgttttgctatggggtttttgcaagatgataaagaattcattgaggcaatcaaagaagcaaaagactggggctcaacacattatataagaaagctatttgtgttgttacttttaactgcaacaatgaacaaacctgaacaagcttgggaccaaacttggcattggatggctcatgacattgtctataattataaaaaatcatcaacaagttcagcattacagcttgatgataggactcttcaaaatctggtcttgcttgaaattgaacaactgttgcaagcaaatcaaagatcgcttacaaactatccttcaatgccatatccagaagatgtgaattgctcaacctatctagacaataaccttatattagttgaactcaattacgacaatcaagaactcagatcagagtttgaacatctattttctcatatgacagaagaacaagcatcaatttataaccagattgttgaagttgttaataaagatgaaggtggtatgttttttctctatggatatggaggtacaggaaaaacatacatttggaaaacactcgcaagttcactaagagctaacaataaaattgtaattatggttgcttctagcgacatagcttctctattattgcctggag

SEQ ID NO: 45827 - DNA, 177 bp, Glycine max
  Peptide Sequence Number=SeqID_137512
atgacctttccatcacccactacctcacaccaccaaaccacgcttcctttttctatgacctccacttcaactctaagcaaatcattctctcaacgcgactgccgccatgacttccaattcatcaactggctcaagcaaggacagacatattccagacttctagctttgaatccatga

SEQ ID NO: 45828 - DNA, 1029 bp, Glycine max
  Peptide Sequence Number=SeqID_137513
atgcagttacaaaagcagttaaatcctggaggtggaggtgttaatgcagcaatttttagtgctgcaggtcctgaactggagtctgcaacaaaagaaaaagtacaatctctttctcctgggaatgctgcagttgcccctctaccttcatcttctcctttgttcactagagaatgtgtaacccatgtaatacatgttgttggacctaatatgaacccacaaagaccaaattgtctaaataatgattataataaaggctgcaaaattctccaagatgcttatacttcactttttgaaggctttgcatctatcgtgacaaacctgacatggcaaccagttggaaaaacagaaaaccttgaaaggaagtctttaatgttgcaggttcagtctaattgttccagaaattatttcaaaaaaatagatcaaaagagtaaaagagatgttgatcatggatcagcaaaaagcaagaaatacaaggggactcaggatggttctggattgacctttactgattctagggatgaaaatgttgattcagagcatagaagaactgagaggagcatgagtaaggcatggggatcatggggtcaagctcctcaccaaatagttatgcatccagaaaagcataaggatgacttgcttgaaatttccgatgatgctgttgtattgaatgatatgtatcccaaggcacagaagcatgttctggtgttggcacgaactgtgggtcttgattgcctagcagatgtccaaaaggagcaccttcagttattgaacaagatgcatgatgtgggtttaaagtgggctgagaagttcttgaatgagaatgctgctctgaatatatattcaagaactatttttcctctacggctctccctcaccttaaaaaggaaaagaatatgtagaagtggacctccaaacataccgcgcttaaaatcacatatcagcagctgccaatcccccttccctgctcacctgcttcaaaacggacgtttggtgcgtgcaccaggggaacctcgtaacaatttccagtag

SEQ ID NO: 45829 - DNA, 319 bp, Glycine max
  Peptide Sequence Number=SeqID_137514
atgtcttccaaacaaaaacccaagtacatatattttgttgtgccttcgtatagcgtatttttctattctgatttgcaggacccacctatgttattcgcatccggtatgacataccaatttaaggctgtatttcatgttgacaggaatatcattgaggtgccctctgtttatcataaacaatgggctccagattacccggattatgtggtgttggactacaatggaaagaagcaccatataagagttagaaaatttagtaaccgagtctacattgttgatggtctcaaacacttcagcagggatatgggaatatatgaag

SEQ ID NO: 45830 - DNA, 49 bp, Glycine max
  Peptide Sequence Number=SeqID_137515
ggtgaatgctgtgaagattttcccagacgcccaaaatggactcggatga

SEQ ID NO: 45831 - DNA, 477 bp, Glycine max
  Peptide Sequence Number=SeqID_137516
atggcccactacgtgaaccatcaccctaatcaaccggcgaacgtggcgagaaaggaagggaagaaagcgaaaggagcgggcgctagggcgctggcaagtgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 45832 - DNA, 261 bp, Glycine max
  Peptide Sequence Number=SeqID_137517
atgtgtgccagagctagagtgatgagtgaaatagaagaggtacaggaacatatgaaggccgacatggaggccatgaaagagcaaatgaccacaatcatggaagtcatgatgagtatgagaaaaatgatggaggtcaacacggctacagtcattgccgcaagtactgccactgaggtcagggaggcgaagcattgggaagtatgggcggcccccatttcgtgcaagtccagagcaagcatttcttcccaccatgtggcttga

SEQ ID NO: 45833 - DNA, 516 bp, Glycine max
  Peptide Sequence Number=SeqID_137518
atgggcccgaaatctaccctaaggctcataagaaccctagggccttctcttgcatctctggcccaatctacttggagtttttctatccaatgcccttgcggagtaggattgcatcaacacgtcctcgccttgagagggctactcgcccttgccttcgggctacacgccctcacctttagaggaccacacgtcctcaccttcagagggctacacgccctcgccatcagaggactgcgtgtcctcaccttcgtagggctacacgccctcacctttagaggactacacgtcctcgccaacagagggctacacgccttcacctttagtggactacacgtcctcgccaacagagggctgcacgccctcaccttgagaggactacacgccctcacctccagaggactatacatcctcgccttgagagggttgcacgccctcacctttagagggctacgtgtcctctttttcagtgtgctccacatccgcaccttaagagaatttaaggtcctctatccttaa

SEQ ID NO: 45834 - DNA, 698 bp, Glycine max
  Peptide Sequence Number=SeqID_137519
gtgtacgcagaaaaggaggctagaggaagagtgattgactcattacatcaagaagcgacgatgtggatggaccggtttgctctcactttaaacgggagtcacaagcttccccgattactggcaaaggccaaagcaatggcggacgtgtactccgcccccgaggaaatccacgggctcctcagctattgtcagcatatgatagacttgatggaacatatgaaagtcgacatgtcggctttcaaagaacaaatgacttctatgatggaggccatgctagggatgaaacaactaatggagagtaacgcggccaccgccactgctactagcacggctgccgaggcagacccggctctcccgactgctgcgcaccatcccgttccaaacatggtgggacgagagagaagcacatcaggacatatcagcaacccccatccgggatacaaccgaggtgcttacccctacagtttaccacccaactacacaccaccagccatgcatgaagacatggatcatgtttcccccctcatcctcaaaggggagcctcctcggcatcctaacacggtccacgagaatcctcgagagcacgctcagggagacgttgactcctactccccgtttcccgctgaggggccggcgcccaacgcactacctcaacccaacatcaggggagagcctcgaaaccacctaacacagccaat

SEQ ID NO: 45835 - DNA, 462 bp, Glycine max
  Peptide Sequence Number=SeqID_137520
atgtaccctcccttgttctctttgaacctagtggatgtatcctccactagaacggatccacaagagatgtaccctctcttgttctcagtcaaacccaaggaatgggaagaatcaaaagaattctcagactgtgtcgttttaaattctttgacaagggagaagggagacacaaaagaattcaggcggttagtcctttgttcttttggaaaagggagaagagagacacaaaaagaattcaggcggttagtccttggcgaattctttttggcaaagggagaagagaatgaaaagatgaatagcacaagttttcaaggtttggaaaaccagaaaacttcagaaagtttttggtacaaagaagaagaagaagttcaaagagattcaaggcttgtaaaggattgtaatgaaatgattggaaaagtattcaagatacttgaaatgcaaaacaaagccttgcttttatag

SEQ ID NO: 45836 - DNA, 228 bp, Glycine max
  Peptide Sequence Number=SeqID_137521
atggtggcacgggtgatgctcaagcacggatatgagcccggaatgggtctgggcaaggacggcctcgggaatgccgacgtggtcgatattagaggaaacccgtacaaatatgggttgggtgccggaataatgtccgaggaagaggtggcagcagtaggagaggagttccctcaagacccgccaaatttcgtgcaaccatgccatcccgattcccaagtggggaactag

SEQ ID NO: 45837 - DNA, 152 bp, Glycine max
  Peptide Sequence Number=SeqID_137522
atgatgacaaaggtgatgacaaaaagctcaaaggtcaatcaaagaatgaattcaagatgttcaagattcaagaatcaagattcaaggatcaagcttcaagaatcaagatcaagattcaagactcaagattcaagaatcaagagaagacttaa

SEQ ID NO: 45838 - DNA, 207 bp, Glycine max
  Peptide Sequence Number=SeqID_137523
atgactctattttgcacgcgacttcctatcgaatcaaagatcaaacgccaaggttcaaaaaggtctaaggttatgtctcaatggggtcttttatcgtgggaacccaatcttgatatctggggcgaaacaaattcgggtgtcaaggtgtcggtctcgggccgaactcctctatcactccctaaggcacgcgtgacaatgatgatttga

SEQ ID NO: 45839 - DNA, 812 bp, Glycine max
  Peptide Sequence Number=SeqID_137524
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggccagctcctctggagggagagttctggatcaagaaccaatccatgtcctcactgtggctcccccctctggaaggaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45840 - DNA, 309 bp, Glycine max
  Peptide Sequence Number=SeqID_137525
atggtgaaagttggaacctcttacgtgccgatcaacgtctcattttcgccaaaagttggcccagggcttcccgctggcgctaaaggcggatgtgtgcatactggcgattactatgttggcactgataacgcagggtgtcccagtcagaagtgcgttgtggcagagaaaaaagctgcaccggtgctcagtcgaatatgtaatacgactcactatagggcgaattggagctccatccgcggttggcggccgctcagaacttggactcctacctcggtgcggaattcgatgagggagaaggaaatgagttag

SEQ ID NO: 45841 - DNA, 156 bp, Glycine max
  Peptide Sequence Number=SeqID_137526
atgaaaatacataaaaagcttgtaggactaggatcttcttcatcaatggattcctttgcttcttggaagatgaatggcagcggaatggagaaggaagagagagaggagacgccacttcaaggagaagatgagtctagaagaagctcaccaccatag

SEQ ID NO: 45842 - DNA, 777 bp, Glycine max
  Peptide Sequence Number=SeqID_137527
atggaatggcaccagccggatagagtcatgagacaatttggaatgcaacaacctattccgggaccagtaatgcaacccaacaacatacatgacttgacattaaagggaaaggaaggaaaaaattggatgcgactaatgcaacccgcgcttaatgaatggaatagtcgctatgaaaggagagtagagcagacgccgccacaaatagggaccctcggtctgaactctgaatatatgaggtggtacaggcgtaaaacaaaagtttatgtggacccaaaacatgcaagaagaggactattgggtgaaatcgctgaaacactacattttatggtgtcgcctgttgggagaagggtttctacttttgacgatttactgccatgtatcgagaagatcactcttttgtctgaggaagaggataggatacttgaggcacatgaagatgctcccccttctcagccacaatttgaacatcaacagtttaatatactacggcaaagtgtggagactcgaggcttagcgcgacgtcgagaaactgttgatgcagcaacatatagtttgcctccgatgccagaacgacaacatggaatgtattacacaccgccgacattcacccaagaaccgtctcagatgccgccgatgtattcatacccacatgattttcaaccagggtatagttttgcaggcatatttgggtcctctcattcttcaacggaaactccttcatttacccaaagtggtcaagtatcgaccccaaatgcctcacttgctggtccgtggaat

SEQ ID NO: 45843 - DNA, 429 bp, Glycine max
  Peptide Sequence Number=SeqID_137528
gtaaaacagccagagcaagatcaacaacatcagccagcagcagatgcaccactaccacctccacatcagccaccatgcttggagtccatctcaacccacttacagagggtggagcaccatatgcacacatacatgcgtcatttggctgaccagcaggcaacaaatcataggggacaaatgcagttgaatgacaacttctaccattacacactgcaccagcatcaccaggaccctaacccttacccttggcctattctcgagcagtttagagccactattgcaaggcctggtgtcacaacgtgcccttcgcgggcgagcgaaggcgaggctcacgggtgcgctttccaaaggaggaaagatgcgcggagtcgccaccaacgtttatttgtggaaaacgtcgggaaaaccgaaggaaaccggtcaaaatga

SEQ ID NO: 45844 - DNA, 1113 bp, Glycine max
  Peptide Sequence Number=SeqID_137529
atggcaggcgctgcactgcccctgccagcgcggataatccgcaccacattcattacagacaaatgcgcgttttggagctttcgccacgttaacctcttacttttgattcatgctgccggagagaatacagaatacccccatcaggtcagcgtggcggatggtgacttccgcctgttcattgacttttggtttcgcatgataggcaatgccgagacctgccgccttgatcatcggcagatcgttggcgccatcgccaatcgccacggtttgcgccgacggaatttcatatttttccgccagtttacgcagagtattggctttatatttggcgtcgacgatgtcgccgatcacgttgccggtgagcttgccgtccataatttccagctcgttggcgaataccgcgtcgagatgcagcttatcgcgcagatattcggcaaagaaggtaaagccgccggaggcgatggccaccttccagcccagcgtttccagcttcagcaccagttgggtcagccccggcatcagcggcagcgcttcccgcacctgcagcagaatgttcgcgtcggcgtctttcagggtggcgacgcgctggcgcaggctggcggtgaagtcgagctcgccgcgcatcgcgcgttcggtcacttccgagaccagctcgccggtgccggcaagcttagcaatttcatcgatacattcgatctgaatcgccgtggagtccatatccatcaccaacaggcccggcgtgcgcagatgcgggattttgcccagcggcgcgacgtccagcccggcctcgtgggccaggcgcgtggcgcgctgcgtcagcgaacccgccaggcgaatcacctgatagtcttccacgacccaggaagagacaatgaccagcgccgcgccgagctcgcgctgccacgccgtcagccgacgtttatcgagaccgcgaccatacagcagccagccgctgcgcccggcgtgataatccagcggcatgacctcgtcgccgctcagggaaagcggcaacccaggccacaaggaaacatcttcgggcaggtcgcaccaggtcaaactgttaggcattacggctccacatctcttcattcaggcgaggaaaataacgcatga

SEQ ID NO: 45845 - DNA, 153 bp, Glycine max
  Peptide Sequence Number=SeqID_137530
atcgaagtaggcctaaaaagaggcaaatttgattatgctgctttgatgaattctggtgatatgaggcccggggaaaatggagggaataagaaggagggagaaacccatgttgtggctgccattcttgcatggccgaatttcccattagcctaa

SEQ ID NO: 45846 - DNA, 213 bp, Glycine max
  Peptide Sequence Number=SeqID_137531
atgttgttttggctcaaaatttattctataattggtgcctattttataccaatctttgttccaaaatttcaattgaaaattactgtgaaaacaagtgccaaagctagagggaattggaaaggaggattggtggcatcccttgaagaatttgagtcaagaagcaaggggccaaccaccttaagagctattggactaagaaacactccaaattga

SEQ ID NO: 45847 - DNA, 261 bp, Glycine max
  Peptide Sequence Number=SeqID_137532
atgactaggggcaatccaggtgatatacaacccttttatcctgaaatagatagaacctttcatagattagttaggcatagtgtgcatcctggtcattctgtgcattttgagcattttgagcattctgagtattatgttgctggtgattttgaatattttgattttgagcattcgactactaattttcatactgagaacatggctcaacctccacctcgtgagaggactcttagggaaatggctgcacctgatttcacttaa

SEQ ID NO: 45848 - DNA, 705 bp, Glycine max
  Peptide Sequence Number=SeqID_137533
atgcccacgccatcagaagagcacacgtcctcgccttcagagggctacacgccctcgccttcagaagactacatgtcctcagcttcagaaaactacacatcctcgctatcagaggaatacacatacttaccttcagaggactacacgtcctcgccatcagaggatgtgcatgtcatcgcctttagagggctacacgccctcgccttcagaacactacacgccctcgccttgagggctacacgccctctccttcagaggactacggtcctccttcagagggctactacacgtcctcctttcagagggttgcatgccctcgcctttagaggactacatgtcctcttgcatgtcctcgcctttagaggactacacgtcctcgccttcagagggctacacggcctcgcctttagagggctacacggcctccctcataggacgagacgtcctcaccttcataggactacacgccctcgccatcagaggagcacacgtcctcgccttcagaggactacacgtagtcaccttcagagggctagacatcctcgccttcagagcacatccttgccttcagcggactacacgtccttaccttcagaggactacacgtcctcgccttcagagggctgcatagcctcgcctttagaggactacatgtcctcctgcatgtcctcgccttcagagggctacacggccttgcctaaatag

SEQ ID NO: 45849 - DNA, 519 bp, Glycine max
  Peptide Sequence Number=SeqID_137534
atgacttttattcaaagaggatacaacaagatgaagccttgtaaggtctcataccaaaatataaaacaaaaaatgaagtttggtaatcaagaactgcctgtacttacaaacgagtttcactaccctggtagggaagccgtcaacaacaaattcaattgccttattgataatatttggaatattccaaaacatacaaacaataatgagcaatttgtgtgttcagtaaaaaaaggcataatttgtgctttatacaatttctgcatagtagataaccaaggagtccctctccttacaaaagcctccccttttgggaaaggttatacagcttttgtcctgttatcaagaccccataaaggtgtttataccaattttaaagatctttgccttgaaaaggagggtattcaaagcccaatttacaaaggattctattcaagggaagaagcagaaaaagcccttgaactaaataccacagacatcaataaaataaaaaggcccttgagccagaaaacacgactatag

SEQ ID NO: 45850 - DNA, 693 bp, Glycine max
  Peptide Sequence Number=SeqID_137535
atgtggatgacattgctgcttagcaatgtcttgcctagtgattataactccgaccttcctttgccgaagtgtcagctggtgtatgtcatcctgacacggatgagcgtccatgtggctcagttgattgtttacgccatctatttatttgaaggtatgccacccaccaggcaccctctagacctggataagtctaacagggccctggggtttccaacattgatcacggacctctgccagtcattcggggtttccgtcacacctagtaaggtgatccgaccgccgatcacttgggcctttattgagaagtattgcacgcctagacaggcgcagggtgatgcactgcaggccgcagacgcaccgccaccaccgcatcaggctgatcccgttgggtcattaggcatggagcggtatctacagcacttggttcgccaacaggcggccaaccaccgggggcaggtgcagatacatgagtgtctctaccagctcagcctcagtcagcagggccagggtttcgctccttttgcgtgccctactccagatcagtttaaggctgaggttgcatggcccggagattggcccgaggcccaggcaggggaggcgcctgcaggagctcccggcgatgcagaggaggcccgcatggatgaggagatgacagacttgctcggtttcttgggaggaagcggagccacgtga

SEQ ID NO: 45851 - DNA, 1413 bp, Glycine max
  Peptide Sequence Number=SeqID_137536
atgatgcgctacatgcacagcctggagaaaaaggatctggcgctgaatcaggcgatgatcccgctcggctcatgcaccatgaaactgaatgccgccgccgaaatgattccgatcacctggccggaattcgctgaactgcacccgttctgtccggcagagcaggcgagcggttatctgcagatgatcggccagctgtcccagtggctggttcagctcaccgggtacgatgcgctgtgcatgcagccgaactctggtgcgcagggcgaatacgccggtctgctggccatccgtcgctatcatgagagtcgtaatgaagcgggccgcacgatctgtctgatcccgagctcggcgcacggcaccaacccggcgtccgcgcagatggcgggcatggcggtggtggtggtggcctgtgataagcagggcaacatcgatctcggcgatctgcgtgaaaaagcagcgcaggccggtgatgcgctgtcgtgcatcatggtgacctatccgtcgacgcacggcgtctacgaagagaccattcgcgaagtgtgccagatcgtgcatcagtacggcggccaggtgtacctcgacggcgcaaacatgaacgcgcaggtcgggatcaccacgcctggctacattggcgctgacgtgtcgcatctcaacctgcacaaaaccttctgcattccgcacggcggtggcggtccgggcatggggccgatcggggtgaaggcgcatctggcgccattcgtaccgggccacagcgtggtgcagattgacggcgtgctgacccagcagggcgcggtttctgcggcgccgttcggcagcgcatctattctgcccattagctggatgtacattcgcatgatgggtgccgaagggctgaagcaggccagctcggtggcgattctcaacgccaactacatcgccagccggctgcagtcggcgtacccgattctgtacgccggccgcgacggccgcgtggcgcatgagtgcattctcgatattcgtccgctgaaagagcagaccggcatcagcgagctggatatcgcgaaacgcctgatcgactatggtttccatgcgccgaccatgtcgttcccggtcgccggcacgctgatggtcgagccgaccgaatccgagagcaaaatcgagctggaccgctttattgacgcgatgctggcgatccgcatggaaatcgatcgcgtagccgacggtgaatggccggctgacgacaacccgctggtgaatgcaccgcatacccagatggaaatcgtcggcgactggactcatccgtacagccgcgagctggcggtcttcccggccggcagcgccaacaaatactggccgaccgttaagcgtctcgacgatgtgtttggcgatcgcaatgtgttctgttcatgcgttccgatgagcgaataccagtaa

SEQ ID NO: 45852 - DNA, 282 bp, Glycine max
  Peptide Sequence Number=SeqID_137537
ggcttccccggtatcaacagggacaccaggattttatttttttttgcgaaagtgatcttccgtcacagggtgctcccagtggcttctgttttctatcagttgttccctcctgttcagctactggcgggggggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 45853 - DNA, 420 bp, Glycine max
  Peptide Sequence Number=SeqID_137538
atgaagcacttcactgacaccttcatcagtgccaacataacaagatcgaattcctgcagcccgggggatccactagttctagagcggccgccaccgcggtggagctccaattcgccctatagtgagtcgtattacaattcactggccgtcgttttacaacgtcctgactgggaaaaccctggcgttacccaacttaatcgccttgcatcacatccccctttcgccagctggcgtaataacgaacaggcccgcaccgatcgcccttcccaacagttgcgcaccctgaatggcgaatgggaggcgccctgtatcggcgcactaagcgcggcgggtgtggtggttacgcgcaccgtgaccgctacacttgccagcgctgatgtccggcggtgcttttgccgttacgcaccaccccgtccgtag

SEQ ID NO: 45854 - DNA, 474 bp, Glycine max
  Peptide Sequence Number=SeqID_137539
atggttctgaaagaggagttgattgcttgttcaaggtccaaaagaagcttgtctcagcgtctatgcgagacagaaaccaacatgttagctatcatcgccaagtaccaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactctgcccccgaagagattcatgggcttctcggctattggaaaaacaccataactaaacgcgccacaaggcatccctatcgcaccagatccaaatctagaacgatgggtgatcaagaggagacacagggaacagatgaaagccgacatgtcgggctctga

SEQ ID NO: 45855 - DNA, 390 bp, Glycine max
  Peptide Sequence Number=SeqID_137540
atgtcagccagtgatcatgccattctgagggacagaacccatcaacctacaaagaagagcctgttggagctaacatcacacgatgctttgttggcacaaaacaagttgctatctaagaaacttgagatcctaacggaaacacttggttgtaccatgtgtggtgcagctcatgagacaggccaatgcatccccactgaagaaaacactcaagaaattcatttcatagggaatcagcagaggcaagggtatactcaaggaggattttcaggcttccagcaaggtccttataatcagcaaggacagtggaggacacaccttggcaaccaattcaataaagaccagggtggatcctcaaacaggccaattcaacaaggtcctaacatcttttag

SEQ ID NO: 45856 - DNA, 630 bp, Glycine max
  Peptide Sequence Number=SeqID_137541
atgtcggctctgaaagaacaaatggcctccatgatggaggccatgttaggtatgaagcagctcatggagaagaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagaacctcctcagcagcccgacgaagtccataaagaccctcaagattatgctcggagggatgtcgagttttatcccccgattcccgaagggccgacaccaggcacgttgcctcaacccaacctcgcagcatcgccaatagttttgtctatggaagggccgcccccggcaactgaagaaaggaggaagctcgatctccttgaggaaagattgagggctgtggaaggatttggggactatccgtttgcagacatgacggatctttgcttagtacccgatgtgttattcccccgaagtcaaagtgccggacttcgacaagtataa

SEQ ID NO: 45857 - DNA, 815 bp, Glycine max
  Peptide Sequence Number=SeqID_137542
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatggcatgggtttgcgcgcaaaaatttcatatgccttcaggcggcgttcgagcatccattgcggttcttgcttgatggatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45858 - DNA, 555 bp, Glycine max
  Peptide Sequence Number=SeqID_137543
atgacatgcggagacaaaatttggtcattccgcacccctttgccatttagacacagtcgtgcccgatggcacgcagagacaaaatttggtcattctgcaccctttgtcatccagaggcggcgggcccgatatgacactggagacaaaatttggtcattccgcacccctttgccattcagacacagtcgtgtccgatggtacgcagagactaaatttgacacagtcgtgtccgatggcacgcagagacaaaatttggtcattctgcaccctttgtcatccagaggcggcgggcccgatgacacgcggagacaaaatttggtcattctgcacccctttgccattcagacacagtcgtgtccgatggcacgcagagacaaaatttggtcattctgcaccctttgtcatccagaggcagcgggcccgatgacacgcggagacaaaatttggtcattccgcacccctttgccattcagacacagtcgtgtccgatggtacgcagagacaacatttggtcattctgtaccctttgtcatccagaggcggtgggcccgataa

SEQ ID NO: 45859 - DNA, 421 bp, Glycine max
  Peptide Sequence Number=SeqID_137544
atgatgagcatgaagaagataatggaagccaatgcggttgcagttgccgctaccagcattgtagctaaggtgaacccgatgcccccatctggcctcaaccaaatgaatcatccaacctctgctatgggaaggcaaagatttgggaagtacgagcgggcccctattatgtgcaaattccaaataaagcacacctttccccccatatgggcttgcctcccaactatacaccacccaatggggcatacactccccagtgaggatgtcaataattctgctcccatactcattgaaagccgacaacctcaaattgatcatgcacatgtctctcaacccatgggggagacatatgaaataccccaccataatctagccgacttcgagccttgcctcagatatgccactgaagggaaagcagttggtg

SEQ ID NO: 45860 - DNA, 304 bp, Glycine max
  Peptide Sequence Number=SeqID_137545
ttggaacctcttacgtgccgatcaacgtctcattttcgccaaaaagttgggcccagggcttcccggtatcaacagggacaccaggatttattttattttgcgaaagtgatcttcccgtcacagctgtccctcctgttccagctactgacgggggtgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtt

SEQ ID NO: 45861 - DNA, 369 bp, Glycine max
  Peptide Sequence Number=SeqID_137546
atgatgaagacaaggatgatcaagatgacacaacacaagaaaatgataatcttcccaaagaatggaaaacttcaagaaatcatcctcttgacaacatcatcggtgatatctcaaaaggggaggaggtatatgtggaacaacctcctgggtttgaagactcacaaaaaccagatcatgtctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtttttacgcacggggaaggtattag

SEQ ID NO: 45862 - DNA, 405 bp, Glycine max
  Peptide Sequence Number=SeqID_137547
atggttatgggggattccatcagcagactctccttccccgcatgtttgcattttagtggagaaaacaccgagactttttcaagtctcacaagttatccagaactacgtaggtctgagttcctcattggaggatacgtaggagcaagagcctcgcttttgtcgaccacaccgccttttgttgccataactcaagagccggtgatacgcggagataccttacggttatccgccccccctttgccattcagacacagtcgtgttcgatggcaagcagagaccaagtttggtcattctgcacacatgatacgcggagataccttacggttatccgcccccctttgccattcagacacagtcgtgttcgatggcaagcagagaccaagtttggtcattctgcacacatga

SEQ ID NO: 45863 - DNA, 189 bp, Glycine max
  Peptide Sequence Number=SeqID_137548
atggagaagtctgaaaagaaaaatatcaatgaaaagaaattgaagaaagcatacattacatgggatgaaaacgatatggaatcttctgaagattcagaaaatgaagaaataaacctctgctttatggctaaaagttatgaaagtgatgaagaggaaaacaaagacatgtctctaataaggctggactag

SEQ ID NO: 45864 - DNA, 279 bp, Glycine max
  Peptide Sequence Number=SeqID_137549
atgcaggaacaatacgtccattacgatgccatgaagagatgcttatgcgatgcatggcatgaatgcatttacggacacaagagcccggaaaatcatctcttcttacttgcgcattcgggggcacagtgccccatgtgtgcacttaagaaggtgatatggaccttccggcttcctgtgacaaaagacgagaccaacatacaacgcatgtgtgatgacatgatgcagacgcgcaaaagcacaacacggggatgtacacagaatggcaatatccacaaataa

SEQ ID NO: 45865 - DNA, 318 bp, Glycine max
  Peptide Sequence Number=SeqID_137550
atggctactcagttgaaccaagctcaatcccaaaattctgacaatttgccttcacaaactgtgcagaatcgaaaaaatgtgagtgccatcaccttgagatctggcaaccaaattcaagtgcctccaccagtagcagcacctgcacctgaacctgtcaagcttcattctacacctgaaaaagaggatgagatagttgcacaaaagagaaagcttcctaactgtcgcaacctacccttcggcgggagggcgacgcgtgactcgcgggaggcgtgttccacgaaaggaatacgcgcggagtcgccaccaacgtttatttga

SEQ ID NO: 45866 - DNA, 201 bp, Glycine max
  Peptide Sequence Number=SeqID_137551
atgatgacaaaggtgatgaacaaaaagctcaaaagatcaaagaacaactcaagtgaatcaagaacaagtcaagagttcaagaatcaagaagaattcaagactcaagaagaaagtctacaatcaagaatcaagattcaagattcaagatctcaagaatcaagatcaagattcaagaatgaagaaaagactcaatcaagataa

SEQ ID NO: 45867 - DNA, 258 bp, Glycine max
  Peptide Sequence Number=SeqID_137552
atggaggagtttaatgcacaggtggcctggccaggagcccagtcttctccttctggagggggtatacacatggctcaggaggaggatgcttctacagaccagatcccagagccatccccagtacccatacctgatgatgccacaccatctgcaccagcacctgagttagagcagcctatctctcaggattcaccagttgctcaggtgttggaccttaatgagcatgcacaggagcaaccacaggagcaagacatttaa

SEQ ID NO: 45868 - DNA, 228 bp, Glycine max
  Peptide Sequence Number=SeqID_137553
atgggttttcgtttacctggcattagaaagacaccaaaagcggtggattcaccaaaaggctatcttgttgtctatgtcagagagaaaataaagcaggttgtgattcctgtatcatacttgaaccaatcttcattccaggacttgttgagtcaagcgaagagtttggatatgatcatcacaagggtggcctcacaattccttgcagtgatgatgtcttccaacatataa

SEQ ID NO: 45869 - DNA, 391 bp, Glycine max
  Peptide Sequence Number=SeqID_137554
gttttatcaagtcaagattaagggcctagatatcaccaacattaaggagttggggcagttgatgggacctctccaaatgcaagccttccgcaaggcgtacggaaagatcttagatttgaccatagcagagatatccacagaagccattgtatcactcacccaatactatgaccagcccttgagatgcttcacgtttggagacttccaattagtaccgactgttgatgaatttgaggagattctaggatgtcctcttgggggaaggaaaccttctttttccggcaaactcgaaattggcattggagtgaaggcctaccactgggaagcacttagaaggcaaggcaagggatatggatcaagaggagtgggtcccattgtatggacgtattag

SEQ ID NO: 45870 - DNA, 797 bp, Glycine max
  Peptide Sequence Number=SeqID_137555
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagctccatcccatgctagggtccaaaaggagttggtgaatgggcagtgggcagctgaaagaacagtcgagggactgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45871 - DNA, 252 bp, Glycine max
  Peptide Sequence Number=SeqID_137556
atgaaaacgagaataaaaatacatgaaacaaaatgtggacccccacggcaaaataggggaggagcttgccacccagctcgcccaggcgagcaaggttgcttcctccagaagcaaccgccttatggaggaagaaactggaaggcccaactttcgaagaagttacggaaactcacggattgcgcaaaaacacctcttttcaatttccgtcacattacggaatttcacggatcgcgtaagcctgcttccttttga

SEQ ID NO: 45872 - DNA, 222 bp, Glycine max
  Peptide Sequence Number=SeqID_137557
atgttgctaagtagcaacatcagtgagatctgtgtaaaagtggtcatgttggtgcgcatgatccgcactcatctctttgcagtggcacgggtgaaatcttgccccggtatgcatagtagctacgtgatagcctccctctctagttgtgctcgcacagttggtcgtccttcaatatcagggggtggcccaggaactaataaaagggaactactggccacttaa

SEQ ID NO: 45873 - DNA, 429 bp, Glycine max
  Peptide Sequence Number=SeqID_137558
atgatggtggcccgggtgatatttgggcaagaacaacggcggaaggaccagcttgaaagaaagaacaaaggccaaggcccgtggttgggacaacgagccaaagaggctccatcatgccacatcagtaggagcttcgtaagtgcgggtttaagacgtgaaggacaaatcgccgcaatatgcgatgatgactccccaaggagatcggatttggtacagccattccctcctggtttccaactaggaaattggcgggtggaggaacgcccagatgtttacgcgacaagcataagatccaacgacgagtcccgcgaagatactaatatcggggacccgaccatcgatttcgagcaagaagcaagtcggatggaggatgaggaggatgaggatgtagggcttcccccagagctagagaggataatcgctcaggag

SEQ ID NO: 45874 - DNA, 345 bp, Glycine max
  Peptide Sequence Number=SeqID_137559
atggcagaagaccacccacagaggatgacgctagaggactactctagctttgctacacctcagtacttgaccagcatagccagactagatgtgcaagcggccaacatttcatatccacattccctcatccagctaattcaagggaatatatttcatgcgaaaagatggcttcactcattcaaggggaatagcctgtggacgtgggaagagatggtggagaagttcctgaagaagtacttcccgaagtccaagaccgctgaggggaaggtggaaatctcatttaatcatgtagaagaaaatacaaataataattcaatcatgctcaacaaaagtgttcataagtaa

SEQ ID NO: 45875 - DNA, 321 bp, Glycine max
  Peptide Sequence Number=SeqID_137560
atgatcgttcaatattttgatcaagaatacaaaaggataccaaagaaaggggcaaaaggctcgcccaaggtggcatctagctcgcctgggccaccaaatagcttcatggtgaagaaaccagcttgcctgggcgagctcactgcttcagggttaagtttcagctcacctggttttgaaggctcagaagtggagagaattgagagaagagagaaagaagaagaagaaagaagaggaaatgaagccaaggcgttgccgaatcacaactgtgatcaatctctatgttgtttcttgttcggtgctcttcgtgcgaccgtcggttag

SEQ ID NO: 45876 - DNA, 270 bp, Glycine max
  Peptide Sequence Number=SeqID_137561
atggcagaagcacagtctatttcttcccctatgactgctaattgcaagttaaccaaagctggctcggatttattcaataatccatctctctataggtctgttgttggcgctctccaatacacaaccattacaaggtctgagcttgggaacaagaccccagagatttactgtgacaaccaaagtgcagtagctatcactcattttccagttcttcatttctggactaagcacatggaaattgacatctttttgtcagggagaaagtcttag

SEQ ID NO: 45877 - DNA, 561 bp, Glycine max
  Peptide Sequence Number=SeqID_137562
atgtatgaatatcctaggagaacccgctcattaacgtgtaagcattcctttcaaaattcatatggatgttcatgctttgttggaaaaagggaaatgactccgaagaaactctccacgaagaggtctaaaagagacgctacagtggaagggtccagtgccacccccgagtttgatagtcatcgtttcccgagcgccgagcaccagcagcgcttcgaggccatcaaaggatggtcgttccacagagagaagcgtgtccagctcagggaggatgagtatacggactttcaggaggagatagctcgtagacgttggacgttgctggtgactcccatggctaagtttgaccctgagatagtcctggagttctatgctaatgcttggcccaccgaggaaggagtgcgagacatgcattcatgggtgaggggtcagtggattccctttgacgcagatgccctcagccagttcctgggtgacccactagttttggaggaaggccagcaatgtgagttcagccagaggaggaacagggtcgacgggttcgacgaggaggtcattgcttag

SEQ ID NO: 45878 - DNA, 549 bp, Glycine max
  Peptide Sequence Number=SeqID_137563
atgacgcctaccaagcaccctctggacccagataagtccaacagggccctgggatttcccgccttgatcacaggactctgccagtcgttcggcgtccccgtcacacctagcaaggtgattcggccgcccatcacccgagcttttattgagaagtactgcacgcagagacaggtccagggtgatgcaccacaggccgcggacgcgccgccacctcatcaggctggtccagccggattgtttgatacagagcagtatttgcggtatttggttcgccagcaggcggccaaccactgggcacatgtacagactcatgattgtctttatcagatgagtctcagcctgcagagccagggctttacttctttttcgtgccctactccagaccagttcagggcagaggtcgcatggcttggagattggcctgaggcccaggcaggagaggcaccagtaggggcaccagcagaggctcccgacgaggcagatgaggcccgcgaggacgaagagatgaccgatttacttgatttcttgggagggagcggtgccacatga

SEQ ID NO: 45879 - DNA, 467 bp, Glycine max
  Peptide Sequence Number=SeqID_137564
atgggaacaaatcaatctggcaaaaggttttatcaagtcaagattaagggcctagatatcaccagtattaaggagttggggcggttgatgggacctctccgaatgcaagccttccgcaaggcgtacggaaagatcttagatttgaccatagcagagatatccacagaagccattgtatcactcgcccaatactatgaccagcccttgagatgcttcgcgtttggagacttccaattagtaccgactgttgaagaatttgaggagattctaggatgtcctcttaggggaaggaaaccgtatcttttctccgggttttttccctccttgagcaaggttacagttgtggtcagggattcagcgagaggattggatcgcgtaaagcaaactcggaatgacatagtgggtttaccacggaagtacttagaagacaaggcgagggatatggcgaatcaagaggagtgggtccc

SEQ ID NO: 45880 - DNA, 264 bp, Glycine max
  Peptide Sequence Number=SeqID_137565
atggtagtttttaataaattaaggaggtttctaaaacctccgcaaaataacttccattatttaacattttttttttgtagtgaagagtgtcccaagtatgccgcatggcatgtgaagaaagatacttggtgggtagattctggtgctactactcacataagcatgactatgcagggttgcctgtggagccaaccgccaagtgatgatgaaaggttcatctttgtaggtgattgcaagaagatggaatttgatttctatttctag

SEQ ID NO: 45881 - DNA, 401 bp, Glycine max
  Peptide Sequence Number=SeqID_137566
atggcgacaattttcccctgcaaatccagcgtggtcagctgtggccagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45882 - DNA, 357 bp, Glycine max
  Peptide Sequence Number=SeqID_137567
atggagaggatagccaaagtggtcaaaatctcggcacaagaattggaccgggtaaaacaaaatagaaatggagtgatcagaataccaaggaagcacttggaagagaaagcgaaggctttggcggatcaaggtgaatgggcttcgttcattaatgtcttagcgctactggtgttcagagtcgtcctctttccgaatgtggatgggctagtggatctagcggcaattgacaccttccttgcttatcaccacagcaaggaaagtccgatcgttgctgttttggccgatgcctatgacacatttgaccgaagatgcgagaagagcggcgcaaggattgtttgttgcacacccgctctttat

SEQ ID NO: 45883 - DNA, 117 bp, Glycine max
  Peptide Sequence Number=SeqID_137568
atgggacatcttagggttcccatgaaccctaagagaataaaggtcattcctgagtggcccgctccaccaagtgtgttaagggaaggagcccagagtatcaagaacctcaggatttga

SEQ ID NO: 45884 - DNA, 830 bp, Glycine max
  Peptide Sequence Number=SeqID_137569
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcatttacatccactttatgccattctctctcccactggctttgtccattctccagtgaacaactctgttactagtctctgggctttagaagctggttcaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45885 - DNA, 91 bp, Glycine max
  Peptide Sequence Number=SeqID_137570
ttgccaagatgttgaggattgtgatatgatggaacaaaaagaaactcacctcgagggaaagaagcaagtgacttgccacaagaacctttaa

SEQ ID NO: 45886 - DNA, 480 bp, Glycine max
  Peptide Sequence Number=SeqID_137571
atgaccatgattacgccaagctcgaaattaaccctcactaaagggaacaaaagctgcaacatctttctcaagggccagcaaagcaggcctatccgaggacactcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 45887 - DNA, 354 bp, Glycine max
  Peptide Sequence Number=SeqID_137572
atgttgtacttgggatgtgatccaattccaaaagctgttgagaatgaggatgatttagatgatgtacctgttgctggccatgaggaagatgttggtgctggtgagcatgttagtgctggagagcagagagatgctggagagcagagggatgctagtgagcagagggatgctgatgctggtgagccgagagatggtggtgagcagaggagagggatactgatgctggtgagcaaagagatggtagtgagcagagggatgctgatgctagtgagcagagagatgccggtggtgaagagagagatgttgctgatagtaagaaggaaaaggaagttgacagtgatgagtggtttataa

SEQ ID NO: 45888 - DNA, 648 bp, Glycine max
  Peptide Sequence Number=SeqID_137573
atggcacgcaaagacaaaatttggtcattctgcacccttttgtcatccagaggcggcgggcccgatgacacgcagggacaaaatttggtcattccgcacccctttgccattcagacacagccgtgtccgatggcacgcagagacaaaatttggtcattctgcatccttttgtcatccagaggcggcgggcccgatgacacacgaagacaaaatttggtcattccgcacccctttgccattcagacacagcggtgtccgatggcacgcagagacaaaatttggtcattctgcatccttttgtcatccagaggcggcgggcccgatgacacgcagagacaaaatttggtcattccgcacccctttgccattcagacacagtcgtgtccgatggcacgcagagacaaaatttggtcattctgcacccttttgtcatccagaggcagcgggcccgatgacacgcggagacaccttatggttatccgcacccttttgtcatccagaggcggcgggcccgatgacaagcagaggccaatgtggtcattctgcaccctttcgtcaatcgtggccgacaagcccgttgacacgcggagatttacatcatcttccacacttacaagatctgtcatactgacttttgagtcatgctga

SEQ ID NO: 45889 - DNA, 471 bp, Glycine max
  Peptide Sequence Number=SeqID_137574
atggattccctcatcactagacttctccgcgtgcctcatttattgaaggatgagaaccctactgatggagtggagatgtcatccatggttgcgtctcgagggagaggaagcggccgcaacagtagaggagatcgcagtggaaggggtggacgtcctcattgcacctattgcaagaggataggtcacacccaagagacttgctattcattacatgggtttcctgacaaggtcgcacaagtttctaaattagagaaagcagagaccagattctctgatgaggagtatcaggagtatttgaagctcaaatccgagaagcccagcaatcaagcacaaccctcgtccgtaccatgtttttcagcagcatgtatctctcaatccattaaaggtcacagcccttggatactcgactcaggtgcctctgatcatatttctggaacatgtgacagggcgactgattggagaaggacatga

SEQ ID NO: 45890 - DNA, 330 bp, Glycine max
  Peptide Sequence Number=SeqID_137575
atggctccatatgaagctctatatgcaaggagatgtagaactccattatgttggtttaagactagagaaacttttgatgcaatcctccctaggaagggaccagttaccagagccatgagcaagaggctccaaaaggattgggctagagctactgaagaaggccctagggttctcatgaacctcaggtggcgtctccaatcatctttctccttctccattccactgccattaatcttcaagaagcaaaggactccattgatgaagaagatcccaggcttacaagctccacaaggagctacatcatgtggtatcaagagcatcttcatctag

SEQ ID NO: 45891 - DNA, 552 bp, Glycine max
  Peptide Sequence Number=SeqID_137576
atgactcttgcaactctttttggaaagcttcaggaacatgaaatagaacttatgagactaaatcaacatgaagaaaatgacaagaaaaagaaaggaactgcacttcaagcttcatcttctattcaagaagaaagtgacaaagaggacttgaatgaaatagaagaagatgagaaacaaaggaaattaaaggagatcaaacttcaatcaaagaagaaaggagaagattcctccttagttctgaaatgcaatgaatgcgatcaacccgggcacttgagatttaattgtcttgtctttaaaagaagaatggaaaaatccgacaagaaaaatttcaaagataagaaagaaaataaagcatacatcacttgggaagataatgacatggattcatcaagtgattcagaaaatgaaatcataaatctgggcctcatgaccaaagactatgaaagcgaagaagaggtaatgtcttctaactatgacttatctatttcttttgatgaacttcaagtgcattcagtgtcttgcataaagaatctatcaaacttgccaaattag

SEQ ID NO: 45892 - DNA, 600 bp, Glycine max
  Peptide Sequence Number=SeqID_137577
atgacggaggtgttgacgtcaacgaaggtgatgccaggcgcaaccatggccgaagatgcgaccatggttggaggtgttgacgccaacaccgcagggaacatgaagggcgtgatgttgacacatcgtaacctaacaacattagccacgagatacgacgtcgttaggggtggtggttatgtcgaacacgatggtgcccaaagagagggatacggtttaactgagtctgcagttacccgaaccactccagaggaggcaaatcaggtgggagcaacaggtaaactgataccaaatatagaagccaaaattgtgaacccagaaacaggggaagccatgtttcccggtgaacaaggagaactctggatcagaggaccttatgttatgaaaggttattctggtgacccaaaagcaacttcagcaactttggtggatgggtggttaaggactggggacctctgttattttgatagcaaaggtttcttgtatgttgtagataggttgaaagagttgattaaatacaagggctaccaggttgctccggcagagctagaagagttactcctatctcattcagagataaatgatgctgcagttattccgtaa

SEQ ID NO: 45893 - DNA, 213 bp, Glycine max
  Peptide Sequence Number=SeqID_137578
gctcatgagaacccaagggtcttctcttgcatctctggaacaattcaagaggaaaagttgaagaacacttcaagattcaagaagaaggatgaattcaagaatcaagattcaaggatcaagattcaaggatcaagattcaagaatcaagatcaagattcaagaatcaagatcaagattcaagattcaagactcaagaatcaagagaagacttaa

SEQ ID NO: 45894 - DNA, 243 bp, Glycine max
  Peptide Sequence Number=SeqID_137579
atgaactgcattttctatgttctttctggaaaatgcgatgaactcgctaagcgagcatgttgcgctatgcgaatggcctctaggaaatgtaagagcatgggggcaaggccaactgctcagtatgatactagacggttccattcgcttgatgcttggaaccgttatacagataatgtcttggggaggagtattttgccagagaggaaggttgatatataccacacagagttcgatgacttctag

SEQ ID NO: 45895 - DNA, 816 bp, Glycine max
  Peptide Sequence Number=SeqID_137580
atggcagctatacaaatgaccagccttgtctctatgacgtgttgggcctgtttaagtctgcctctgattcaagtgctttatgcccctagttgtcaaagtattttctgttctaactggagtagagggttgtctacctccaatctagaaggacagtgtccaacttgctgttttagagggcactattgcaagactgcttccaacttaccctactgctgggcatccagttccttgacaatcgtagaagaagggtcattcagcaccatttgcaatccttatgtcgaattggcaaatagttatggcactggcaaaattgcagaactagaggcatatgtcaaggcaaacgcagaaaagtttgaatctgacaacaaccttggactggttaagcaggttgtatcatccatgtataagcggaacattcagagattgacccagacatacttgaccctttctctccaagatatagccaacacagtgcagttaaatagccccaaagaagctgaaatgcatgtgctacaaatggtgattcaggatggcgagatatacgcaactatcaaccagaaggacggaatggttagattcttggaggatcctgaacagtataaaacctgtgaaatgattgaacatattgattcatcaattcaaagaataatggctctctcaaggaaacttactgcaacggatgaacaaatttcatgtgatcagttgtatttgtctaagggcgtgaatcttgcagcattggcaattgatggaacatttgtgaagggtggggagggagaaattgcaatatcatcatgcggtgtgctagataaccattga

SEQ ID NO: 45896 - DNA, 474 bp, Glycine max
  Peptide Sequence Number=SeqID_137581
atggtgctgaatgacccttcttctacgattgtcaaggaactggatgcccagcagacaaggcagcttcttaggaaggtggtactgataacaatctggatccaactaccctaccagaccaagattcatttagctcagtggctaccaaagctgggtgatgaggacacaactaagggtaaggaccatgaagcacttgaagggcccatgaccagagacagacttaaaaaggtccaacacagtgatgaggacacaactaagggcaaggaccataaagcacttgaatcagaggcagacttaaacaggcccaacacggttcctgttgaaccaaattctgacttatcaaggttgattccttgtggtgtcactgtgacttatcttccatctctggaagtggcgtccctctccgtcaacattcctgtatcaaacgttctatcccgtaaggttcacgtcatctggtatcaaagcttcggctcttga

SEQ ID NO: 45897 - DNA, 327 bp, Glycine max
  Peptide Sequence Number=SeqID_137582
atgaccagagacagacttaaaaaggcccaacacagtgatgaggacataactaagggcaaggaccatgaagcacttgaagaacccatgaccagaggcagacttaaacaggcccaacacgtcatagagacaaggctgaaagcttatctcagggttcctgttgaaccaaattctgacttatcaaggttgattccttgtggcgtcaccgtgacttatcttccatctctggaagtggcgtctctctccgtcaacatttctgtatcaaacgttctgccccgtaaggttcacgtcagaaggggatacagaaggggtgtggggagcaggagttag

SEQ ID NO: 45898 - DNA, 369 bp, Glycine max
  Peptide Sequence Number=SeqID_137583
atgactgaaagtttgactattctagtcatgatgctcggcgtatggttttccttaccggtcgtcagatcgactgggctcacttggttagtaacttcatttggttaccataaggatcatgatggacaatggctgaagaaggacgtgttacctccacaagacgagcgtactccctctcctcctcctcaacaagatgattcctcagcccttatgaatgaagttctttcagaattacggggccttcgcacctatgttggcgaacgctttgtttccttagatggtcactttgaaggaatggatacccgcatcacccagcttgaagaggatgtgagttatcttcgtcgatgctttgaccttccaccaccttcctag

SEQ ID NO: 45899 - DNA, 328 bp, Glycine max
  Peptide Sequence Number=SeqID_137584
atggataagcgttctagagtgtggggccaatggattccctatgacacagatgctatcaaccaattcttagggcatccattgatcttagaagaggaacagcattgcacctcctacaaactcagtgcactcagaaaagtcccacagagcaccaggatttcctacattgattataggcattttagagccattgttgcatggcctagagacaggcctaattttcaggatgaggtaggacctgtagatgctcaaggagctacccaaggagacgaaggtggagctgaggatgatggagaaatggtagatttgcttgattactttattggaggag

SEQ ID NO: 45900 - DNA, 498 bp, Glycine max
  Peptide Sequence Number=SeqID_137585
atggcattgcaacactcatcctctgttgaggtgttagatatacaagtattagctgcacatgtgagcaccaaggggagttgtaatgaagctactgcaaatccattaggtgaagagccttctactgttgatgtggctactatgggcttgtacatagtaggtgatcagtgtacatgcctagtggccttgggaaaagtgtatgatagtgcgaccaccatacacaatgtcccttatgcagatgatgtggttagggtcaatgttacaatagtttatgacggtgacgctcaggcccttcacacattcacacatcctgtggaacctacatttgatgaggattcacacaattgtgtgccgaaaccggttgcaactgttgaaaggtccaatgcagttgctggggttgacccattgggagaattgattaagaacttgtttgatgtttgccaaaagcttattgagttgtcgtgggatgggatgaaattttggattcttaatctacaataa

SEQ ID NO: 45901 - DNA, 228 bp, Glycine max
  Peptide Sequence Number=SeqID_137586
atgactggagtaggtcatggtgcaatgtacggtttctttgagtctcaatcaattcacaatgcaaaggataggcatcatgaatgtcaaccttacattgaaacatgggtgaaggaatcagaacgagagttgtggacttcagggcacattggcaacttcttgttgtgtatccatgggacaatgttgttgtttggttttgctctttgttgcaaagaagaccttaaccactag

SEQ ID NO: 45902 - DNA, 642 bp, Glycine max
  Peptide Sequence Number=SeqID_137587
atgccaaggagatgtgggatactctccaacttacacatgaaggcaccattaatgatgaaccctaatgaaaacattcatagcatgcagaaaagatttacacatatagttaaccatcttgtctctttaggaagaatcttccctaatgaagatttaattaataaagttttaagatgcttaagtagggaatggaagcccaaggaacatgaaatggaactccaacgtcttaatcaaaatgaagaaaccgacaaaaagaagagaaattcagatgatgaagaagacttctcactctttgtgaagaagttccagaaatttgtcaagagaagaagaataaagaggcgtaagaactttaacaatggaagaagaataaagaggcgtaagaactttaacaatggaagaagatcacaagaagactctcaagtttttagatgttacaaatgcaaccaactttgtcacatcaaagctaattgtccttcaaaggaagaatggcctgagaaaagtgataagaaaaggtatgacgaaagaaggaccaagaaggcctacattgcatgggatgacaatgattcatcagatggctcagaaaaggaaatcaaccttctaaccaagaattatgagagtgaagagaacatttctcaagaaggttga

SEQ ID NO: 45903 - DNA, 255 bp, Glycine max
  Peptide Sequence Number=SeqID_137588
atggtgttttgcgagaatgctccaaccatatgggatcaacatagacttaaaggagcactcaaaccgggtgacccccaaggcctacactctgaagagtctgtcagggcctctccctccagattcagcattaactcgtcgcccttaaaaggacttaacattaactcattgcccttaaagggtcttagcattaactcgtcacccttaaagggacttagcattaactcgtcgcccttaaagggtcttacaattgtgtga

SEQ ID NO: 45904 - DNA, 318 bp, Glycine max
  Peptide Sequence Number=SeqID_137589
atgaatgcttctagtcctagtcaagctaaagaacaagatgatgataccaaacctttatggacctatgttacaaagataaaaagtgtaagtggtggtggaaattatgaaataaaatacaatatttgtgattttacctttaatgggccttacactagagtgagggcacacttgttgaagatgactggaaagggagttagagtttgtcaaaaggtaacaattgacagacttatagatttgaagaagatagacaatgatgcaacattgagggtggagaagtcaaaaacaaaatctatgtcattgcctccggtttctacttaa

SEQ ID NO: 45905 - DNA, 411 bp, Glycine max
  Peptide Sequence Number=SeqID_137590
atgactacaagagattttgatgatgccaacagtcaagtgttcttcgtggataattcaactccctttgctgctattaaccggttcttctttcgaaactctgccaacttcagtgttttaaaggctcttggactcttcggcttccgaaggctctctcagcgagcatggctcgctgagcgagagttagtgaattttcgcttagcaagaatgggcgcgctgagcgcgagaagagaccacgacctcgctgggcgggctggctgtgggctggatgtgcagatctctgaattatcctcttctaggatttcttatccgctaagtgagctagatgtctcgctaagtggatgcatctcgctgagcggatctgcctcactaagtgagtcatcaacagctttaaccttttcttctttagcctaa

SEQ ID NO: 45906 - DNA, 534 bp, Glycine max
  Peptide Sequence Number=SeqID_137591
atgaatgataaggtggctccagatcttcattgggcatggtgtcaggatagaaggtgttgggatgtgaagggatgtggaagcaagactacaagagattttgatgatgccaacagtcaattaacacaattatccagtcaaggtgtaccttttgagggcaccattgttgatgactggaaatttgatttttcaagtcatgatgcccgccgaatggtctgcactaaccaggcggaaatgaccgatagattgcttgccggttcattgaattttgaatgtcgcatcatgcattatcttattgtgcatattcttcttccccggtcatctaatcttgctcaggtctttgaggaggacctgatagtcatgtggacgttcttaaccggtcgtcagctcgattgggcccatctcttggtcactttatttcatcaccatttcaatgttcctcttgagtctgaacccttcattcaagtgaaacattccttcgctattggtgctggcgtggtcacctattttggctaccgtcaagacagagatggttaa

SEQ ID NO: 45907 - DNA, 427 bp, Glycine max
  Peptide Sequence Number=SeqID_137592
atgactggtggaggtgttggaagaatcagaaagctgcaagaaatggctataaccgaaatgggggcgagccctggtgcagcggtaaagttgtgccttggtgacttgttggtcatgggttcgaatccggaaacagcctctttgcatatgcaaggtgggtacgcacctcaggttgggttagcagaacactttaaggtaaaattttgggaggatctagaaggggtacttcaggatataccccaaggagagaaagttttcctaggaggggatctcaatggacatgtaggtagcgtggctagaggttttgagggggtgcatgggggttttggcctaggggagatgaatggggagggtaaatccatcttggagttttcggaggctttggatcttggagaggaacatcttatcacttacaaaagtggagggacat

SEQ ID NO: 45908 - DNA, 654 bp, Glycine max
  Peptide Sequence Number=SeqID_137593
atggagcctaactgtcatgatatacaaatgcctgacaggtcttccttaaacaaagaaaatgatttgaccacttatggaacttttgtggacgtggaccctcttcataacattgagaaccttgttaactgggtatgggttcgggttcaggtttttcccgataaccaaaagtcggctacgggtacagtgtccgctaagcgcaacactcatgggctaagcgcgaggaagactctggaagaagatgagttgtacagtggaaactggtctgactctaaagtccttgagagtacagggctaagctgtcatactatcatgaggaatcggggacggggtcggggatacccgataccttatgggtacggggatgggataataaactttaacccgtcgagtatcgggtacgggtatagggatatgttggggagtcaggggagtgtgctgagtgggggagggagtgttccagaaataaatgcatctgctgagacttggatccaaatggtgaatgggatccaaatggtgaatgggatccaaaatggatctttgtctacatgccttgggattcgaatgatttgtggaatagatgttgttcatggtcacaataatgtctacaaggcaaccatttttcctcacaatgtttggctaggagttaccaggcaa

SEQ ID NO: 45909 - DNA, 702 bp, Glycine max
  Peptide Sequence Number=SeqID_137594
atgatcacgctggatgacgtggcgtcactcctacacgttcccatcactggcgcgctgcataagtttgagccgctagttacttcagacacgattggtctactgatagagcttcttgaggtcagtcatgaggaggctacatttgagacccgacaggctggtgggcctcatgtccggttggggtggcttcgggacttgtatgagagccagtgcagggccagacgatgggttgcaacagtccgcacgtatctgctccacttggtgggttgtactcttttcgccaagagttcaacccatgtacatgtcgtgcacctagaggctttcagggacctggcccaggtagggggattcgcctgggaagcgactgcattagtccacatgtatgagcatctgaacgacgcgtcgcatgcctctacacgtgctggatatacgagcactttcctacagtgcatacatgtgtcattcatgatgcttatgatgaggagagcccacgggcctacaggtggcttacgggtggcgccagactacatagagtgggttttcggatttcgcacccgttcgtcacctggaccgaggagactgctgagccaagacatccgcctccccctcatgatgaggagttcgttgagccacccatccctgaggtttcagtcgcgtccgatctccctacgcattcagtggttgactgcgaaggatgtcaggtga

SEQ ID NO: 45910 - DNA, 915 bp, Glycine max
  Peptide Sequence Number=SeqID_137595
atgtaccatgcggaagaagcttccgcaagttcttccgcgataacaaaatatagcctatggaagaagatcacgcggaagatcctacaaaaccttcttccgttggatcacgcggaagatcctgtagaagcttcttccgtaggaatccgcggaagaaccttccacacttcttccgcggaagaacaccttcttccgctacagttcccagaagcccctttcatacgtgaggaagaatgttcttcttgcggtagaaccttcgtcttcaacctccagcaccataggacacgaacaacagcttcaatggaggatgtcaactttagaaggaaacaacaacttcaaatgaagggaaccaaatttcaaatggagaaggaaatgagggcgcggaggaagaagggcaatatcggggaagaagaagcacgaatggagattgctgggtgcatggggaagaaacaagcacggaagcaaggggaagaagaaagagaaaggctccaagctagtgttgtaagcccttctcaaactccccctgcacatgagaataatgaagaagaagctacagtggggaatgaggaagaaagtgttgcagaccattgtaaccagttctctggagagattctggcaagccttcggtttgagcaacactacctagagaaacaaaaggagggttgttacacactaagtgacctcttgatgcttcctaaggatatgttgttaagtgcatccataaggaatgagaagattctagacaacattgtctcggatgagctttgccctgatcctgttccctctaatgtttttgaagctttggactcagagccttacccttgcatatgcaaagaggctgtttccggattcaaacccatgaccaacaagtcaccaaggcacaactttaccactgcaccagggctcggcctcatatga

SEQ ID NO: 45911 - DNA, 594 bp, Glycine max
  Peptide Sequence Number=SeqID_137596
atggattttgttttaggtttgccttggacaaggaatggtaaggactctatttttgttgtggttgacaggaagtggtctgtctccatggactaccaagaagcatcgtttcagatcgagacaccaagtttcttagtcacttttggagaacattgtgggggtaaggttggaataaaactgcttttttccaccacatgccatcctcaaaccgatggccaaactaaggtgaaggctcaaattgcaaagaagaatgaaagctatcccaagaaagccaacaagaacaggaagaaagtaatacttgaaccaggtgagtatagagtaagttcttcatttaatgttgctaacttgactccatttgttgcatgtgatgactctgaacatttgagggcaaatgctttccaagaaggaaggaatgatgagaatcctgaaactacccaaatacaggaacctatgacaaggagtaggaccaaacagttagtggataccctccaacaaatggtagcagacgtacttaacaaggcccaagtggagaaggatgaaggcccagaggtagagatactactaagcatattaatcgttgctgaagacctagactaa

SEQ ID NO: 45912 - DNA, 522 bp, Glycine max
  Peptide Sequence Number=SeqID_137597
atgtcacattttatagtaagtgatatcatagcgacgagacgggtcattacaacaacaaaccacaaaaagacaaaatttgtgggactacactgcaaagttggaagaagccttgaccaaactcaccgaagtggtcatcaccaaccacaaaaacaccgaagttatgatcaaaagcatggagactcaaatagggcaattttggccaaacaattcaagctaatcatccataagcaaggagacaatgagaggatgaccaaatttgagaaatacatggagatgctacaagggaagaaggaggaaccacctattgaaaaactcacatgggatgtgctacatcaagtaagacccacaagacatttggaggataagggatgctttaccatccctatctcattgggaaatctctctatcgaccatgcactacttgacttagagaagattggtcgtcttaacctaaagttcaccaacatgactctacaatttgctcatggttctaaaaagaaagcactatggaaagcgatataa

SEQ ID NO: 45913 - DNA, 642 bp, Glycine max
  Peptide Sequence Number=SeqID_137598
atggtttcttatttgtctctctcttcatccctatcgatgagaaaaaagggtgtaaggtgcatgttctacgtctctcaccagacatcctccaagctgttgcggtggacgagtttgcgtgtgggcaagagagcgtcgcaacccagttctcatcttttcaatccctcactcgctggaaaccttaagcgtcaatctctgaaaaacgcgatatccaatccaattcctcatcgccgacctccaccacgcattccactagttcaagcactctcatcaatctccaaaggtgagggcggcaagagcggtggtgccaaagccttcacagcacgagagaaggaggtcttggaaggaggggaaggagtgggagaggaggttgaggtcatggtcagtgagggacatgtgtttgaggtcgaagtcggcgaagcatggcttgccattaatggtcacagaccaaacgcgggggaattgggtgctggcgcgatgcggggacacgacgtagcagtttttgatgaagagctcggtgcgggtgagggcctcggcatggggaaagggttcgaccatcgtcaatttggttcatctttggcttcagagatagagaaaatgagagtgagtgaggaaggaggagcaagagtcgcctttgctttgtag

SEQ ID NO: 45914 - DNA, 180 bp, Glycine max
  Peptide Sequence Number=SeqID_137599
atggaagcataccaaaactcaaccagcctcacattgcatcaaggtggcatgatgttttccgtttccgatacggtggtgcacgcgaacgacggcgatccctttgtctctggcgagagacccgcacaaggtggcccctttgtctccgacgcacttgtgcttcaagggttgagagagagttga

SEQ ID NO: 45915 - DNA, 708 bp, Glycine max
  Peptide Sequence Number=SeqID_137600
atggcccgcaccaagaaaactgggcagataatgtttgaggcagcaaaggaaatcgttgacaagattggatcagctggaggatcgatcatagaaaaagtgactcaacagctgatgttatccttcaaccagatgcagtcccagttgcaatcacagatccaatcacagggacttgcactgcctccggagcctgaggttggtccctcagctactcgtgtgagcacaaaagggagttgtgttgatccctcaccgaccgatctagagacaggtgacctagacaaatgcgggttatacatcaaagacaatccttcccacctggttgccctaggaagagtttatgagggatccatagtggttcacaacatccctttgttgcatggccaagtcaaggtaggtgttgagcaggttaaagatgcagaggctcccgttcctgtacccactgacgaggttaatttagtggggcagacacttaagaccttccttgcttggccgacacatctcatgaagcgtgtatcagaacaagcagctgtgtctccagcaaaatctcatgataggccggatcatgaggaaaacaaagtagatgatcatggagatgacaaggaaggaggaactggtgctgtgggtgcttcagatggtccgtggcatcgatggccagcagcggcgatggtggtggaagagccattttgctttttcatcgattcagccatttga

SEQ ID NO: 45916 - DNA, 675 bp, Glycine max
  Peptide Sequence Number=SeqID_137601
atggatgggtggaagtactttgatagcatcaagacagattacaatattaatccaacaattgagcactactcttgcatggtagatcttcttggaaaagttgggtttcttgatgaagctttggatttcattcacactgtgccacaaaaggtagatgctagtatttcgggtgttgttcttgcagcctgcaaacttcacaaagacattaagatagcggagattgtcgctaggaatctcttaaggatacattgtagcagctctaagggttgctctgcgaggaagcaacttgagaggagcaagaatgatccaaacatgttggttatcacatacacatcagagcacaaccattcatggccaactcaaagaaatgctctacctggttcaacaacatcacagtcatccaagcacaacaacaatggcacaactacaagaacaaaggatgaacaagagagcaacaataataacaatagtgagggcaatgtgtccccagttatggctgggaactcatcaaacagtatgaaggaagacaatatggaagacaaagagaggcatcacattgagatggatgagggagagtttagtgatggactcccttataagcctagtttgataaatcacagtgctaataaccaagaatctgaggacttctttgttggatacttgatgagttgggcataa

SEQ ID NO: 45917 - DNA, 847 bp, Glycine max
  Peptide Sequence Number=SeqID_137602
tgaggaacttcgtgactattatgaaggaaggcataggtcacatcttagacctcactcccatatgagagaaaaggaaagaaatcctcaagaggctaacattaacctcccatacttccatgggaaggacaatgtagaggctaacttagattgggaaataagggtagagcaacaacttaaaagaaagtctacttcgaaatcttatggctctcactcttatccaaagaaagaccatggtcaaggcatcttaggggtgacaccttctaagcccaaagatgataaggggaagacaatagaaaggcaaccccttaaggctagtatgcaagagaagactagatttataaagtgctttaaatgtcttggaagaggacactttacttctcaatgccccaccaagaaaaccatgattatgaggggccaagacatttatagtagccaagatgaggctactacttttccttcctatagtgaaagaggcaagtgtctcctccaagagacacttgttagcattgccacacctcttaggcttgagtttattcctcaagtaaaggagttgttggatgagggtttggttcgcaagagcttaaatccttgtgctttgttggtgcccaaaataggtattattaggcatcaaatccctaaaataggtggtatgatgaatgttttgagtggtgcaaccctcttttgtaaaatcactcatgcacccaacaccttcatgatttgtgtacatatggactcattaggtgttgaggaaaaaagcccaaagtttcaagaacctcgggatttgaggtcaaatccttttcaagggggagggaatgatgcaatcctaccccgtaagggcattggatag

SEQ ID NO: 45918 - DNA, 579 bp, Glycine max
  Peptide Sequence Number=SeqID_137603
atggaacacaaacgagtacttattggtgaagccatcatgcttcattcattagttgaactaccaagaatgtgtaataagtgttttgcctacctaggtgttatatacataacacaccttattgtagaagcaaagcttcatgatgaattaagaatgattcaaagatgttttgatgataacaaaggtgatgacaaaaagctcaaaggtcaatcaaagaatgagttcaagatgttcaagatagaatcaagaaagaatgagttcaagatgttcaagatagaatcaagaacacttcaagattcaaggatcaagcttccaagaatcaagatcaagattcaagattcaagaataaagagaagacttaatcaagataagtatgaaaagagggtacatctacttgggttgttgactgagaacaagagagggtacatctcttgtggatcagttctagtggagggtacatccactaggttcaaagagaacaagggagggtacatcccttgtggatctttgcttgtaaaaggatttttacaaggtttgaaaagaaatctcaaggaccgcaggtcgcttggggactggatgtag

SEQ ID NO: 45919 - DNA, 664 bp, Glycine max
  Peptide Sequence Number=SeqID_137604
atgtctgatcatctcaggtttaatttcaaccagggctcaccaaggacggaccttgggtttggacgagccatggagattcgtcaaggctcaccaaggacaaaccttgggtgtgatgagccttggagattcatcaaggctcgccaagggaggaccttgggtatgacaagccttgaagactcgttgaggctcaccaagggcggacgttgggttttggtgagccttggagatccgtcgaggctcaccaagggaagaccttggattcgtcaaggctcgccaagggccgaccttgtgtttgacgagccttggagattcgtcgaggctcatcaagattggaccttaggctcaccaagagtgaaccttgggtttgacgagctttggagatctgtcgaggctcaccaagggcggaccttgggtttgacgagccttgaagattcatcaagactcaccaaggtggatgcagatgggacagttggaataggtgttggaggtgaggaagggggaaactcagaagatgggggagcctcaaacctctcccccctggccttgcacgaccctttgaagaaagcagcgattaaggctggaaacccaagcctagaagagtcatgtgtgagaggtagggaccgggttagagaaagaaagaatgctccatgtctgagcgagcgtg

SEQ ID NO: 45920 - DNA, 150 bp, Glycine max
  Peptide Sequence Number=SeqID_137605
atgcaagggataacttggctcccaaagctaaaaggtctgagtaggaaagaggctgaaattcctgaggagagtgaagaagtgcaagctttgaaagtggaggttgaaaagacaagaatggtgaaggtgaagctgaaggtggtggtcactagg

SEQ ID NO: 45921 - DNA, 147 bp, Glycine max
  Peptide Sequence Number=SeqID_137606
atggttattctatgtgttattttgaagtttgaatgggcgatggctccgaagaagctttctgctaaaagggctaggaaggccactgcaggggagggatccagtgcagccccacaagcagaaattgagtttgacgagcaccgtttctga

SEQ ID NO: 45922 - DNA, 246 bp, Glycine max
  Peptide Sequence Number=SeqID_137607
atggaagtgggtatggccgtgtgcaataacatggactacgtgttacaactattgtaccctggtacatttcattacgacgaatggggcaatgatctcagatatagtttgaagccagtgcgcccgatcgaagttaccgaggatcaaggagaccattcggatatgtcatcaagggagattgaggagtatagtgaacttatgtggcaattagagccaccgtctgagcaggagaatgatgatccttcttag

SEQ ID NO: 45923 - DNA, 944 bp, Glycine max
  Peptide Sequence Number=SeqID_137608
atttcagagctccttttgagcacaaaatttcgtgctcttctctccctctcccttcattcatctccttcttcctccaagctcttatccatggcctcctatggtgtggtgtctcctctctctcttccttctccattccgctgccatttatcttccaagaagcaaaggaatccattgatgaagaagatcctaggcctacaagctccaatggagcttgcatcaggactcatgctcacttggtatccccctttaatcaaaaccttattcaatcaattggggtacaaaattcaaccgatgctgtgaaggtcttcgtccagaggagcctagctattttggatgagaatggacaaaggcataaggaggctttgagtaatattactaccttggaggtcgaggtcaccaaatggagagccactgctcagattttgtggaaagtgaagtttcccaaagtggccaatgctattgttgccctagttgaagccattaggtctaactaccagttgttgtccagggttgatgatgtctttgctaagctagtgagcacaagattggatggtaatgaggtgttcaaacgctacaaatatttattgaaagaaaagaatgatttcacaggcaaggtggagcgcgcttttaaggagaaagaagtgcttaaagcgacagtgaccaaatccgccaagctaaaggagtttgagctcgaggtgaaaaaggagaaagaggcaaataaggagctagaggaggaacttctaatgtttaaaaaggaggttatggagcaacacgagaagggattcctcaaggccatcaagcaggccgggttcttcactgattgtcttgacattggtctttttgacccatttaaagatgtgaaagatggtcaactacttgacgaggaggagattgctgctagggaggacaacgacagcgaagaagaggataaggccaatgtttag

SEQ ID NO: 45924 - DNA, 861 bp, Glycine max
  Peptide Sequence Number=SeqID_137609
atgactggtgagatctctgctgagctaggtgcattgttcgggtttagtcatgatccccctggttgtctcgtaaatggtcaatgtctttattgggaattcttcaacaatgcttatgaattgactattgttgccaccagagggaggatgaagcttgcctgttacgatttctctcgtcaagatttcaagcctttgaaatgtcttccaatagagtatgtgtgtggaactgccttggtcgacaagaactttagacaccatgaagttggcaatgaccatggagacgaccatgtggtcatcctgtttgatgaggttgatgcttttgaaatctttgtcaatgaatgttatgggtggaagacttctcgatggtggtgtatcaacgtagttaacattgatatctctaatggcatggagatggcgcttccgggattagctagatatccctccataggagaatccacccgcaatagtgttgatcacgcctttaatttactgagcgagtttgtcttcctgctcttgctaggtctgggaagagttatagggggtaactgtatgggtatctcggcgttgaaggcttctttgagaatggtggctcgatttgttatcagtggtattgttggtttgacgaggatgcgattcaccctgggtgtgctcattgatcgtgtgagtggagtgtctatcccctttggggagtctcacacgagcctccaactcgttatgtcatcagaagagggattggaattttctgggggtggctcttgcctgagacctaatcgtgtattaaccattagtgttggtggccgtggggggagttttaccatggccccatggtgggtgccaaatgtacttactgaaaccgggagttga

SEQ ID NO: 45925 - DNA, 129 bp, Glycine max
  Peptide Sequence Number=SeqID_137610
atgggatttgtgggaggtgatttggttgagaaacgagtgagatataaggattggaagttttgggagaaagagggcaccgtaactcgaggagcacttagccttctggtaatcaattacaggctgctataa

SEQ ID NO: 45926 - DNA, 327 bp, Glycine max
  Peptide Sequence Number=SeqID_137611
atgcctatggtcgttccggaaatcctaggaatatatctgttggtggtaaagatagcagtgcttggactgttttggaatgatgaggacacgactgagagggagactgagttgcatcctcgaaggaaatcgaatcctcatgagacaacgatcgttccttcaaccaatatggattctcaatttcgagcatgggttggtggtgttgatatggccaccaactttgaactccatgaagcactcaatttagaagatgtcaaatggatcaatgaggaagttcatggtgtccattctgctttgactcccttggtccttgctttctttaccccttaa

SEQ ID NO: 45927 - DNA, 426 bp, Glycine max
  Peptide Sequence Number=SeqID_137612
atgacaattggtaaatttcttgtagataaatcgccatttgatccggaaattaccaaaattgaaaggaagaatagaaagaaaaagaaacaagcaaacactataacaccggctgagtcttcttcttctgattatctttcaactaataagacacttgtagaaaataacatggatggtcaaggaggagaaggaaatagaccaccaaggaggactcttggtgactatgcttatcaacaaggaccaaagcattataacaacatagtcattcctcttttcagcaacaaggtcgtggaattgaagccagcaccgcttagtctaattggctcagattcctttgatggaatggatcatgaggatccgtacacacatttttctacctccatggaactattcagtaccataaaagctattgacaaagatgatccttga

SEQ ID NO: 45928 - DNA, 1524 bp, Glycine max
  Peptide Sequence Number=SeqID_137613
atgactgatacacaacacctcagcctaaagtttgaccaactagagaaagcaaagcaaattgcacaaaattcagccccaaagatacaaagggtagcacatcatctgcgagatcgaaaacattttgccaagcattacttacccaggttggtgtcaattggtccaatccatcatggtgcagagaaactgcagctgggagaaaaatacaaggttatgtgggcagcaatgtacctcgaacgcaccaaacaagatgcacaaactctgtaccaaaagattgcatcaaatattgaacaactgaaggaactgttttctgaggatgttgttagagacttccctgatgatgaaaagctctcgtggtcgtggatgctatttgtggatggatgttctctgctacaaatcttggagaagggaaaacttcattatccaaaagaaatgaatgtaaaggttgatcaactggctcttgtgtggcaggatgtgctcttgttagagaaccagcttccctatcaagtgcttaaactgttgtcagaccacgggaatgatgcaaagctagtaaagagcatgaatgagtttcttaagtgccatcatttgtcaccagttagacaggagcaaaaagctaagaaacaggacatgggcaattttaaaagcaaggatgaagatagagcattgactgaagaagagtacagaagcgtttgtgtaaagaacgaagacaccctaaaaggagaacatagaatagaaataacccaggaatcacctattcatcttcttgatcagcttcgcagatatgtccttgatgacccacatgagaaaaaggacacaggaagggacaaaaggaagaagaatacaaatgaagacttggacatgataacatacaggaacaagaaaagggagaacagcacaaatgaagacttggatatgacaacatacaggaacaagaaaaaggagcagaacacaaatgaagacttggacatgacaacatacaggaacatacaagagctgagagcagcagggattaaacttaagagagaaaagtcacgcaggctcagagacgtgtctttctcttatcgctggatgtgtttgtgcgcggaactgatgcttcctgagatcacagttgatgacacaacagctcctacatttctcaacttgatagcatatgagatgtgtcctgattttggcaacaacttcgagatttgttccttcgtggccttcatggactcgcttatcgaccatcctgaggatgtgaaggagctgagagcagcaaaggttctgcacaatgcccttgggagtgatgaggaagtggcaaagctcttcaacaccataagcactgacttggtgcccgacacggagagttattcgcatgttagatgccaaattgagaagcattataggagcaaatacaggacatggatagctcttggttatcatacgtactttagtaacccttgggcaatcattgctttccatgctgctcttgttgctctagttctcactttcatccaaacttggcttgctattcaccctgttggctag

SEQ ID NO: 45929 - DNA, 216 bp, Glycine max
  Peptide Sequence Number=SeqID_137614
atggagcttggaagaagaagaaaatggatgcctctcctccctagaagaacttatgcaagaggagaagtcaagttgtttgtgaataacaaatcaagaacagacttaggtaaacatcctgttgcacatggaaggagcaaacacataaaaacacactttcactttttgagagatcaagtgaataaagggaaattgatcttggagtactacaaggcataa

SEQ ID NO: 45930 - DNA, 255 bp, Glycine max
  Peptide Sequence Number=SeqID_137615
atgacaaaaggtgccgatgaccataaggtacccccccatgtcatcggactcgcctctctggatgacaaaagtgcggataacctaaggtacccccgcatgtcatcggacttgccatctctggatgacaaaaggtgcagaagacgacatgacgatgttagtctctatgtcaacgggctcgcttgcctctggttgacaaaaggtgcggataaccataaggtacccccgcatgtcatcggactcgccgtctctggatga

SEQ ID NO: 45931 - DNA, 843 bp, Glycine max
  Peptide Sequence Number=SeqID_137616
atgggttgggtagccatgctttatctcgcctttatctcgccgtcgttcctgcactcaaccgacgattatctgatcaagcttctcctaatcggcgactcttccgttggaaaatcctgcttgcttctcagattcgttcgagaggttgagggtgaccttttacttggtgacatgggtcagggtctaggaatttgtcctggagttttggatggagccattagtatatctgctgttcaggagaagaagtacaacaagaaatgtgcaaatgctgttattaaatcactgggtctcaatacggaaaagattgaaaagtgcatgggagatccagacgccgataccgataatcctgttttgaaagaagagcaagatgcccaacatgtgtctgaaatagccttggagaatcttagaattcggttaagaggcacaactgcacaagcatgtgggagaatggaagtcatggcaaggcttctcgctgctgagactttctctcacactgtagtagtacaggtaaaaccaaagcaccctgatttcaaacgcaaggatcgcaattctctctggcttggcaaggatgaaaagtgggttttgcctaaattggaaggacttcaatttgatgttccaactgctatatccaaaaaaggtgatggtggtgagccctgtaatgatttggtgcaaaactatgctaactggtgggataatagattaaataagaggaatgcaaaagctcccgatttcaagcacaaagaaaccggtaaagggttgtggcttgattcttcatcagagtgggttttggaaaaattgccgccacctctgaagcctaaacaaagtgtagatactgaaaggacactg

SEQ ID NO: 45932 - DNA, 923 bp, Glycine max
  Peptide Sequence Number=SeqID_137617
caatccacaatggtctcaccaatgatataaccctcacccatggaagcaaaaagttcaaacttgttcccttgacactttcactagttgttggggatcaagtacaaataaaactcaaatgggatgaggaaaagaatagaagaagaaaagaagaacaacctttaatggttaaggaggggtgtaaggaggtaagtgtctcctccaaaaggacacttgttggcactgccacacctcttgggcttgagattattcctcaagtaaaggagttattggatgagggtttggttcataagagcttaaatccatgtgctttgttggtacccaaattaggtattattaggcaccaaatccctaagataggtagtatgatgaatgtgttgagtagtgcaaccctcttttgtaaaatcactcatgcacccaacatcttcatgattcacgtacatagggtctctttaggtaggtttgatggtgctcatatgggacaccttagtggtgtctccaatcacctttcctcattctctattcagctttcattgatcttgaagaagaaaagaactccattgatgaagaagatccaaggcctacaagctctacatggagctacattactccccaagaccacactaactgatttcgaggtttatccaggaagtactattgaagggcatgcattttctagtgtccctatgtcgtacgcttcgggggctcctcagtctactgttgtggttgagaatgaaaagtttgatcatatagaggaaagaatgagggccattgaaggaaggggaaattatggatttattgacatgtcaaaattgtgtttggtacccgatgtggttattcctctaaagttcaaggtaacagactttgataaatacaagagtaccacttgcccgaagaaccaccagtatggaatgcatggaacctaa

SEQ ID NO: 45933 - DNA, 108 bp, Glycine max
  Peptide Sequence Number=SeqID_137618
atggcagttgcctggtatatgtcttcccactccctaggtaatgaagaaattccatatcaactaaaaagttctgaggttggagaaaatcagaacaacaacatctattaa

SEQ ID NO: 45934 - DNA, 369 bp, Glycine max
  Peptide Sequence Number=SeqID_137619
atgacattggtaagctaccactggaactcccagaacttagtagtcttacgaaactttagtttgaactgtcgggagggcaccttatgccatggtatgatggcaaggctctcaccgactggttatgccttgcatttgtcgggatttccaagttggcactgtggaaaatgcgaccacaaactcagtgtcatatccctaataaatagcaagtcagtgagcgtaaccgaagtaccactctataaggtcatcctaactccaaggacttactcctcaaccactcctcaccaagggtttaccttatcgtcgttgtggggctcgactgcacagttatggatgcctgggattcacacttcccaagtctttcagatgtaa

SEQ ID NO: 45935 - DNA, 729 bp, Glycine max
  Peptide Sequence Number=SeqID_137620
atgtcgcgggggtcaggagaccttggggacgtcaggtggggtgctattgcccaaaaccaagcttggccaatcccggcccaacccgggcatagtcagccagtgagaacctgtgacgtacctaagcaggcgagctcttggcagtcaaccaataaaggaacaaaagtccacgaagcagggaggcttgtgtggcggctggccagctatctatcttgtgttttatctgaaaaattccctctgggtttaaaaattgaaacagaacgttcagtagctactggtaatcgattaccatttatcgcgatggcagcgcagttgatccatgatcgcgttgtgatggagtgcctagatggtgtttgggagaccctcgaaggcaatgagaggtgtcgattccgtggcacagttcgactcactactacttcgttagtacatccgaagcaacctgcacacacacttcagcagtctgtggagtggatactacctacgcctactccatatcgactagttgagcctgttcaattgatagaggtgtcatcctctgatgaggatcttgaagaggacccagaggagttacctcctgaacctgctatggatgcccctgacttaccagaggatgatgaggacccgctccctgatgttgattctccagaggatatgatgtcagcatctgaggcagactctacaaagcagagtgaccctggagggacagcgaatagtgacgactcttcatcatag

SEQ ID NO: 45936 - DNA, 156 bp, Glycine max
  Peptide Sequence Number=SeqID_137621
atggccattgtgagttctaaaaactatttttggcacatctgtagtgatgcaatcctccttaggaagggaccagtcactagagccatgagcaagaggctccaagaggattgggctagagctgctgaagaaggtcctagggttctcatgaacctcagg

SEQ ID NO: 45937 - DNA, 411 bp, Glycine max
  Peptide Sequence Number=SeqID_137622
atggcttccagaaagagaaagagtattggtacaaggaccacatctcagtatgatacaaggaggttccactcctttgaggcttggactcgatacacatataatgttctaggaagacatatattgcccgagaggaaggtagaaatataccacactgagctagacgagtttaaggctaaattggagaggcgtaacttccataaacacctcaccaatttagttgacaggagcatagatctagctttggtgaaggagttttatgccaatctttacagctccgaaggaccttcaccaaaacaagttaggttcagaggccacgtggctgccttatgtatccaaggttgggggtttgttttgaatgctgaaggccaccctaggaagattctcaggaaagatttaacaactcttgcttag

SEQ ID NO: 45938 - DNA, 183 bp, Glycine max
  Peptide Sequence Number=SeqID_137623
atgagcaggctccaagaggattgggctaaagctgctgaagaaggccctaaggttctcatgaatcttaggagcacaaaatttcgtgctcttctcttcctctcccttcattcatctccttcctctaagctcttatccatggcctcctatggtgctgagcttcttctagactcatcttctccttga

SEQ ID NO: 45939 - DNA, 546 bp, Glycine max
  Peptide Sequence Number=SeqID_137624
atgatcttgaccacttcgacatcattttcaggcccaaccatcgccagtctgatcgtcgacagtgttgaggcaactgctgaagtttcaaagactttcaatgaaaaaattagaaagtactgtgacatgacactactatcatgtggctatgctggaactgaaaatgttcttaaggttcaaaatttgctgggtcattgttcacaacatcttgataaaggtgaaaatcaccaaggttctgctgtgcttgaaattgctatggtagctatggctgaagaattgggacttgagatgacaattcgatcattagaacatcttctacaatatggagagcagaatatttgtcaagcagttcctttggcccttggtctactctgtatatcaaatccaaaggtcaatgttatggatacgttaagcagacttagccatgatactaaattggaagtagccacgccaaggatgttgttgactatggatgagaacttgaagcctctatcagtgcctgctcgtgttggacaagcaggtcgtccgaaaacaatcactagcttttag

SEQ ID NO: 45940 - DNA, 1185 bp, Glycine max
  Peptide Sequence Number=SeqID_137625
atgtggaactttggtggtggcagttgcaggttttctcacaattcctcagctgaaaaaatgagaattctggaagagtcaccttcatatgcccatggttcctcctccgcaggtcaagagcctcaggatgcagattatgatgttccatgtctcagtgatgagctagagaccatgatactggcaagatttccaataccaaaacactggaagatgtgttgtctaagcaagcggtttctgacccttctgaagagtggtgaaatctacaaaatcaggagggtgatagggttcaaggagccatcagtttttatgttagcaagtggagagaagaattggtgtgcatttgatggccacttcaggtcctgcaggaagcttcctatcattccatcagattacaattttgagtgggggaacaaggagtcattttctgcagggacctatatctttgtttcaggaaaagaggttgatggtggtgttgtttggaggtatgagttagcaacaaatgagtggttcaagggtccttcaatgctcagtcaaaggtgcctctttgcatcagcctcttgtggtaccatggcttttgttgctggtggaattgagacaacaactagggaggttttgagttctgctgagaaatacaactcagaaagccacatttgggagcaacttccaaggatgatacaaaagaggaagtcttgctcaggttgttacttggacaacaaattttatgtgcttggagggcaaaacgagcagaagaaagacctcacttgtggggaattctatgatgaagacacaaacacttggaacttggttcctgccatgttcaaagatattcctctttcaactccaagatcccctcctcttattgctgttgccaacaatgagttgtatacccttgacgcttcctcaaatgagctaaaggtttatcttaagaaaagcaactcatggaagaagttaggaccagttccagtgagagctgatgcacgactaggttggggtgtggctttcaaatccttgggaaatgagttgcttcttattggggatacctctgcctcctactcacaacgtgccgtgatgaagatatacacttgcttccctgatccacatgttgagaaattgaagtggaagcaaattgtatgtagcagcaccaaccttcacccctttattcacaattgtgctgtcatgttagcttga

SEQ ID NO: 45941 - DNA, 852 bp, Glycine max
  Peptide Sequence Number=SeqID_137626
atgaccatattggtctctgcgtgtcaatgggcttgcttgcctctggttgaagaaggtgcagataaccatgaggtggtggatgatcaaattttgtatatgcatgtcatcaaacttgcttgtctctggatgacaaaggctcgcttgcctctggttgacgaaggtgaggataaccatgagatgaccatattgatctgtgcgtgtcaacgggctcgcttgcctctgtatgatgaaggagtggataaccatgagatgaccatattgatctgtgcgtgtcaacgggctcgcttgcatctgtttgatgaaggagtggatgactatgagactttccttctctggatgataaaggcatgcttccctctggttgacaaaggtgggaataaccatgaggtgtctctgcgtgctatcggactccattgtccctggatagcaaaggctctcttgcctctagttgacaaagacaacatggtggatactaaagtagtgtctgtgtgtcaacgggctcgcttgcctctggttgacgaagacattgagtcttcgacaaagggagcagatgaccatattggtctgtgtgggtcaacgggctcccttgcctctgacttgccgtctctagatgagaaaggagtggataactatgaggtatctccgtgtgtgaggattatctgtgtgtcattggactttccgtctctggatgataaaggtgcggataaccatgaggtgtctccacattctaccggactcgattgtctctggatagccaagacttgtttgtctctggatgacggggtggagactaaagtagtctctgtgtgtcaacgtgctcgcttggctctggttgacgaaggtggcggatga

SEQ ID NO: 45942 - DNA, 429 bp, Glycine max
  Peptide Sequence Number=SeqID_137627
atcatgggttctccacctgcctccactcctcctcctcctcctccttcacctccttctcctcctccttcggacgcatcggcttcgtcgtctgccgtgaagcggacactcaaagcctcacgtctacgatcgttgtccactagaccacctggtgctgagagaccagtggtgcatgttgatcctgctaccgggaaggccaacggtggacatcacctacgagaactggaaggagtccctactgctcagaaggacctgatttgggaggatattcaggcgaaatttgatatccctgaggcttctgacaacctcgcgaggaaatgggcccttgcagctaatcaagacggtgtcgaggacactgtctgtgagaaatatggcatcagcaaggaaaagtgggtccagttttgccagactcgcagagacccttcttgggag

SEQ ID NO: 45943 - DNA, 345 bp, Glycine max
  Peptide Sequence Number=SeqID_137628
atgggtgccaagcacctcacgaggaccaaagaatggtcgcacgtcatcaagcaaaggtccccggacgaatgggtgcgaataaccataagaatgaacaaacttggtctctgcttgtcatcgggcccgccgcctctggatgacaaaagggtgcggataaccgtaagaatgaccaaacttggtctctgcttgtcatcgggcctgccgcctctggatgacaaaagggtgcggataaccataagaatgaccaaacttggtctctgcttgtcatcgggcccgccgcctctggatgacaaaagaggtgcgaataaccataaggtatctccgcgtatcatgggtgcagaatga

SEQ ID NO: 45944 - DNA, 422 bp, Glycine max
  Peptide Sequence Number=SeqID_137629
gtgattcaaccgccgatcacccgggccttcattgagaagtattgcatgcctagacaggcgcagggtgatgcaccacaggctgcagacgcaccaccaccacctcatcaggctgatccagttgggtcatttggcatggagcggtatttacagcacttggttcgccagcaggtgaccaaccacagggggcaggtgcagatacatgagtatctctacctgctcagcatcagtcagcagagccagggtttcgctacttttgtgtgccctactccagatcagttcagggctgaggttgcatggcccggagattggcctgaggcccaggcaggggaggcgcccactgaggctctcagtgatgcagaggaggcccgcatggatgaggagatgacagatttactcagtttcttgggagggagtggagccac

SEQ ID NO: 45945 - DNA, 450 bp, Glycine max
  Peptide Sequence Number=SeqID_137630
atggaccctcggaggactgcatgtcctccccttcagagggctacacgccctcgccatcagaggactgtgtgtcctcaccttcagagggctacacgccctcgccatcagaggactgcatggctacacgccctcacctttagaggactacacgtcctcgccaacagagggctgcacgccctcacctttagaggactacacatcctcgccttcagaggactccacgtcctcaccttgaaaggactacacgtcctcgccttgagaggactacacgtcctcgccttgagaggactacatgtcctcaccatcagagggctgcacgccctcacctccagaggactacatgtcctcgccttgagagggctacccgccctcgccttgggtactagttaccctcaccttcagaggactacatgtcctcaccttcgtagggctacatgccctcacctttag

SEQ ID NO: 45946 - DNA, 183 bp, Glycine max
  Peptide Sequence Number=SeqID_137631
tccagcaagggcatcagcccccctactaatcgagatgtcatcaagaagtacggcatccccaggcaggcgcagggtgaaacaccacagcagcctggggatggccaacagcgggcaatagacgcaccgccatcacctctagagttcacctcagctcatccacaaaaaggtagaaagataccttga

SEQ ID NO: 45947 - DNA, 291 bp, Glycine max
  Peptide Sequence Number=SeqID_137632
atgaaggaaggcataggtcacatcttagacctcactcccataggagagaaaatgaaagaaagtctcaagaggaaggacaatgtagaggctaatttagattgggaagtaagggtagagcaacaacttaaaaggaagtctacttcaaaatctcatggctctcactcttatccaaagaaagaccaaggtcaaggaatcttaggggtgagaccttctaagcccaaagatgataaggggaagacaatagaaaagcaacgcttaaggctagtatgcaagagaagactagctccatga

SEQ ID NO: 45948 - DNA, 645 bp, Glycine max
  Peptide Sequence Number=SeqID_137633
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaaccacgctgaaagagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 45949 - DNA, 546 bp, Glycine max
  Peptide Sequence Number=SeqID_137634
atgttggtgcgcatgatccgcactcgtctctttgcagcggcatgggtgaaatcttgccccggtatgcacagtagctgtgtgatagcctccctctctggttgtgcttgcacagttggccctcctccaatatcagggggtggcccaggaaccgtgtggatatggagcccactgaaagtgaggacgcgtagtcctctaaaggcgagggcgtgtagtcctttgaagttcaggacgtgtcgcctttcgaaggcgagggagtgtagtcctatgatggcaaggacgtgcaatcctctaaaggtgaggacgtgtagtcctctgaaggtgaaggcacgtagccctacaaaggtgaaggcacatgaccctttgacggcgaggacgtgtagtcctctgaagttgaaggtacatgaccctttgaaggcgaggacgtgtagtcctctaaaggtgaaggcgaggacttatagtcctctggaggtgagggcgtgcagccctctggtggtgaggacgtgtagtcctctcaaggcgaggacgtgtagtcctctgacggtgagg

SEQ ID NO: 45950 - DNA, 587 bp, Glycine max
  Peptide Sequence Number=SeqID_137635
agcatgttagggttcgagggcacttgattaagttcgatgcggactccctcaacaccttcttgaagactccagtggtcttggagcaaggggagagcttaccttcttactctaggttctacaggttgaggccagaccctcaagagctggcagcccgactgtgtatccttggaagaggatttgttcttaacattgagggcttgccatggaagctcttgagcaaggatcttacaactctggcgcagacttggagtgttttatcttattctaacctagccctgacttcacatacctctgatcttaatcttgacagggctagctccaacagccccagttcttccaggtccctccactcagagctcagagcctttcatgtctatgctgcagagcctgcaccagggccagctcctgattatgcagagcttgcaagatgtggtccagcagtgactagttatgagtgtggaggagtttctgcagaagtgaccgtagagggtactcagcaggcatctccagcaggcactcctacactggacttgaacaaggaggccatggatcaggacccaccaccaccacaggaccaggatcactga

SEQ ID NO: 45951 - DNA, 247 bp, Glycine max
  Peptide Sequence Number=SeqID_137636
gtacttgtcgcaacctacccttttgcgggcgagcgaggcgaggctcacgaatgcgctttccaaaggaggaaaatgcgcggagtcgccaccaacgtttatttgtggaaaacgtcggaaaaaccaaaggaaaccggtcataaaggatattccaagttcgggagttgtatttatatttgaggaaggtcaacaaaagcagggctcttgctcctacgtaccctccatcgaagaggaaatcagacctacgtag

SEQ ID NO: 45952 - DNA, 417 bp, Glycine max
  Peptide Sequence Number=SeqID_137637
atgaccggccctcttgatgagtcaatctcttactttctcataagggtggatccttgggtactagtacctattgcctttagagggatgcatgccctcaccttcagagggctacatgtcctcgccttcagagggttgcacgccctcacctttagagggctacatgccctcgccttaagaaggctgcacgcccttgccttaagagggctgcacgccctcgccttcaaagggctacacaccctcgccttcagaggactacacgtcctcaccttcagaggactacacgccctcgccttcagaggactacacgtccttaccttcagaggactacacgtcctcgcctttagaggagtacacgtcctccccttcagagggctacaggtcctcaccttcaaaggagtacaggtctcttgcctttag

SEQ ID NO: 45953 - DNA, 617 bp, Glycine max
  Peptide Sequence Number=SeqID_137638
atgttgctaagcagcaacgtcatctatatctatgtaagagtggtcatgttggtgcgcatgatccgcactcgtctctttgcagcggcacaggggaaatcttgccccggtatgcatagtagctgtatgatagccttcatctctggttgtgctcgcacagttggccctcctccaatatcagagggtggcccaggaaccgtgtggatgccgagcacactgaaaatgaggacacgtagccctctcaaggcgaggatgtgtagtcctttggaggtgagggcgtgcagccctctgttggcgaggacgtgtagtcctctaaaggtgaaggcgaggacttatagtcctctggaggtgagggcgtgcagccctctggtggtgaggacgtgtagtcctctcaaggtgaggacgtgtagtcctctgacggtgagggtgagggcgtgtagccctctcaaggcgaggacatgtagtcctctggaggtgagggcgtgcagccctctgatggtgaggacgtgtagtcctgtcaaggcgaggacggcgtgcagccctctgatggtgaggacgtgtagtcctctcaaggcgaggacgtgtagtcctctcaacggtgagggtaacaaatacccaag

SEQ ID NO: 45954 - DNA, 279 bp, Glycine max
  Peptide Sequence Number=SeqID_137639
atggggtcactgaatgacgaggtgcggataactgtaaggtgtctccgcgggctaccagctcttgggtcatgcatttcgtttctaaatgaccatttagaggaaacactgggttcaacaaaaatagaagaaaatcactcagagtgtatcaacctcgcacagatatgtcacgacttgactttgcgaattatttcctatcaaatcaaagattacatgcgtgatcatggatcaataggacttcccttggaaatgggttcttttggtgggtttttcggcttttga

SEQ ID NO: 45955 - DNA, 771 bp, Glycine max
  Peptide Sequence Number=SeqID_137640
atggcaaatcaagaagattgggtcccgtttatggatgtgttagcattgctaatctttggggtcgtcctctttccaaacgtagatggtttggtggacctagccgccatcgacgctttccttgcataccaccatagcaaggaaagcccggtggtagctgtcttggcagatttatttgacacatttgaccgaaggggcattcgtaatggcatcatcggtggttatcatgaatggctgaaagttcgtacacgagggttagattggctctccaagttaaagattatcgacaaagaaagcttcgaagctctagaagaggatgaagaagtccgagctctaaaaacagaactaggaaaagcaagacttgccaaagaaaaattcaagttggtcgctacagacgtccgaaaagagtgtgtcgggttacaagaagaaaatacagctaacgcaaaagcccttcaacaagaaaccaagagggctcgcaaggaagagcatggccgtgacaaatttcgtggagctttatggggcagcaacagtgagctcaagcttcgaagggaagagagagaccaatcacgagcacataacatggtcttgaaagaggagtcagctgcttgctcaaggtccaaaagaagcttgtctcagcgtttatgcgagacagagaccaacatgttagccatcatcagcaagtaccaagaagagctaaatctagccacggcccacgagcataaagtggcggacgagtatgcccaagtgtacgcggaaaaggaggctagaggaagg

SEQ ID NO: 45956 - DNA, 171 bp, Glycine max
  Peptide Sequence Number=SeqID_137641
atgcctgagcggggcgaagccagagaaattctgaactggcgatgcgggatgaaccggaagctgggttacggtgcccaactgcgcgctaacctagaccccacaaagggtgttggtcgattaagacagcaggacggtggtcatggaagtcgaaatccgctaaggagtgtgtaa

SEQ ID NO: 45957 - DNA, 108 bp, Glycine max
  Peptide Sequence Number=SeqID_137642
atgaaaatcatcccaggcaccccatcaggcaaaatagttaatcagctcaagaaaggaaaagtgaaaagccctcacaagatataccctccaatctctcaggggtctagg

SEQ ID NO: 45958 - DNA, 240 bp, Glycine max
  Peptide Sequence Number=SeqID_137643
atggttgcttatggaggaagcaacccagctcgcctgggcgagctgggcggcaacctcctccctccttttcctataaataggcgaagggaggctgttccaaatatccctaacccccttggctatgcatttcagctgttttgggtgaaaaaaattgtttccgtgaagaaaatccaagccaagctttcatcttcatttcgttcattttttgttttcctttcttctgtttttaacgagctttaa

SEQ ID NO: 45959 - DNA, 231 bp, Glycine max
  Peptide Sequence Number=SeqID_137644
atgactcgcgtgaggggaccaaagcttttgatgctccgccagccactccgtaaggacgacgacctattggtagtgaccctagcctccttttgtgtccgtccccaagtatctgaaagtaggaaacaacgaggtgtggcaaatctcgaccgcgtcgttgtctcacctcgattggtttctgctgttttaactttgtctttaccccagaacgtagctcgagatgatcctgcccct

SEQ ID NO: 45960 - DNA, 225 bp, Glycine max
  Peptide Sequence Number=SeqID_137645
atgatagcgaataagaggtgttttgatgataacaaagatgatgacaaaaagcccaagaaaatgatttcaagattgagtcaagaacaattcaagaatcaagagaaagattcaagagaaagtttcatcaagaagattcaagattcaagattcaagaataatcaagatcaagattcaagactcaaagattcaagaatcaagataatacttaatcaagataagtattaa

SEQ ID NO: 45961 - DNA, 544 bp, Glycine max
  Peptide Sequence Number=SeqID_137646
atgggttctccacctgcctccactcctcctcttccttctcctcctccttctcctcctcatcttcctcctccttcggacgcatcagcttcgccgtctgccgtgaagcggacacgcaaagcttctcgtctacgatcgttgtccactagaccacctagtgctgagagacaagtggtgcatgttgatcctgctaccgggaaggccgacggtccccacaggaagaaattaagaacatatttggggattgtggcgcgtgataaggcggaatttgatatcttagaggcttctgacagtaggacgaaaaggaagttattgcagaccgtgggggagagatggaggcagtttaaatcagacctcacaaggaaaggggcccttgcagccgatcaggacggtgtcgaggacactgtctatgagaaatacggcatcagcaaggaaaagtgggcccagttttgccagactcgcagagacccttcttgggaggatgtgtgcaagaaggcacaggacatccagaagcagaatactggcccccatgttttgtctcgtgggg

SEQ ID NO: 45962 - DNA, 525 bp, Glycine max
  Peptide Sequence Number=SeqID_137647
atgggttcagttccaattattttaggcaagccatttatgaaaacagcccaaaccaagatagatgtttatgctggcacattgtctatggaatttgttgatattattgttcactttaacattcttaatgccatgaaacatccatctgaggatcattctgtttttcgtgctgagataattgatcagattgttgatgattatatgtttgattttgattctgttcttcatggtaggaaacatccatttttatctgatctgcatacttgtcattccttatgcattgaatctgaatctgagtttgaatttgatcctgtatctgatttttatgctgagagtgaatttgaatttgagtttggttctaattttctgggtgttgtacctcttgatgttgattttttagagtcagaatgcactaatcgtgttgcaagaagttcatatacttctgacttgctttatgaggacaaggaaaaatttccagtgatcatctctgcctcccttgctgctgagcaagaggagaagttgttgcta

SEQ ID NO: 45963 - DNA, 271 bp, Glycine max
  Peptide Sequence Number=SeqID_137648
ggaggcaaatggaaatgctgcaaaccctagagaaggttcgatgagtatcattcgggtcatgggcttggcccatcaaacaaagaagtccgaagccgatgtggaagagggtggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 45964 - DNA, 84 bp, Glycine max
  Peptide Sequence Number=SeqID_137649
atggaaggaaaacaagggggtgcaaatagcaaccaggcccacttgggccttccaggaagttctccagaaggcggtgccttctag

SEQ ID NO: 45965 - DNA, 471 bp, Glycine max
  Peptide Sequence Number=SeqID_137650
atggccccgaggaagcttgcctcaaagagatctaggaaggataaagcggctgaaggaaccagttccgctcccgaatatgacagccaccgttttaggagtgctgagcaccagcagcgcttcaaggccatcaagggatggtcatttctccgggagcaacgcgtccagctcagggacaacgagtataccgacttccaggaggagatagttcgccggcgttgggcatcactggttacccccatggccaaaggagggcgtgcgagatatgcgatcctggatgctctcagccagttcctgggataccctttagtgctggaggagggccaggaatgcgagtatggccagagaaggaaccggtctgatgggttcgatgaggaggccatcgcccagttgctatgtatgccggggcacgattttgcccggattactgctgggagatgggtacggatcatgcgcaccaacatgaccacctga

SEQ ID NO: 45966 - DNA, 222 bp, Glycine max
  Peptide Sequence Number=SeqID_137651
atgtctattccccaatttatggttctttttgtaggtgaaaagatgaagaatacgaaggttgttgtggctggtgtctcgctaagtgaggcttgtgtgcttagcgagaatcattcgctaagcgaggcatcaacccgcttagcgagttgggagaatctggaggagaatctgtcaagcatcagtgcgtcatcagctcgctcaacgagtcatttgtctttgcgctaa

SEQ ID NO: 45967 - DNA, 231 bp, Glycine max
  Peptide Sequence Number=SeqID_137652
atgaagtcaggtgacatgcgggggtaccgtatggttatccacacctttcgtcaaccaggggcaaatgagcccgttcacatgcagagactaacatcgtcttatgcaccttttgtcatccagggacagcgagtcaggtggcaggcggagataccttatggtcatccacacctttcgtcaatcgaggcaaacgagttcgacaatatcaggatgatgttggtcgtccgattctga

SEQ ID NO: 45968 - DNA, 306 bp, Glycine max
  Peptide Sequence Number=SeqID_137653
atgtaccctctcttgttctcagtcacaacaacccaagtagatgtaacctctacttgtaccacaaaggatgtaccctccaatgtgttaagacaaagttctcaggcagttagtcctttgaaactttgtgaatggggaaacaaaagaattctcaggcgggagaagggagacacaaaagaattcaggcggttagcccttcgttcttttggaaaagggagaagagagacaaaaagaattcaggcggttagtccttggcgaattctttttggcaaagggagaagggagacacaaaagaattcaggcggttag

SEQ ID NO: 45969 - DNA, 605 bp, Glycine max
  Peptide Sequence Number=SeqID_137654
gtgatgttggggaatggctacgagcccgaaatgggtttaggcaagaacaacggcggcagaaccagcctggtaagcaccagaggaaaccgcgggaagtttggattatgctataaacctacgcaagcagacataaggaaaagtgtcgcgggaaggaagagcagaagccaaggttcgcaattgggacgacaagtcgaaggaggcccgccctgccacatcagtaggagctttataagtgcaggtctaggacacgaaggccaagtcgttgcaatatgcgaggatgactctctgagtgggtcggatttggacccgaccatcgatttcaagcaagaagcgggtcagacggagagtgaagagggcgaggatgtgggacttccctcgaagttggagaagatagtcgcccatgaggaccaagagatggggcctcgtcatgaagagacggaactagtggacttaggaaccgacagtgggaaaaaggaagtaaagataggcactatggttgtaagggatggtcttaggcctaggttgtgttatgagatgatggggcaagccacattgcccccattcccttgttgttggtacccaaaagtgcgcccaccaagtgctcg

SEQ ID NO: 45970 - DNA, 615 bp, Glycine max
  Peptide Sequence Number=SeqID_137655
atgggaagacaaaaagcagtgatcaaagctcgtcgtgaggcaaaacgtgtgctgagacgggattcgcgtagccataaacaacgtgaagaagaatcggtcacatcgcttgtgcaaatgagtggcgtagaagcaatcggcatggcgcgggatagccgcgatctttcgccgattgaagcgcgtaatgaagctcaggcgcattatttgaatgccatcgacaataaacagctgattttcgccaccggcgaagccgggtgcgggaagacctggatcagcgcggctaaagcagctgaagccctgatccataaggatgtggacagaattattgttacccgtcccgttctgcaggccgacgaagatctcggcttcttaccgggagatatcgccgaaaaattcgctccttatttccgaccggtatatgacgtactggtgaagcggttgggcgcttcctttatgcaatactgcctgcgtccggaaatcggcaaggtagaaatcgcgccgttcgcctatatgcgcggacgcacctttgaaaatgcggtggtgattctggacgaggcccagaacgtgaccgcggcgcaaatgaagatgtttttgacccgcctcggggagaacgtcacg

SEQ ID NO: 45971 - DNA, 822 bp, Glycine max
  Peptide Sequence Number=SeqID_137656
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgctttcatcatcttattcccttcctacacccactccactttctttcatggatggttactggtggccaccacaatcattgtagccaccaaaaccattgttgttgcaaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 45972 - DNA, 321 bp, Glycine max
  Peptide Sequence Number=SeqID_137657
ggttgggctgttcgcccattaaagcggtacgtgagctgggttcagaacgtcgtgagacagttcggtccatatccggaccgggaaggacgcacctctggtgtgccagttatcgtgcccacggtaaacgctggagcctccggtagcacagccgagacagcgatgggttctctgccccagcggggatggagcgaaagaagttttgagaattcaagagaaggcgtagaggaaccacaccaatccatcccgaacttggtggttaaactctactgcggtgacgatactgtagggagtcctgcggaaaatagctcggcgccaggatga

SEQ ID NO: 45973 - DNA, 720 bp, Glycine max
  Peptide Sequence Number=SeqID_137658
atgactacaccactcagctctcctcctcatcctcctcctcctactaatgcagcatcacattccccttctaccttgaagcggacaagaaaagctacacgtctgagatcattggctactagaccagttagggtaaagcgacccttggcccatgtggatcctgtgaccgggaaagtcgatggtccccacaaaaagaagttaagaacatatttggggatcgtcgctcgtgataaggtggatgtgacatacgagaattggaaacaagtccctactgcccagaaggatttgatatgggaggctattcaggttgaatttgatatccctaaagcatctgatccgaggacaaaaaataaaatacttcaaactatgggggtcaaaaagaatagtttcaatgacactgtatgtgaaaagtacggcattagcaaggagaagtggacccaattttgtcagagccacagagacccttcatgggaggcacaggccattcagaaacaaaacattgcccttcacatgttgtcttatggggattatgaatttctagaaaacaagttgatggaggagaagaaaaagaaacaactggaggaagctgctaaatctgaaagcactaacaccgtcattgatcctccatctcccatcagaagacacgtgaagtggaagatggcccgcaccaagaaaattggccaaatgacgtctgaggcagtaaaggaaattgctgacaagatt

SEQ ID NO: 45974 - DNA, 841 bp, Glycine max
  Peptide Sequence Number=SeqID_137659
aggcctgcacaccttcgccttcagaggagtatacgtcctcaccttcagaggactacacgtcctcacctttagaggactacacgtcctcacctatagagggctacacgccctcgccttcagtggactatacgtcctcaccttcagaggactacacgccctcacctttatagggctgcacgccctcgccttcagaggactatgcgtcctcaccttcagaggactacacgtcctcgcttttagagggctgaacgccatcgccttcagaggactacacgtccacaccatcaaagggctgcacgtcctcaccatcagagggctgcacgacctcaccttcaaaggattagacgtcctcgccatcagagggttgcacgtcctcacatttagaggactacacgtcctcgccatcagagggctgcacgccctcaccttcaaaggactacacgtcctcgccttcagaggactacacgtcctcgccttcagaggactacacgtcctcgccttcagaggactacacgtcctcgccttcaaaggactacacgtcctcaccttcagaggactgcacgccctcgccttcagagggttgcacaccctcaccttcagaggactacacgtcctcgccatcagagggctgcacgccctcgccttcagaggactacacgtcctctccttcagaggactagacgtcctcctcttcagaggactacacgtcctctccttcagaggactaggcgtcctcctcttcagaggactacacgtcctcgcctttagagggctacgcgtcctcgctttcagtgggctccatagccacaccttaagagaatttaaggtcctctacccttaa

SEQ ID NO: 45975 - DNA, 318 bp, Glycine max
  Peptide Sequence Number=SeqID_137660
atgatgtccatttgcagcttttggctctatggctccagttacatctattccccacatggaaaagggccacggcgcggccatgacattcagaggatgtggcggatcattgacattgtccgcgaatgcttaacacttgtggcatttccttacatggacgcagcagtcactttccatggtgagctagtaataacctgccctcaagattttcttggccataacatgcccattggcgtgcgttccaaacgaaccctcgtggacttcctcaatcatgtggttcgcctctttggcatccatgcatcgcaggagaatcatgtcgtg

SEQ ID NO: 45976 - DNA, 244 bp, Glycine max
  Peptide Sequence Number=SeqID_137661
ggcgcacgtgcagacccatgactgcctctaccagttcagccttagcctacatagccagggtttccttccttttccatgccctactccggatcagttcaaggcagaggtcgcatggcccggagattggcccgaggcccaggcaagggaggcgcccgcagaggctcccgacgatgcagatgaggcccgcatggatgaggaaatgaccgatttgctcaatttcttgggagggagcggagccacatga

SEQ ID NO: 45977 - DNA, 405 bp, Glycine max
  Peptide Sequence Number=SeqID_137662
atggaaagggagatgataacaatgatagtagacacattactagtgttcaactatgaaaagatagtgggttacacgccttcaaacattgtcgatttagttttcgccggtgaaagaatcgaagtgggtctgagaagaggtaagtttgattatcctgctttgataaatgggaaaactagggaaaatagagagaatgagaaggaggaaggaacccatgctgtgactgttgtccctacacggccaaatttcccaccagctcaacaatgtcattactcagccaatacctgcctttcttattacccaccacccaatcatccacaaaggtcatccctaaatcaaccacaaagcctacctgtcacacatccaatgccaaacaccacccttaacacaaaccaaaacaccaactag

SEQ ID NO: 45978 - DNA, 414 bp, Glycine max
  Peptide Sequence Number=SeqID_137663
atgaggtgcttcacctttgggaacttacagctatcacccatggtagaagaatttgaagagatcctagggtgtcctctaggggggaggaaaccatacctcttcacaagtttcacacctttttcgccaagaggtgaggcatgcttgcccgctagaaagtcatcgttcatgcacagagaaaggaggggcaaattgggaccaactcttagcaagcaaagaagaagcatctgtcaactggttccctcgatggaaggaaggaagaaccggagttcttatttcatgcggaggatttccaaatgttcccttgatgtgatgaggggttgcatcagctacaatcccattcttgcaataagacaacttggctaccctatgagaggggcgccactagaggatgggctcgcgcctgtcatttcatga

SEQ ID NO: 45979 - DNA, 483 bp, Glycine max
  Peptide Sequence Number=SeqID_137664
atgaaggaagacataggtcacatcttagaccccactcccataggagagaaaaggaaagaaagcctcaagaggctaacattaacctcccatacttccactagaaggataataggacacattacttctcaatgccccaccaagaaaaacatgattctgaggggccaagacattcatagtagccaagatgaggctactacttcacctttctctagtgaaagtgaagaagcaaaaggggaagaatctagtgaagaaatctacccccaagaagaaggacaacctttaatggttaaggaggagtataaagaggtgagtgtctcctccaagaggttagctaagaaggacagtcattttgaaataaagacaaatattaaagaaacttcccctcttagacaacctccacatcttctcctttgtaaaaagatacttgttagcactgccacacctcttgggcttgaggttattcctcaagtaaagaatttgtag

SEQ ID NO: 45980 - DNA, 480 bp, Glycine max
  Peptide Sequence Number=SeqID_137665
atgaccggtagattgttggtcggatcatcaacttttgataatcgcatcatgcactacattattgttagaattttgcttccccggtcttcaaatttggctcaagcctctaaggaggatttgattttgatgtgggctttccttaccggtcgtcagatcgattgggctcacttggtttggtatcgaatgcatgaggcattacggcattcctttgctattggtgctggtgcagtgacttcttttggataccgtaaggatcggaatggtcaatggctgaagaaagatgcacttcctcctcaagatgagcgtattccttctcctcctcctcagcgagatgattcggccctcatgactgaagttctttccgaattatggggtcttcgtacttatgttggcgaacattttgattctctggatactcgctttgccggcatggatatccgtctcacacaacttgaaaaagatgtgggttatatttgttag

SEQ ID NO: 45981 - DNA, 807 bp, Glycine max
  Peptide Sequence Number=SeqID_137666
atggaaaaacggctttgccgcggccctctcacttccctgttaagtatcttcctggcatcttccaggaaatctccgccccgtttcgcccaatacgcaaaccgcctctccccgcgcgttggccgattcattaatgcagctggcacgacaggtttcccgactggaaagcgggcagtgagcgcaacgcaattaatggaacaaaagctggtaccgggccccccctcgaggtcgacggtatcgataagcttgatcggccaggacctgctggaggcgatcacgccgggcgccaacctggcgcccggcggcagcgcgctgatcggccaattgctggacctggccacggccagcctcgcaccggccgcgcctgaagcggcgctggcaccggtgctggccgaaatcgccctgctgcaccagcgcgccgccagcggcgacacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 45982 - DNA, 216 bp, Glycine max
  Peptide Sequence Number=SeqID_137667
ggcaaggatggacattctcaccctgggtcaaggtttatggtaagttgggattttggctcaaggcttgtagaacggctggacatgatatatgccagggccatccccaggctgtcgtggtgtctcgccctgtgcctacctgggggtgcagtacttcttgatgaaagctcagttagtagggcgcctgatgaccttgctggggagataggcactccgtag

SEQ ID NO: 45983 - DNA, 1056 bp, Glycine max
  Peptide Sequence Number=SeqID_137668
atgaaatgtcctgcaattctggcgaatgagcaagaacggttagccgcattatatgagcacggcttagatgatgaagggctgattcccagcctggatcctattgtccagatcgccgcacgtatgtttgatatgccggtggctgcggtcaacatgataggcagtgaccatgtgttttttgccgctagtgttggcattggtgaaaccgatatgcggcgtgatgtatctttttgcggccacgccatcaaccaactagagattatggtggtgccggatgccgcgcaggatgagcgctttcatgacaatcccttggtcactggcgacgcaaatgtacgattttatgcgggtgttcctctgcgttctcctggcggtcttgctctgggcgccttgtgtgtgctcgataacaagccgcatctaaacttttcagaagaagatcaacgccgcctgttggagcttgcacgtattgtgtctgatcgcctcgagctccggcgtatagaaacctccagcaaccgccaccgcccaacctttgaaaagtatgccggtaattcaaccacgccaattgtatggtttgatgagcgtcttaatatcattgcatggaatgctgctgcggcactttcgcacggatacagtatgccagaaggggcagggatgggcgtggataggctggttcttgagcgtgatcgtcctatcctacaggagaccatcgcaaaagccgttgcagccgataccgtggggcatctggataccttttctgaaattttcggcctgcgcaaagatggcaccaagttcctggttggtttctccttatttgcctggaaagaggctggcaaaatgcggtttgaagccagcatgaaagatattaccgagcagcgaatggaagaagctgagttgcgcttgcgggccaatgttgacttgctgactggcctggcaaaccgtgggcgattttaccgtgttgtcgaagatacgttgacggtaccaaaaacagcggccgtgtttatgatagaccttgacggctttaaggatgtgaacgataccttgggtcatacgctgggcgataat

SEQ ID NO: 45984 - DNA, 810 bp, Glycine max
  Peptide Sequence Number=SeqID_137669
atggatttggggatgaccggccctctcgatgagtcgatctcttgctttctcataagggtggaccccttgggactacacgtcctcgccaacagagggctgcacgccctcgccatcagaggactgcatgtcctcaccttcgtagggctacacgccctcacctttagaggaccacatgtcctcaccttcagagggctacatgccctcgccatcagaggaccacacgtcctcacctttagaggaccacacgtcctcaccttcagagggctacacgccctcgccatcagaggaccacacgtcctcaccttcagagggctacacgccctcgccatcagaggactgcatgttctcaccttcagagggctacacgccctcgccatcagaggactgcacgtcctcaccttcagagggctacacgccctcgccatcagaggaaaacacgtcctcaccttcagagggctatacgccctcgccatcagaggactgcatgtcctcaccttcagagggctacacgccctcgccatcagaggactgcatgtcctcaccttcgtagggctacacgccctcacctttagaggaccacacgtcctcaccttcagagggctacacgccctcgccatcagaggactacatgtcctcaccttcagaggacctcacgtcctcaccttcgtagggctacacgccctcacctttagaggaccacacgtcctcaccttcagagggctacacgccctcgccatcagaggaccacacgtcctcaccttcagagggctacacgccctcgccaacagaggaccacacgtcctcaccttc

SEQ ID NO: 45985 - DNA, 627 bp, Glycine max
  Peptide Sequence Number=SeqID_137670
atgcgcaagtttaacgttcccgaagataaactggcctccctgagtgtggagaatatccttattggcgatctcagccagccggaagccttcctgaacgatccgcgtctggatcaggtcacacatgtcgttaactgtgcggccgttgcctcatttggaaataacccgctgatctggaaggtcaacgtagaaggtaccctggcgctggcgcgccgcatggagcaggtttcaacgctacagcgtttcctccacgtcggcacggctatgtcatgcacgccagaacaggattccctggtcgccgaaagcgctgaattcagagagaatgctgaacatctggtggaatacacctggtcgaagtcaaccatcgaacagctgatgcgccaggcgtgtccagacctgccgctgcttattgcccgtccgtccatcgttgtcggccatacccgccacggctgcacgccatcgagcagcattttctgggtctttagcatgggtctgatgctgcagaagtttatgtgctccatggaagaccgaatcgacgttgttccggtggactactgcgccgatgcgctattaatgctgcttcacagcaactgctcgtccgggggaagtggtgcatatttcggcgggtga

SEQ ID NO: 45986 - DNA, 171 bp, Glycine max
  Peptide Sequence Number=SeqID_137671
atgttttctcggttggacctgaatcagaagggagaggccttgacgcactcttcggagtgtaggccttgggggcgcctgacgaggtttttcactaacatgatggttaggtggatgactatgaagaacatcatgctagaggacacaaaaacacaatgctctgataggatgtga

SEQ ID NO: 45987 - DNA, 414 bp, Glycine max
  Peptide Sequence Number=SeqID_137672
atgggaacaaatcaaactggaaaaaggttctatcaagtcaagattaagggcctagatgtcaccagccttaaggagttagggtggttgatgggacctctccaaatgcaagccttccacaaggcgtacggaaagattttagatttgaccatagcagagatattcatggaagttgttgtatcactcacccaatactatgaccagcctttgagatgcttcacgtttggagacttccaattagtaccgactgttgaagaatttgaggaaatactaggatgtcctcttgggggaagaaaatcgtatcttttctccgggtttcttccctccttgagcaagattgcagttgaggtcaggaattcggcaagagagttggatcgtgtaaagcaaactcgaaatggcgtagtgggcataccatga

SEQ ID NO: 45988 - DNA, 702 bp, Glycine max
  Peptide Sequence Number=SeqID_137673
atgaccacttttacatggatatggatgacgttgctatttagtaacattctgtccggtgaccacaatgccaatctccccctgcagatgtatcggttgggatcgcgcccacaagacgcccagtgggcccgaagaagtccaacagggccctggggtttccagctctgtttacgggcctctgtcagtcctacagggtgcccgttcccccaacaaggaatcgcacccacaaagacacccagtggacccggagaagtccaacagggccctggggtttccagctctggttacgggcctctgaatcgcccccacaaagacacccagtggacccggagaagtccaacagggccctggggtttccagctctggttacgggcctctgtagtcctacagggtgcccgttccctccggcaaggtcacgtcatcataggatcgcgcctgcaagacacccagtggacccgaagaagtccagcagggtcttggagttgtcaagctctaattacgggtctctgtcagttctacggagtgcttgtcacctccagcaagggcatcagaccccctactaatcgagctttcatcaagaagtactgcgtccctaggcaggcgcagggcgaaacaccacagcagcctgtggatggccagcagcgggcaacagacgcaccgccatcacctctagagttcgcctcagctcatccacaaaaaggttag

SEQ ID NO: 45989 - DNA, 765 bp, Glycine max
  Peptide Sequence Number=SeqID_137674
atggccaatcaaggagattgggtcccgtttatggatgtgttagctttgctaatttttggggtcgtcctctttccaaacgtagatggtttggtggacctagcagcaatcgacgctttccttgcataccaccatagcaaggaaagtccggtggtagctgtcttggcagatttatttgacacatttaaccgaaagtgcgaaaagagtagcgcacggatcatctgttgcttgcccgccctctgtgtttggttggtttcacacctgctccagcaagacacgaggcatccatgtccgctccagagccatcgctcgtgtactgaaaagagaagaatagattgggaccagcttttgactgggataggaggtagaacaatcaattggttccccccgatggaaggaaggaaaggagggagtccttttctcatgtggagggtacccggacattccgctaataggaatgaggggttgtatgaactacaatcccgcgctcgctataagacaactagggtaccccatgaggggagctccgacggaagaaagcatgtctccagttccttcgaagagagtatcgaagcaccggaagaggacgaagaagtccaagccctcaaaagcgagctaggcaaggcgaaacttgccaaagagaagttcaagttggccgctacacacatccggaaggagtgtgccggattacgggaagagaatgcaacaaccgcgagagcccttgtacaagagaccaagagggctcgcataggaagagtatggccgtaa

SEQ ID NO: 45990 - DNA, 574 bp, Glycine max
  Peptide Sequence Number=SeqID_137675
atgagtcatcattcatctagtgttaatggcgagggtactagtcataaagaccctttatctagaatcttagatgagttgagttccctcaagttatggaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaaaagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttcgaagcccaaagatgataaggggaaggcaatagaaaagcaagcccataagacta

SEQ ID NO: 45991 - DNA, 897 bp, Glycine max
  Peptide Sequence Number=SeqID_137676
ggtgcgcaagcagctcgatgacgcgatcccggaaacaccgctggaacagcggcggctgctgatcgacgtcatcaccacggccgcccgcgccgatcgcaccctggaggaccagtccagcgccttcgacgcgttacggaacttggtgatcaacgcgcccgccaagctggacaccctcacgcaacaggtggtggccgtcaccgcccggctaccggagtccgaacggattctcggccagctgcgcaccgaattcgatgccgcggcattggcatccatcggtgacaacgtcgccgaggccaccgagcgtgtccgctttgccgattcccgcatcacgcacgggcgcgaactggcggcccgcgccctggagggccagcagatgagcctcgtggatgccatccgtggtgccgaatcggcgctgacgcaggccaacgccctgctggacgcgatcgacaacgccgccaacaacatccgccacgccaccgactcgctggccgcgtccatcgctgacacgaaatccgatatcgcgcaggccgaagaattccagcaacaaggcaggctgccgtcctcggaggagttggccaaggcgcacgacgccgccgtggcggccgtcgccgacgccgagcgcatcggcgcgaccgacccgctgaccgcgttcactcacctcgctgccgccgatgcacagctggacaaactcttggcgacggcgcaggaagacagggcggccgcggaacggcgtgcccgcgtgctcgatcaagcgctcgtggccgcgcgccagcgactggacgcggtcaaccagtacatcggcctgcaccgcggtgccgtgggagccaggacgcgctggaatctggacgaggcacagcgccgtctggccgctgccgagcagagccgggcctccactcc

SEQ ID NO: 45992 - DNA, 260 bp, Glycine max
  Peptide Sequence Number=SeqID_137677
gtcgactctagaggatccccagttaggtctagccatggcccacgagcatagaatcgcggatgagtatgctcaagtatatgcggaaaaagaggctagaggaagggtgatcgactctttacaccaagaggcaaccatgtggatggaccggtttgctcttaccttgaacgggagtcaagaacttccccgcttgttagccaaggccaaggcaatggcagacacctactccacccccgaagagattcatgggcttctcggctatt

SEQ ID NO: 45993 - DNA, 183 bp, Glycine max
  Peptide Sequence Number=SeqID_137678
atggaggttgatgaaccttggctagggttatggctaccattgaattatcaagtagatatgggagcaagctttgtggttgatttagggatggcctttgtggataactgggtggtgggtaaggagaaggttggttattggctgagtaatgacattgttgggttggtgggaaacttggctgtatag

SEQ ID NO: 45994 - DNA, 1022 bp, Glycine max
  Peptide Sequence Number=SeqID_137679
ctgtccctgaagctgatgaagatgtcccaacatcttccaccccgaatgtttctgtgcctgatgttgagaaagatgttccaacatcttccggcccaaatgctgaagtactctcttcccccagcaaagagagatcaacagaggaagatgatcaagccacagaggagacccctgcaccacgggcaccagaacttgctccaggtgacctcattgaccttgaagaagtagaatctgatgaggaacccattgccaacaggttggcacctggcattgcggaaagactacaaagcagaaaaggaaaaaccccccttaagaggtctggacgaatcaagactatggcccagaagaaaagcactccaatcactcctaccgcatccagacgaagcaaagtcgcaatcccttccaagaagaggaaagaaatttcctcatttgattctgatgatgatgtcgaactagatgtctcgacatcaaagagggccaagacatcagggaaaaagacttgctgtgaaagagaactgggaagaactgccttggattgcaaggagatcatggaacttatcaaggctgctggactactgaagacagtcaccaagttgagagactgttatgaaggcctagtcagggaattcattgtcaacattccctctgacatatcaaacagaaaaagtgatgattatcaaagagtgtttgtcagaggaaagtgtgttagattctcccctgctgtgatcaacaaatatctgggcagacctactgatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacagacattgtctcgacatcagggaaagctgctgcttcaggtgctgtgtccaaggatgctctgattgctgaactcaaggacacatgcaag

SEQ ID NO: 45995 - DNA, 488 bp, Glycine max
  Peptide Sequence Number=SeqID_137680
ggtggacccttgggtactagaacctgttgcctttagaggactacacgtcctcacctttcgagggctacatgccctcgccattagagggctacacgccctcaccctcagaggactacgtgtcctcgccttcagagggctacacgctctcgccttcattcctgggccaccccctgatattggaggagggccaattgtgcgagcacaaccagggagggaggctatcacgcagctactatgcataccggggcaagatttcacccgtgccgctgtaaagagacaagtgtggatcatgcgcatcaacatgaccactgtcgcaacgtgcccttctgcgggcgagcgagggcgaggctcacgagtgcgctttccaaaggaggaaagatgtgcggagtcgccaccaacgtttatttgtgggaaacgtcggaaaaaccgaaggaaactggtcgaaatgaaaattcaaagttcgggagttgtatttacgtttgaggaag

SEQ ID NO: 45996 - DNA, 312 bp, Glycine max
  Peptide Sequence Number=SeqID_137681
atggacattctcaccctgggtcaagaagaaggaacagtcgggtctcccaaggaagaagagtcactcactgatgagccgccaatgcacttcaaaagaaaaagaaaagttcccgatcaaagatcggaagaaagcaaaaagaagaaaaattcccaattcaaagattggaagaaagcaaaaaaagaaaggaaattcctgatcaaagattggaagaaaacaaaagaagatatccagaaaggtctttggaccagacaatatctaaacaatacagaattgtcacaagcaaacaagaaaagaaaggaaaccacgacttga

SEQ ID NO: 45997 - DNA, 148 bp, Glycine max
  Peptide Sequence Number=SeqID_137682
catatcagatgttcctcagatgaaaacaatgatccagagggaatggaggaaggaatcggcgtttcctgtgacccgaaatgtcattgactctgactcgaagtgccctttcgcttctttgatggtttcgccatttgaagagattatttga

SEQ ID NO: 45998 - DNA, 780 bp, Glycine max
  Peptide Sequence Number=SeqID_137683
atggccaagttcgatccagaagtagtccttgagttttatgccaatgcttggccaacagaggagggcgtgcgtgacatgaggtcctgggtgaggggtcagtggatcccgtttgatgcagatgctatcggccagctcctgggatatccgttggtgctaaaagagggccaggagtgcgagtatggccagaggaggaaccggtctgatgggttcgatgaggaggccatcgcccagttgctatgtatggtgcctaccaggcaccctttggatccagataagtcgaaccgggccctgggatttcccgcgctgatcacaggactctgccagtcgtttggagtccccgttacacctaccaaggtgattcggccgcccatcacccgggcttttatcgagaagtactgcacccagagacaggctcagggggatgctccacaggccgcgggcgcgccaccaccacctcatcaggctggcccggctgggtcatttgacatggagcagtatttacggcatttggttcgccagcaggcggccaaccaccgggcacatgtacagacccatgattgtctgtaccagccgagcctcagcatgcagagccagggcttcgcttctttttcatgccctactccagaccagttcagggcagaggtcgcatggcccagggattggcccgaggcccaagcaggagaggcgcccccagaagctcccggcgatggagaggaggcccacgaggacgaggagatggccgatttgcttgacttcttgggagggagtggagctacatga

SEQ ID NO: 45999 - DNA, 383 bp, Glycine max
  Peptide Sequence Number=SeqID_137684
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaagagaaaaaaggctgcaccggtgcgtcagcaaaatatgtgatacaagatatattccgcttcctcgctcactgactcgctacgctcggtcgttcgactgcggctccgcccccctgacaaacatcacgaaatctgacgctcaaatcaatggtggcgaaacccgacaggactatcaagataccaagcatttaccactggcggctccctcatgcgctctccagttccagctattcggtttacag

SEQ ID NO: 46000 - DNA, 582 bp, Glycine max
  Peptide Sequence Number=SeqID_137685
atgtgtcccggtcggatgtggaacggtgagagccggtccgccgatcgactcgggacattgaccgacgcggattgcgatggtggcccaagcccgggcttgttgatatgctcgtggaagacgtcatcatcgcgattgtggatggacgcgcgcccttggcgtgcctcggcacctgcgcgctgccatccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcaacacatccccctttcgccagctggcgtaataccgaagaggcccgcaccgatcgcccttcccaacagttgcgcaccctgaatggcgaatgggacgcgccctgtagcggcgcattaagcgcggcgggtgtggtggttacacgcagcgtgaccgctacacttgccagcgctgatgtccggcggtgcttttgccgttactcaccaccccgtcagtatctgaacaggagggacagctga

SEQ ID NO: 46001 - DNA, 354 bp, Glycine max
  Peptide Sequence Number=SeqID_137686
atgacagtacttcagatccaaataagcacttggatgccttcaccattcactactcaggtgtttcccacctccctcaaaggaccaacacttacgtggtacaagggcttacctccatggtctattgactcattctcgactttagcccaacattttcggagtgcacctttgtcggaaacaacccaaggatttggacgagcttcaagcacgagtggtgggatacatccaaatggagttgtttactttctgcaaccagatgcgctgtacggagtagagaaaggaagaccacacgaaacctatctgatcgaggccgtacccgaatcaaataaaaatgaaaatgcagtaactaggaagtga

SEQ ID NO: 46002 - DNA, 201 bp, Glycine max
  Peptide Sequence Number=SeqID_137687
atggttatccgcacctttcgtcaaccaggggaaaacgagcccattgacgcgcagagactaaagtcgtcttctgcaccttttgtcatccagggacagcgagtcaagtggcaggcaaagataccttatggtcatccgcacctttcgtcaactgaggcgaacgagttcgacggtatcaggatgatgttggtcgtccgattctga

SEQ ID NO: 46003 - DNA, 425 bp, Glycine max
  Peptide Sequence Number=SeqID_137688
gacacgctttacggcgcccttaccgaactcgtgctagagctagagtaatgggtgaagcagaggaggtgcaagagaagatgaaggccgacatgggggccatgaaagagcaaatggccacaataatggaggccataataagcatgaagaagacaatggaagccaatgcggttgcaattgccgctaccagcgttgttgctaaggagacacatgaaattccccatcacaatctagccgacttcgagccttggctcggatatgccactgaagggcaagcagttggtggtataccctttggaaacactttggagggccctcagtttcgcccacaaccacaaccattgcatttttgcggtgggaagaaccctcatgactatggcaggaatgggaaagttggatcatctagaggaaaggctcagggccattga

SEQ ID NO: 46004 - DNA, 60 bp, Glycine max
  Peptide Sequence Number=SeqID_137689
gtctagtcattctacaagccttgagccaaaatccaaacttaccataaaccttgacccagg

SEQ ID NO: 46005 - DNA, 288 bp, Glycine max
  Peptide Sequence Number=SeqID_137690
atggaagacctagagaggagtaggcatcatcaaccaccctattcttctcaagggagtgatgatgactacgaagaaggtaaaaggcatatgcataggaggaataaggatggaatggatgatgtgaaggtcaaaattccgacgtttctagaatttgaaggatatgcattggtgtggtggaatcaaatccaagtggatagagaaagattgagaagacatagagtggacacttgggtggtcatgaagagaatcatgaggaagagatttgtcccacttcactatgtaagataa

SEQ ID NO: 46006 - DNA, 303 bp, Glycine max
  Peptide Sequence Number=SeqID_137691
acttatcaaggtaatccttgtggcgtctatcctgacttatcttccttcaccggaagtggcgtctacccagacttatcttccttcaccggaagtggcgtctaccctgacttatcttccttcaccggaagtggcgtctacccagacttatcttccttcaccggaagtagcgtctatcctgacttatcttccttcactggaagtggcgtcatccaaacctccgtagcatgtatcaaacgttccgcccctaagattcacatcataacttatgaccatttgaatttctcgaaagattccattgtttaa

SEQ ID NO: 46007 - DNA, 465 bp, Glycine max
  Peptide Sequence Number=SeqID_137692
atgagacagaatctccacctaaggagcccaatcgtgaacaaccaaaccacgacgctctcagaaaaggaaaaaatgagaatcttcttcatttactctgttataagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgctctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46008 - DNA, 537 bp, Glycine max
  Peptide Sequence Number=SeqID_137693
atgaccatgattacgccaagctcgaaattaaccctcactaaagggaacaaaagctggtaccgggccccccctcgaggtcgacgattgctcttgctgcaatccaggagatggcaagtcatgtacctactattgcacccatcatcagtgcatttattacagatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46009 - DNA, 420 bp, Glycine max
  Peptide Sequence Number=SeqID_137694
atgaggccaaagctcatgagcagtgcaaaagagagactctggccgggggggtgcgaacacgcgactgctgcgggtcatgccgctcagccccgtgatattggttaccttggccgacagcgtgctgatgttggtggcttcttccttcctttcgcttggaggcgcatacctccatggaactgtgtggttgttttggtatggaaacggaataggtctaactaccgagggggcctcgtagataaaccttctaggggtcgtcacgtccttcaaaggtttggacctgcgcggcctacccgactcgacggcattaaccgctccccctccatgattggcaagcgggttggtttttacgttgggtcagtcctcttgaaaggtcagccatccggcttctatcaaactttggatcttgtgcttaaaggctag

SEQ ID NO: 46010 - DNA, 867 bp, Glycine max
  Peptide Sequence Number=SeqID_137695
atggccaagttcgatccagacatagtcctcgaattttatgccaatgcttggcctacggaggagggcgtgcgagatatgaggtcctgggtgagaggtcaatggatctcgtttgatgcagatgctatcagccagctcctgggatatcctttagtgctggaagagggtgaggagtgcgagtatggccagaggaggaaccagtccgatgggttcgataaggaggccatcgcccatttgctatgtataccggggcaggattttgcccggactgctgccgggagacgggtgcggatcatgcgcaccaacatgaccaccttgactcagatctggatgactttgctgctcagcaacatccagtccagcgatcataattccgacctccccctgttgaagtgtcagctggtgtatgccatcctgacacggatgagcattcacgtggctcagttaatcgctgatgccatctatctatttgcaggtatggcgccaaccaggcaccctctggacccggataagtccaacagggccctgggatttcctgccttgatcacgggactctgccagtcgttcggagtccccgtcgcacccagcaagagcagtatttgcggcatttggttcgccagcaggcggccaaccactgggctcatgtacaaactcatgattatcttttaccagatgagcctcagcctgcagagccagggttttacttattttccgtgccttactccggaccagttcagggcagaggtcgcatggcctgaggcccgggcaggagaggcgccagcagaggctcccgacgaggcagatgaggccctcgaggacgaggagatgaccgatttacttgatttcttaggagggagtggggccacctga

SEQ ID NO: 46011 - DNA, 954 bp, Glycine max
  Peptide Sequence Number=SeqID_137696
atggcaagccaagagaagtgggtcccgtttgcggatatactagctttgctgatctttggggttgtcctctttccgaacgtggacggtttggtggacctagccgcaattgatgctttccttgcatatcaccatagcaaggagagtccagtggtggctatcttggcagacttatttgatacctttgaccgaaggtgcgagaagaatagcgcacggattgtctgttgcttacccgctctctgtgtgtggttggtttcgcacctattccaacaagacataagacgcccttgtccgcttcaaagttatcgctcgtgcgtcgaaaaaagaagagtcgattgggaccaacacttggctgggataggaggcagcacaattaattggtttcctcgatggaaggaaggaaaggagggagttctcttctcatgtggggactaccctaatgttccattgatagggatgaggggttgtattaactataatcccgcacttgccacaagacagctagggtaccccatgaggggagcgccaatggaagagagcctctcgcctttccttgtgagagatttcggcgcgcaaagtcttaaggttatacaaagagtccacaaggcgtggagaagtccgttgaggaaagacaaagagcttaggggcatccgtaatggcgtcatcggtggttatcatggatggctaagagttcatacgcgagggttagattggctctccaagttgaaagttatcaatgaggagaacttcgaaactccagaggaagatgaagaagtccaagctctaaaattagagctagggaaggcaagactcgccaaagaaaagttcaagtcagccgctacaaatatccggaaagagtgcaccgagttacgagaggaaaacgcagccactgcaagagcccttgaacaagaaaccaaaagggcccgcaaggaggaacatggccgagagaaattctga

SEQ ID NO: 46012 - DNA, 393 bp, Glycine max
  Peptide Sequence Number=SeqID_137697
atgtggattgtatgtcaaagaaaatccccccgcctggttgccataggaagactttataaggggtcggcaactgttcacaacatctctttgtgcaatgatcaagtcaaggttggtgttgaggaagttagagatgtagatgctcccattcttggagctatggaaccagtgaaacctgcagttaggtcggatcatgatgtcaatgataccctatatctgatgacattgaccatcccacaactttttctaaagttgttgcatgttatgtgggatgctaccgtgtttggggtgtttaatgacaacttctccttgtacataaagcatgaagatctgtctaaaatagcacatagtggtcaatgtctaagcatctatgttatacaattatggattctttaa

SEQ ID NO: 46013 - DNA, 108 bp, Glycine max
  Peptide Sequence Number=SeqID_137698
atggctggatctactactacctcgtccattgagtataacagagcaaatgatggatttattttcgttgatcggatcgagcacatagggtgcgagcccgaagtcaattaa

SEQ ID NO: 46014 - DNA, 352 bp, Glycine max
  Peptide Sequence Number=SeqID_137699
atggatgaccctgccataccattcacaacattaagttcgagaatcaccccgagtttaagaacccacaccattatgaatcttaccgaattaaagaatacgccggtttctgagctgatcactctcggcgaaaatatggggctggaaaaccaggctcgtatgcgcaagcaggacatcattttcgccatcctgaagcagcacgctaagagtggcgaagatatctttggcgacggtgtgctggagatattgcaagacggatttggtttcctccgctctgcagacagctcctacctcgccggccctgacgacatctacgtatcccccagccaaatccgccgtttcaacctccgcactg

SEQ ID NO: 46015 - DNA, 231 bp, Glycine max
  Peptide Sequence Number=SeqID_137700
atgcaaggtgctggaagcacccatcaaagccaccacagagaagatggagctggaacggctgatcaaaaggctctcagaagtggcattgatgatggagaagcagctgagcaagaagatgaagcagctgaggaagaggtagaagcagccgaggaagaagaagaagctgctgaggaagaggaagatgcagcagaggatactgaatcagatgatgattctgaagccaccccatga

SEQ ID NO: 46016 - DNA, 438 bp, Glycine max
  Peptide Sequence Number=SeqID_137701
atggtgaaagttggaacctcttacgtgccgatcaacgtctcattttcgccaaaagttggcccagggaacttcccggtatcaagtgggagcagccaggattacagcccgtttattgcagaacggctcgcgtcacagtatcttatcgataccgtcgacctcgagggcggcaagtgtaaagccggggtgccaagagctgagctaactcaccttacacccttgccgttgcgctcaactgcgccgctttacgggaaacgctgtcgccattcgctgcattcaagagctgcgcaactggcgcgaagggacgatcgggcgggctttgcgtattacgccagcggcgaaagggcggagtgtgcaacggcgattaatgttggtgtaacgccagggtgttcagtcagaagcgttatgtggcagaaaaagcgacggccagtgaatatgtga

SEQ ID NO: 46017 - DNA, 857 bp, Glycine max
  Peptide Sequence Number=SeqID_137702
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatctcttataccttcttccatggtctttggatgaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46018 - DNA, 162 bp, Glycine max
  Peptide Sequence Number=SeqID_137703
gctaagttgctcgctatgcgagcagagtttccacaagtagcaaattggttggatcaaattcctaagagtaaatggactcagacctacgatgaaggaaaacggtatgaccatatgactaccaaccttgttgaatgtatgaattctgttttgaaaggagcctga

SEQ ID NO: 46019 - DNA, 1296 bp, Glycine max
  Peptide Sequence Number=SeqID_137704
atggatcgcatgaagcaaactcggaacggcgtagtaggcctgcctcggaaatacttggaaggcaaggcaagggatatggcgagccaagagaagtggggcccgtttgcggatatattagctttgttgatttttggggttgtcctctttccgagcgttgacggtttggtggacttagccgccattgacgctttcctcgcatatcaccatagcaaggagagtccagtggtggctatattggcagatttgtttgacacctttgaccggaggtgtgagaaaaacagtgcacggattgtctgttgtttacccgttctctgtgtgtggttgttttcacacctattccaacaagacataagacacccgtgtccgcttcaaagttatcgctcatgcgccgaaaaagggagagtcgattgggaccaacatttggctgggataagaggcaacacaatcaattggtttcctcattggaaggaaggcaaggaaggagttcttttctcgtgtggggactaccctaatgttccattgatggggactaggggttgtattaattataatcccgcactcgcccataagacagctagggtaccccatgaggggagcgccaatagaagaatgtctctcgcctttccttgtgagggatctaggcgcgcaaagtctcaaggtgatacaaagagtccacaaggcgtggagaagtccgtgaggaaagacaaggagcttagaggcatccgaaatggcgccatcggtggttatcatggatggctaagagttcacacgcgagggttagattggctctccaaattgaaagttatcaatgaggagaactttgaagctccagaggaagatgaagaagtccaagctctaaaattagagctagggaaggcgagactcgccaaggagaagttcaaatcatccgctacccacatccggaaagagtgcaccgagttacaagaggaaaacgcggccactgcaagagcccttgaacaagaaaccaaaaaggcccgcaaggaggaacatggccgagagaaattccgaggagcattgtggggtagcaacaatgagctcaagctccgaagagaggaaagagaccggtcacgggtgcatggcatgatcttaaaagaagagttagctgcttgcgcaaggtccaagaggagtttggctcaacacttggaagccacggagcaaagcatgctagctatcatagggcaatacaaggaagagttgaaccagtctgtgacccatgaacaaaagctagcgaaggattttgcacaagtgtacgccgaaaaagaagcaagagggagg

SEQ ID NO: 46020 - DNA, 408 bp, Glycine max
  Peptide Sequence Number=SeqID_137705
ggccctctcgatgagtcgatctcttgctttctcataagggttgacccttgggtacttgtacctatcaccttgagaggactacatgtcctcgccatcagaggactgcatgtcctcaacttgagaggactacatgtcctcgccatcagaggacctcatgtcctcgccttgagagggctgcacgccctcacctccagaggactacatgtcctcgccttgagagggctacacgccctcaccttggttaccctcaccgttgagaggactacacgtcctcgccttgagaggactacacgtcctcgccttgagaggactacacgtcctcaccatcagagggttgcacgccctcacctccagaggactacatgtcctcgccttgagagggctacacgccctcaccttgggcactag

SEQ ID NO: 46021 - DNA, 444 bp, Glycine max
  Peptide Sequence Number=SeqID_137706
atgaaaattctagccaagttgcatctttacaagattagtgttgaacactttggttctgactttgcaatggctcaaaggaaaactcattctcctagatgtgaaagaaattggagtgtgtttgagcaaattcattccaaaaaaagaaataggcttgagcacaagaggttgcatgatttggtgtttgtcaaatacaaccaacaattgaagcaaagatataatgcaagagatgaaattgatccaatttctcttaatgatattgatgtgtgcaatgaatggctcgtgggagagatggatgaagatgatgataatgatgctggaaatgatttggtatttgaagatgatgatgctctaaattggacaactgtgtatcaggcttcgggggttggagagcctcaaccttcacttagcactttgcattatgtttttatccttttcttattttga

SEQ ID NO: 46022 - DNA, 810 bp, Glycine max
  Peptide Sequence Number=SeqID_137707
catcaaattgccaaggaaatcactgccaaacgagtccagcattggccgaagaaagggaagctttcagcagggaagctaagtgtgaagtatgcaattctacacaggattggagctgcaaactgggttcccaccaatcatacttccactgttgccacagaatcttttgctatcaaattacccattgccttccctactgtgttgtgtggcattatgttgagtcagcatcccaatatgttaaactacactgactctgtgatgaaaagagaatctcctctatccctgcattacaaactgtttgaggggacacatgtcccagacattgtctcgacatcagggaaagctgcttcaggtgctgtgtccaaggatgccttgattgcagaactcaaggacacatgcaaggtgctggaagcaaccatcaaagccaccacagaaaagaagatggagctagaacggctgatcgaaagactcacagacagtggcattgatgatggtgaagcagctgaggaagaagaagatccagctgagcaagaagaggcagctgaggaagaaggagaagcagctgaagaagaagaagaagctgctgaggaagaggaagatgcagcagaagagacagaatcagatgatgattctgaagttgaatgtatgatgtatagcagtaggatagtaggatacgatgtatgcatgattcatgaccttgagggggagttgtatgaatatgattttgagggggagactgctgctgatgacgactgttgtaagctactagaagatgctgcaggggagcagaagcagaaagctgatgtcatgtga

SEQ ID NO: 46023 - DNA, 315 bp, Glycine max
  Peptide Sequence Number=SeqID_137708
atgacagtacatccggaggaacccgcatgcacgcttcagcagcctgtggagtggatactacatacacctagtccatatcgactagtggagccagttcaagtgatagaggtgtcatcctctcaagaggatcctgaagaggacccagaggagttacctcctgaacctgttgtggatgcccttgacttacctgaggatgatgaagacccactccttaatgttgattttccagaggatatcatgtcaacatcagaggcagactccacagaggagaacggccctggagggacagcgaatagtgacgactcttcatcgtag

SEQ ID NO: 46024 - DNA, 981 bp, Glycine max
  Peptide Sequence Number=SeqID_137709
atgaggatttttctgagctttgacaagtttcttccccaacatgctccattcattagtcgagaagttggcccggcctggttcactgactattttcctgctgtcgatccggacaatgaagaagaagtgaacgaaatatggtcattttacttgaatccacagattctgtcttgccgtacaggtgttcaatcgaactatttaggcctggttggataccagcctaatttggtttcgagacaatttggcctctcgcaaatccgtcctaaaagcttgttcgaagatcctcgagacgttataagaggggccaatctttcagaaaagactttcaagaagtttttgaagatttctcttgatgaaaactataacctgcatccttttgagttcaaccattcccacttctgcaccatggggtttgttacctggtgggagaaatattattcgacccgttcaattggagacactactatcatgatctccagactcgagagtggttttacacaaccaacggtcgagaatattcgctcaaaccttcaagctcaaggcaaaacaatcatgacaaagaaaagcaccgaaacgtctcgagctgatgtgagacccaagaaacccactggggtgaagatccaagaagggaaacaagaagagaaggaagaagaggaaagaccactcataagaaaaagaaagttaccttcgacttcgaccaagtctgctgaacaagcagaaacaggcaattctcaggctcaaatgcctaagaagaaaaagaaagtgaagcaggtcgagtctgaaccttctgtggctgttgagggtggtgagccaatcaagaagaaaaagaaaaagatcaggccatcaaaaaatcaaggtgacaatcaaactgttgatgtccaaccaccttcgaccaatattgacggcactgaagtagaggctactccttctgttgctgagatgggcaaccctgtcgatcaatcggactcacggggatcctctaga

SEQ ID NO: 46025 - DNA, 267 bp, Glycine max
  Peptide Sequence Number=SeqID_137710
atgacccatcgaggtctaaaaaagaagcatgaccggatgacgccgatcgaacatttcccaatcgcggtttctgatgaggacatgaccaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggtagtgagttgtatcatggcccaaatggaggaggactaa

SEQ ID NO: 46026 - DNA, 630 bp, Glycine max
  Peptide Sequence Number=SeqID_137711
atgggacatctccagatgcaagccttccgcaaggcgtacgaaaagattttagatttggccatagcagagatatccatagaagccgttgtatcactcacccaatactatgaccagcctttgagatgcttcatgtttggagacttccaattagtaccaactgtcgaagaatttgaggagattctaggatgtcctcttgggggaaggaaaccgtatcttttctccgggtttcttccctccttgagcaagattgcagatgtggtcagggattcggcgagaggattggatcgtgtaaagcaaactcgaaacgccgtagtgggcctaccacagaagtacttagaaggcaaggcaagggatatggagaatcaagaggagtgggtcccgtttatggacgtattagcattgctaatctttggggttgtcctctttccaaacatggatggtttggtggacctagacgcgattgatgctttccttgcatatcaccatagcaaagagagcccggtggtagttatcttggcggacttatttgatacatttgaccgaaggtgcgagaagagtagtgcacaaatcatctgctgtttacccacctttgtgtatggttggtttcgcacctattccaacaagacataa

SEQ ID NO: 46027 - DNA, 210 bp, Glycine max
  Peptide Sequence Number=SeqID_137712
atgacaccggtaaaccgaaaggcaggaacaggagagcgcacgagggagccgccagggggaaacgcctggggggcggagcctatggaaaaacggctttgccgcggcccggttctcttccctcgagatcttcggctcttccaggttcctgaatggcgaaatgcgggcagccctgtagcgcaagcgcaattaaccggcggtgtgagtggttag

SEQ ID NO: 46028 - DNA, 270 bp, Glycine max
  Peptide Sequence Number=SeqID_137713
atgttaactctacccttcatctctaacagtttccataagcaatttcagcacatcaacatcacaagcatcatcataaaaaccctaaaactgaatggaaacctagcaagactacccatcatatctcccaaagccccatacccacgaaaatcaaaggagaaagaagtccacccaaacctgaaatttcgaagtcccactcgtagacacgcacttcacgactctggaaatgccctccttttgcgatttggagcggaaatgggcaccaaaggttga

SEQ ID NO: 46029 - DNA, 429 bp, Glycine max
  Peptide Sequence Number=SeqID_137714
atgtaccatgttattgctgaggaatttcacttcttcaaacatattatgctcattgtgtcgtgcatatacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46030 - DNA, 273 bp, Glycine max
  Peptide Sequence Number=SeqID_137715
atggacattgcacaatgtcagacctattcctgccttaaagagaaatttatatctatagggcagttgggtgatgagagacatcacaccacttttagagatggagcttggaaggtaacaaaagacaatctcgttgtggctcgtggaaagaagcaaggatctctttacatgattgcagatgaggatatggtagcagttactgagggtaagctatcaagcctcaagcatgttgatgttggtgcttgtgaacattgtatccttggaaagcagaaaaag

SEQ ID NO: 46031 - DNA, 147 bp, Glycine max
  Peptide Sequence Number=SeqID_137716
atgacacaagttggaaggaaaatcagtatccagaaaaaaaaaagggaattggaaggaggattggtgtcatcccttgaagaatctgagtcaagaagaaaggggccaaaaaccttaagagctattggactaagaagcactccaaattga

SEQ ID NO: 46032 - DNA, 770 bp, Glycine max
  Peptide Sequence Number=SeqID_137717
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcactgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46033 - DNA, 519 bp, Glycine max
  Peptide Sequence Number=SeqID_137718
atggaaaagggactttcccatggttcagttccaattattttaggtaggccatttatgaaaatagcccgaaccaagatagatgtttatgttggcacattgtctatggaatttggtgatattgttgttcattttaacattcttgatgccatgaaacatccatctgaggatcattctgtttttcgtgctgagataattgatcagattgttgacgattatatgtttgattttgattttattcttcatgagagtaaatttgaatttgaatctggttctaattttctgggtgttgtacctcttgatgttgattttttagattcagaatgcactaaccatgttgcaagaagtacatacacttctgacttgctttatgaggtacaggctgaggaacctccttcttctcctaccctggttcctcccactgttcagacaccacccacaccagagttgaagccctcaaaatgcttacttggaggacaaggaaaaatttccagtgatcatctttgcctcccttgctgctga

SEQ ID NO: 46034 - DNA, 165 bp, Glycine max
  Peptide Sequence Number=SeqID_137719
atggcttgcttagaccagcagcattctggaaggaagggacaggctgttgttgttgtgggggacttgtccatctcagatttggatgattcctccaacctggattgcatctgttgcttgaaagatcataattattctactgttcataagcttcaggttgctcattga

SEQ ID NO: 46035 - DNA, 573 bp, Glycine max
  Peptide Sequence Number=SeqID_137720
atggaatttggtgatattgttgttcattttaacattcttgatgccatgaaacatccatctgaggatcattctattttttgtgttgagataattgatcagattgttgatgactatatgtttgattttgattctgttcttcatggtaggaaacatccatttttatctaatctgtatacttatcattccttatgcattgaatctgaatctgagtttgaatttgatcctgtatctgatttttatgctgagaatgaatctgaatttgagtctggttctgattttctgggtgctgtacctcttgatgttgattttttagagttagaatgcactaaccatgttgcaggaagtacatatacttctgacttgctttatgaggttcctcccactgttcagccacaacccacaccagagttgaagcccttaccagcaaccctcaaatatgcttacttggaggacaaggaaaaatttccagtgatcatctctgcctcccatgctgctgagaaagaggagaagttgttgctagttctcaagaagcacaagaaagccattggatggactttagcaaacattctttag

SEQ ID NO: 46036 - DNA, 546 bp, Glycine max
  Peptide Sequence Number=SeqID_137721
atgggctacactcaagaaaactgttactcactacatggctctcctgaaaaagtagcacaggtgtctaagtcagaaaaaccggagtccggattctctaatgaaaagtatcaggagtatttgaggctcaagtccgagaagtccagcaatcaagcatcatcctcatcagcaccatgtttttcaacagcttgtgtttctcaattcattggaagtcctagtccttggatacttgactcaaatgcctctgatcatatctctggtaacaagtcctccttctcatccatttctttttcaaaagttcctcaccttgttactgtagctaatggttccaaagttacatcccaaggaagtggtcaagaacatgagacgggtcgactaattggaaaaggacgtgaatcacaaggattttattatttagaatccagctttcctgtgtcttgttttgcatcctcaaaacccaagcttttgcaggatcgtctgggccatccaagtctaccaaagttgaaaatgatgatccctagtctcaagaatcttagagtcttagattga

SEQ ID NO: 46037 - DNA, 141 bp, Glycine max
  Peptide Sequence Number=SeqID_137722
atggggctaaaggcagaaaccaatcaaggtacttatggacgaatgcaagtagaggctagggtcacgatcatagatcgtcatctcatgcccagcactggaccagcgggaagcgctactaggaggcaacctagtaacttttaa

SEQ ID NO: 46038 - DNA, 437 bp, Glycine max
  Peptide Sequence Number=SeqID_137723
ggggcgttgcgccccccggatgccctctaaatccattggctttacccccgatagaactcgcccgcgggctcccagctatccctgagggaaacttcggagggaaccagctactagacggcatagttcaccatctttcgggtcccgacaggtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccatattttgaccgggacacatag

SEQ ID NO: 46039 - DNA, 60 bp, Glycine max
  Peptide Sequence Number=SeqID_137724
gtcgactctagaggatccccggatgatgtcgattaggaaatgttcgatcggcgtcaccag

SEQ ID NO: 46040 - DNA, 198 bp, Glycine max
  Peptide Sequence Number=SeqID_137725
atgacattaggtgctgaattcaatgtggaaagcttaacatgtagagattggaacacatcatcgaaagtatcccaaaagatatgtgttcggttctgtgcaagaaagaaaatgactacctatataagcacgaagtttagccgcttcaagaagctgggacttggctttgatatgcttatgaaggatagggacacaggctag

SEQ ID NO: 46041 - DNA, 141 bp, Glycine max
  Peptide Sequence Number=SeqID_137726
atggctggtatactcttccttttgaaacagcaaaatagtttagagatcacgagtgtcattattttggggacgccacaggatggacctttccagattttggagaggatcaataacaatgcctataggttggacttcccataa

SEQ ID NO: 46042 - DNA, 348 bp, Glycine max
  Peptide Sequence Number=SeqID_137727
atggctcatgagaaccctagggccttcccttggatctttggcccaatcttcttggagtcttctatccaatgcccctgcggggtaggattgcatcacaacccacttgagattttccactctctttgtaaaattccttttacaaagtctgaaccacacagggacaaccctttccttgtgtttaggaatcctctacaacaagagagccatggtctcttaatcccttttcagaaacaagaagaagagaagaagaaatctctcttaaaagagatagattgtacaatgaaaatcaatcaaaattccttattgaatatgcaagtggttgaccaaggaatctttttgagaggataa

SEQ ID NO: 46043 - DNA, 759 bp, Glycine max
  Peptide Sequence Number=SeqID_137728
atgtctcataaaattgcattgattaccggcggtaaccgcggtctgggcaagaatggcgcgctaaaactggccgctaagggcgtcgatattctgtttacctggcgcggtcatgctgaagaagcgcaggcggtcgtgaaggagattgaggcgctgggcgcgcgtgcggtggcgctgcagctggatgtgggcgacagtaagcagttcgatgactttgcggcgcgggtcaaagcaacgctgaacgagacctggcagcgccatagctttgattatttcgtgaacaacgctggccacggtcattacaagctgctggccgaaaccagtgaagatgagtttgatgcgctggtgaatgtgcattttaaagggccgtatttcctgacgcagaaactgctgccgctgatcgccgatggtggacgcatcctgaacatttccagcggtctgacgcgcatgacgctgccgggttcaggtacttacgccgccatgaaaggggcgatggaagtgctgacgcgctatcaggcgaaagagctgggcgagcgccacattcgcgtcaacatactggcaccaggggcgattgaaaccgactttggcggcggtcgcgtgcgcgacacgaaagatctgaacgctcatattgcttcagtgaccgcgctgggccgcgttggtctgccggatgacatcggtgatgccatcagcgcgatcctgagcgatgaaaccggctggattaccgcccagcgtatcgaggcctccggcggtcaggcactgtaa

SEQ ID NO: 46044 - DNA, 882 bp, Glycine max
  Peptide Sequence Number=SeqID_137729
atggatttacgagacctgaaactgtttcttcacctggcggaaagctgccactttggccgcaccgcgcgcgccatgcacgtcagcccgtcgacattatcacgccagattcagcggctggaagaggatgtcggacacgcgctgttcctgcgcgacaaccgcaccgtgacgctgaccgaagccggcgagcggctgcgtcagttcgcccagcagaccctactgcagtatcagcagctgcgccatgtcatggacctgaacggtccgtcgctgagcggcgagctgcgcctgttctgctcggtaaccgccgcctacagccatctgccgccgattctcgaccgctttcgcgcggagcatccgcaggtggaaattaaactcaccaccggcgacgccgccgatgccattgaaatggtgcagtccggtgaagcagatctggccatcgccggccggccggagtcgctgcccgccagtatcgattttacaccgctgggtttgatcccgctggtgctgatcgccccggcgctgccctgcccggtgcgcagccaggcaacgcaggaacagccggactggtcgcagattccctttatcctgccggatcaggggccggcgcggcgcggtattgatgtatggtttcgccgccatcgcattgccaacccgcagatttacgccacggtgtcaggtcatgaggcgattgtgtcgatggtggcgctcggctgcggcatcgcgctgctgccggatgtggtgctggaaaacagtccggaaccggtgcgcaatcgcgtgctgacgctggagaatgtcgagtcggtggcgccgctggagctcggcgtatgcgtacaaaaaaagcggctcggggagccgctgattaatgctttctggcacctgctgtaa

SEQ ID NO: 46045 - DNA, 159 bp, Glycine max
  Peptide Sequence Number=SeqID_137730
atggaggttacatcaccaagggtattggatacaagactccaagaagattgggttagagctgctaaacaagaccgtagggttctcatgaacctcagggaatcttctcaaggaagtttctcaaggaagcttctcaaagaggtgagcttagttcttagaggg

SEQ ID NO: 46046 - DNA, 475 bp, Glycine max
  Peptide Sequence Number=SeqID_137731
atggggacaaggggttgcatcaattacaatctcgtcctcgctataagacaacttggctaccctatgagaggggcaccactaggggaagagcttgcacctattattgcacaaggtttcaatagcaccaacgcggaggcacttcagaaggtccgcaaggcatgggagatggtgcaaaagaaggatgaggaactcagaggcagtagcaacgggcccatcggtggctaccgtaggtggttgaaagcctacatccaaggtctggattggctcccgagtttgagaaccactaagggggtggaagttgaagctctggaggaggacgaagaggtgcaggccctcagggcagaactcgagaatgcccaaacagtcaaagaaaagttcaaatcagcagctcttaagatccgaaaggagaatgccgaactgagagacgtaaatatagccaccaccaaggccttggaacaagagaccaaaagggctc

SEQ ID NO: 46047 - DNA, 315 bp, Glycine max
  Peptide Sequence Number=SeqID_137732
atggctaagtttgaccctgaggtagtcctggagttttacgctaatgcttggcccacaaaggagggagtgcgggacatgcgttcatgggtgaggggtcagtggattccttttgacgcagatgccctcagccaattccttggtgacccgctagtgttggaggaaggccaggagtgtgagttcagtcagaggaggaacagggccgacgggttcgacgaggaggccattgcccagctattgtgcacatcggggcaggatttcacccagaccgctgccgggagacgggtgcggatcatgcgcaccagcatgaccacctag

SEQ ID NO: 46048 - DNA, 183 bp, Glycine max
  Peptide Sequence Number=SeqID_137733
atgactaaagcacgtcaaaagggggtacggaaagggaaagatggaggtggttaccacccatctcggtatggaaagatggaggtggttaccacccaggcgagctgggttgcttccaccagaaggcaccgccttctgttggaaggcccaagtgggcctgattgctatttgtacccccctgtttag

SEQ ID NO: 46049 - DNA, 333 bp, Glycine max
  Peptide Sequence Number=SeqID_137734
atgaattttgcaacgagaaagcctgtagaattcaccccaattccagtgtcttatgctgacttgctcccatgtctacttgataattcaatggtagccataaccccaaccaaggttcataaacctccatttctccgagaatacgactcgaacgcaatgtgtgcttgtcacggagaagccccggggcgttccattgagcattgtagggctctgaagcgtaaggtgcaaggattttcaactttcaccggaagtgggtgcaagccattggtcagtttgctcaagcgacctatgctcctgagtttgggacttccaagaccgttggtgggggtgccgtaa

SEQ ID NO: 46050 - DNA, 468 bp, Glycine max
  Peptide Sequence Number=SeqID_137735
atgtcgcggcgaacaccaagcggcttgcagcgccatgaccgcatcgggagtgactgcatcgggggtcgcgctggatgcgcagtgcctgatcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46051 - DNA, 252 bp, Glycine max
  Peptide Sequence Number=SeqID_137736
atggcgtatcatggtttctatcagctgtttcctgttcagctactgagggaattggttatccgcgtcaatcggcaacaagcactacagccggaacatcagcgggcaaagaaaaaagcgacggccagtgaatatgtgatacgactcactataggcgcgaattgtgagctccaccgctcggtcgatgcggcagcgctgaaatggcccttacacgggctgcggaattcgatcctggatgccaggaagacaacttaa

SEQ ID NO: 46052 - DNA, 449 bp, Glycine max
  Peptide Sequence Number=SeqID_137737
atggctaagtttgaccctgagatagtcttggagttttatgctaatgcttggcccatagaagagggagtgcaagacatgcggtcatgggtgaggggtcagtggattccctttgacgcagatgccctcagccagttcctgggtgacccgctagtgctggaggaaggccaggagtgtgagttcaatcagaggaggaacagggccgatgggttcgacgaggaggccattgcccaactgttatgcataccggggcaggatttcgccagaccgctgcagggaggcggtgatcataactccgatctccctctgccgaagtgtcagctggtgtatgccatcctgacacggatgagcatccatgtggctcagttgattgctgacgccatctatttatttgcaggtatgccacccaccaggcacccactagacccggataagtctgacagggccctggg

SEQ ID NO: 46053 - DNA, 474 bp, Glycine max
  Peptide Sequence Number=SeqID_137738
gtacttatggacggacacaaggagaggctagggtcacgaccaataggtcgtcatcctttgcctagcccgggacaagaggaaaacgccgctgcaaggcaacctataagcgaacgccgacccatagagggccatgcttatgtgttccctaaaaaaaaagtacaggttagctcgcctgggcgagctgagctcgcttgggcgagcaacccttgtacgaaaatggtgtcgcaacatgcccttttgcgggcgagcgaggcgaggctcacgggtgcgctttccaagggaggaaagatgcgcggagtcgccaccaacgaaggtattagcacctctcacgtcgacaaaagcggggctcttgctcctacgtaccctctatcgaagaggaaatcagacctacgtagtccttcaatggtgatttttcaccatggagatgcagcggaaggcaaaggagaagaggagaagggaggcgccatccactag

SEQ ID NO: 46054 - DNA, 306 bp, Glycine max
  Peptide Sequence Number=SeqID_137739
gcaaaggaccactttggggcagttgcaactcgcccaggcgagctgaaacttagtgctaaagcaatgagctcacccagacgagttggtttcttcactataaagctatttagtggcccaggcgagctagaggctagcctgggcgaggtaggctctaggaaaaccaagaaaaagacccttttgtcccctttttttttggtattttttgcattcttggtcaaaacactgaatgatcatctgtttcgcactgtaattgacattcaacaccataagtcgactagcaaggatcaaaagatcaatgaacgatag

SEQ ID NO: 46055 - DNA, 494 bp, Glycine max
  Peptide Sequence Number=SeqID_137740
tttcacatgcttttgccttgaagccttattctattgcatgcaatcatcctacaaatcgcttcaaaggatcttccaagaatcgccccttgtgtgctcattgtgaagtcaagaaacatttttcatcttctgaaccaccacacaaggttgctcaacaagtatctgttgatatgtctcactcaccatcttcctctggtgactcaggttcccagtttcaacttactgcccaacaatatagccaattgatgaatcttttagaaagtcatgctaccaatgttgtcatccctcaaggtgtttcatctgccagtgattctggtgccagcatttatatttcttgttctcttcatcttttcgatcttaccaatcttgtttctgataaaactgtcactctgcctaacaatgatgttatacctatcgttgccattggttcgaagcaagcttgcaagaggattggtagaggggctctcatccaaggtcctttatgtcttagatcttaa

SEQ ID NO: 46056 - DNA, 764 bp, Glycine max
  Peptide Sequence Number=SeqID_137741
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgtccacacaaatgtcgcctaacatcgtcgaagaagaagaagctgacgacgttcatgctaatctcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46057 - DNA, 1079 bp, Glycine max
  Peptide Sequence Number=SeqID_137742
gattcttttgaggagcaggccacacagggatccttcgtccctcatcgacgtcaggatgttctcgccgctgctattggacgtccagagcaccctggatgtgtccatgctgctggatccggtgtcaccatcaatcaatactttggatcggctccacggacgtcccacagcgcttcctccctgcctcctgacgaattgcaacagctgaccaagcaaatcagggaccagctagaggagtccatcatacagaatgtgacgaggcaggtcatggcatccttcagccacttgcagtcccagcttcagtcgcagatgcaatctcagggacttgcagtgcctcctgagcctctggttggtccctccggtcctcgagtgagcacaaaggggagttgcgttgatccctcaggaaacgatcctgagacgggtgactctgacaggtgcggcttgtacatagaagcagatccagcccgcctggttgccatggggagattttatgagggatccactgttgttcataatgctcctttgttgcttggccaagtcaaggtgagtgtggaggaggttacagatgcagatgcttcagttcctgtacccactgatgaggtttccttagaggggcaggcactttacaccttccttgcttggccgacacatctggtcaagtctttatcacagcaggtagctgtgtctccggcaaaaccacctccgaagcctgatccggaggtcgatgatccgctttatctaatgagattgaccatcccagagcttttcttgaggccttatcaagttagatgggatgccaccgtgttcggggtctttaatccagatttccccctctacataaagcacgaagacctctacgaaattgcacacggtggtcaatgtctcagcatatcagtgttacagttgtggattctgaatctcactgaaacatgtatgcgagtggggaattctaatatctatggattcctcgagccacagtccattcagaggtctgggcaatcgcagtttgagtctgaaagttacataaagagttggatgcagagttcacaacgcgatgtctatcttggagcctacttaaatgg

SEQ ID NO: 46058 - DNA, 249 bp, Glycine max
  Peptide Sequence Number=SeqID_137743
atgcccttggggggtaggattgcatcagtaccattgccaacaccaacactggagacaaagaagacagacaaaggttttgagtttgttctcatacctgggcacaaagaagaatgtaggaaggcgtgggaaactcagcaattatcaaatctgggcccttctagaggattctgggcatttccttgcttaaggtggaagcaacctagctcgcctgggcgagctgggcggcaaccacctcccccgttttgttaa

SEQ ID NO: 46059 - DNA, 639 bp, Glycine max
  Peptide Sequence Number=SeqID_137744
atgggtgaagcagaggaggtgcaagagaagatgaaggccgaaatggaggccatgaaagagaaaatggccacaatgatggaggccatgatgagcatgaagaagataatggaagccaatgcggttatagttgccgctactagcgttgtcgctaaggtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatgaggatgtcaataactccacacccatactcattaagagccaacaacctcaatctgatcatgcacatgtctctcgacccatggaggagacacatggaatgccctaccacaatctagccgacttcgagccttggctcggatatgccactgaagggcaagcagttggtggtataccctttgaaacactttggagggccctcagtttcgcccacaaccacaccattgcattttgcggtgggaagagcccctcctgctatggccgaaaagggaaaggcggatcatctaaaggaaaggctcatggccattga

SEQ ID NO: 46060 - DNA, 297 bp, Glycine max
  Peptide Sequence Number=SeqID_137745
ctgtcttcctgtcagtatgaaattgttatccgcgtcacaattcggcacacaagcactacgagccggaagcatcagcgggcaagtgtaaagcctggggtgcctaagagtgagcgtaactcaccacttatgccgtccgcgcttaactgcgccgctttacagggaaacgctgtcgccatcgctgcattcaggatgacgccaactgtgcgcgaagggcgatcggtgcgggcctttgcgctattacgccagctggcgctaaagggcggatgtgtgcaacggcgattactatgttggcactga

SEQ ID NO: 46061 - DNA, 353 bp, Glycine max
  Peptide Sequence Number=SeqID_137746
atggggaatttcatgtgtctcccccacggtttgagagacatgtacatgatgaggttgttagctcttaatgagtatgggagcggggttattgacatcctcattgggagtgtatgccacattgggtggtgtatagttgggaggcaagccatatggccagatgggggcatcgggttcaccttagcaacagtgatggtagcggcaactgcaaccgcattggcttccattatctacttcatgctcatcatggcctccaacattgtggccatttgctctttcatggcctccatgtcggccttcatctgctcttgcgcctcctctacttcaccaattactctagctctagcacaggttcg

SEQ ID NO: 46062 - DNA, 618 bp, Glycine max
  Peptide Sequence Number=SeqID_137747
atgggtgatcaagaggagacacaggaacagatgaaagccaacatgtcggctctgaaagaacagatggcttccatgatggaggccatgttaggaataaggcagctcatggagaaaaacgtggccaccgctgccgctgtcagttcggctgccgaaacagacccaactctcttggcaactgtgcaccatcctccctcaaacatagtaggacggggaagggacacactggggcacgatggcaaccctcatctgggatacaaccgagcggcttacccttatggattgccgcccaactactcaccacccgtcctgcaagacgatgcgggccatattgcttctcccgtccttgaaagagagcctcctcaacagcccgacgaggtccacaaagaccctcaagactatgctcgaagggatgtcgagttctatcccccgatccccgaagggccggcacccagcacgttgcctcagcccaacatcacgacacaatcaatagttttgtccaccgaaggaccgcccccgacaactgaagaaaggaggaagctcgatctcctcgaggagagattgagagccgtggaaggatttggggactatccgttcgcagacatgacggatctttgctta

SEQ ID NO: 46063 - DNA, 422 bp, Glycine max
  Peptide Sequence Number=SeqID_137748
atgagtctgccgcttaatttcataacagagctgggaataacggctggcatagaagtctctcgcacgcaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46064 - DNA, 417 bp, Glycine max
  Peptide Sequence Number=SeqID_137749
atggaggtcaatttcaagcgcataatatatcgagacgctcgaaatttgacaacggaagctctcgagaaattcaaactggtcataacttttcacacggatgtccgattcaggccgcataatatgtcaacacgctcgaaattcaacaacggaggctctcgacaaattcaaatggtcataactttcacacggaggtctgattcaggtgcatattatatggagacactcaaaattgaacaatggaagctctcgaaaaattcaaatggttataacttttcacacggttgtccaatttggacgcataattggtcgagacgcacgaaattgaacaatggaagctctcgagaaattcaaatggtcataacttttaactcagaagtcggattcaagagcatattatatcgagacactcgaaattga

SEQ ID NO: 46065 - DNA, 75 bp, Glycine max
  Peptide Sequence Number=SeqID_137750
atggaggtgggttttgttgtcgatttagggatggcctttgtggataaatgggtggtaggtaaggagaagggttga

SEQ ID NO: 46066 - DNA, 213 bp, Glycine max
  Peptide Sequence Number=SeqID_137751
atggttagggttctacttgaaattctgataccaggggacagatgtcgtacaggatgtcacgacatcacacttcagaacatgcagattaggattgttaacccagttcggtgcaacctcacctacatctgggggctaccaagccagggaggagatccactctcaatagtgttagttcaaggtctaacagcccctgtttacaaccttctcacctaa

SEQ ID NO: 46067 - DNA, 396 bp, Glycine max
  Peptide Sequence Number=SeqID_137752
atggttagaagtcaagacaagttgattacggaaatcaaccaaggtaagacgatgaccggacacgataggccacagattttgtttcctactggcaggaacatagggacgaatgcaagtggggatagggtcacgaccgaccgatcgttgccccttccgggcgttaaacaagcagagaacatggttagctcccctgggcgagctgagctcgcctgggcgagcaacccctgcacccaaattataaaaatgagggaggggaatgttttggcatccaaaaacttcccccccccccctcattcaaaagaaagaacacgaaggcttgcggttcttgctccctcaagccactttcggttgccttttgctttcatttttggtgttattattcactccaacaagtaa

SEQ ID NO: 46068 - DNA, 483 bp, Glycine max
  Peptide Sequence Number=SeqID_137753
atgcaatcacagggacttgcactgcctctggagcctgaggttggtcccctagctgcctgtgttagcacaaaagggagttgcgttgatccctcaccgaccgatccaaagacgggtgactcagacaaatgcgggctgtacatcgaagaaaatccttcccgcctggttgtcctaggaaaagtttatgagggatccacagttgttcacaacatccctttgttgcatggccacgtgaaggttggtgttgagaaggttaaagatgcagaggctcccgttcctgtacccattgacgaggttcaactagtggggcaggcactgaacactttccttgcttggccgacatatctcgtgaagcgtgtattagaacaagcaactgtgtctccatcaaagcctccagataggccggatcctgaggtcaatgatcccctgtatgtgatgacattgaccatcccacagctgttcttgaagcctctctatgttatgtga

SEQ ID NO: 46069 - DNA, 893 bp, Glycine max
  Peptide Sequence Number=SeqID_137754
ggttcagacgtcaattatctgctggtgaaagcgctggaagatgccgggctgaactataaagatgtcacgccggtgtacctgccgccggccgatgcgcgcgccgccttccagaaaggcgcaattgatgcctgggtgatctgggatccctacctggctgaggtcgaagccaacgcaggcgcgcgtgaagtgcgcaacgccgaaggtctggtgccgcactacaccttctatcttgccagccgcccgtttgccgaaaaccacccgcaaacggctaagcaggtggttgacgagttgagcaagctgagcgactgggccaatcagcatcaggatgaagccgccgcgattctggcgaaatccaccggtctggataaatccatctggcagaccacgctgcaacgcctgccttatggcgcgtcacgcatgtcaccgcaggtgtttgcggaacagcaggcgctagcggacaccttcacccgcgtcggcctgctgccggtgaaggttgatgtgcgcagcgcgacatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46070 - DNA, 125 bp, Glycine max
  Peptide Sequence Number=SeqID_137755
atggccgagtatgaggaatgcgccctcgggatccaagcagcaattgacttcaaggtcaaattgctcaaagtatatggagactcggccttggtgattcaccagctaagaggcaaatgggagactag

SEQ ID NO: 46071 - DNA, 222 bp, Glycine max
  Peptide Sequence Number=SeqID_137756
atgagtgtaacccatgttcatgttgtcttcttagatgctttacatgacttgagtcagagtgggagctatgcatggggagctgctgccctagtgcatatgtacgatcatttgaatgatgcttgtgtcaccacgtgcatgtcggtggattgctacgaaggcgactttgaagtccataactacagcgacgtagaggcagcgtctggatcgactcaggatttctga

SEQ ID NO: 46072 - DNA, 258 bp, Glycine max
  Peptide Sequence Number=SeqID_137757
atggtgggttacacaccttcaagttttacagatttggtcttcgccagcgaaaggatcaaagtgggtctgaaaagaggaaaatttaatcatcctgcttggacgactgagaaaactggggcaaatgaagagggtgagaataaaggagaaacccatgctgtgactgtcattcctacgtggccaaacttcccaccagcccaacaatgtcgttactcagccaataacaacccttctccttacccaccacccagttatccataa

SEQ ID NO: 46073 - DNA, 533 bp, Glycine max
  Peptide Sequence Number=SeqID_137758
gtcgcgcatgcgtggcgaatcactgcggctggcgcggccagcggcatcgtaaggtgtgcgggtcagcaggatcggcgcgttgcgggcgcccttgggcaccacgatcaccgtatacagcttggtgccgtcacgcatcggcaccatcaccacgcgcttgtcgtaatcgcgaccgacatcaggggcaacgaagggcttgccgctgatgtccggggtcatcggcggggtatcggcggccagcacggtgctggacaggcaaagggcaatggctacagcgacggcacgcacacgcatggacaacccctcccggcaggaaagcctcaagcctactcctgccccgagccgactgatggcacatgtgctgcccgacgggcacgcatccatctggccgttgtagagccgagcccacgctcggctggggccaccgcaacctccccgaagagcagccgagcctgggctcggctctacaacatcaggctgccgttacttcatgcaacgccagccaacgtccacggccgtcttcctgccgcagcacg

SEQ ID NO: 46074 - DNA, 517 bp, Glycine max
  Peptide Sequence Number=SeqID_137759
atgtatgccacattacagggtattaggaaacgagcacaatcaattcaaaaacacaacaactgccctcacctactttcacgtgggggatatgatttgcttgagaagaaattattagacgagaaaagaaaaagactagaagaggaagcattgttgactgaaaatccagcaagtgttaacgaccccccatctccaattaaaagacatgttaagtggaaggttgcttggaccagggcttatggcaatatgacatctgagtcgacacaggaaatagcagataaaatagactccttagaagagcaggttacgcagggatcctttgtaccccatggtcggcaagacatactgaacactgctattgggcgacctgaccatgggggtcgcgttcgtgcagcgggctcaggtgtcactattactcagtactacggaagggcaacaaggacatgcaacaactcgtccacatccatcactcaacaacaattagatgaagttgttgcaaggcttagggaagacatgagtg

SEQ ID NO: 46075 - DNA, 489 bp, Glycine max
  Peptide Sequence Number=SeqID_137760
atgttggtaagctgcccctcctccgcaccatatgtagaaacagttttccaatccttcgaggtggtgatttgtgcctctgtggaaatgattttgttgctaccttgtctctctaatgcgtccctaatggtgacacgggtaatgctcaggcactgttatgagcccagaatgggtctgggcaaggacagccacgggaatgccgatgtggtcgacattagggggaacccgtacaaatatgggttggggtatgaacccgaaaaaccgggaagaaggaatgcgccgtcaagactccgggcagatagggcatggcccgaccatgtcagccagtgtttcacaagtgccgggataatgtttgaggaaaaggtggcagcaataggagaggagtctccacaagatccgccaagtttcgtacgaccgtgccatcccaattcccaagtggggaactggcgcgtgatgagccagtcggatgcctataccgctgattcaatgtaa

SEQ ID NO: 46076 - DNA, 198 bp, Glycine max
  Peptide Sequence Number=SeqID_137761
atgtatggttctgcttgggccagcagcattttggaaggaaggagcaggctgctgttgttgctgagggctggaccatctgaggttagggtgattcctccatccagggttgtatctgttgctggaaaggttgctgcatggaaaggcaaaggtctgtatggtggtcagcagaggagcacaaaccacaaacccttgcgacag

SEQ ID NO: 46077 - DNA, 204 bp, Glycine max
  Peptide Sequence Number=SeqID_137762
atggaacatacggaatctggggatctcacggtcatgtggctccgcatgccaccggtctcttgggacacggtaacaaaaagtggggtggtcgacaaaagcagggcttttgctcctaccatttcgtttctaaatgaccatttagaggaaacaccgggtccaacaaagataggagaaaatcactcaaagtgtatcaatctcacacag

SEQ ID NO: 46078 - DNA, 267 bp, Glycine max
  Peptide Sequence Number=SeqID_137763
atggaggttgatgaaccttggttggggttatggctaccattgaattatcaagtgggttttatggttgatttaggtatgacctttgtggataattgggtggtaggtaaggagaagggttgttattggctaagtaatgacattgttgggttggtgggaaacttgtgttgggttggtgggaaacttggccgtataggaatggcagtcacagcatgggtttctccctcatcctcaccctcttcatttaccccagttttctcattcgtctaa

SEQ ID NO: 46079 - DNA, 135 bp, Glycine max
  Peptide Sequence Number=SeqID_137764
atgaccctagggctgcaaactcgtcaatcccgtgggggtggctcgcccaggcgagcccagctcgcccaggcgagcccagctcgcccaggcgagcccagctcgcccaggcgagcccagctcgcccaggcgagctaa

SEQ ID NO: 46080 - DNA, 324 bp, Glycine max
  Peptide Sequence Number=SeqID_137765
atggctcaatctccacctcgtgagaggaatcttagggagatggctgcacctgacttcacttatgaaagcttgtgcattcaatatcctgatgaggatgttccatatgttctcgagactggactaatacatttgttgcccaagtttcatggtcttgcaggtgaagatcctcataagcatcttaaggagttccatattgtctattccaccatgaagccccctggtgttcaggaagatcatatctttctaaaggccttttctcactctctggagggagtggcaaaagattggctgcactaccttgctcccaggtccattaccagttga

SEQ ID NO: 46081 - DNA, 147 bp, Glycine max
  Peptide Sequence Number=SeqID_137766
atgaagaagatcctaggcctacaagctccaatggagcttacatcacttctctttgttgtaaaggaagcttcccaattatggaaagctaaactctctgttggatcttccttaacttcattcttccatgcttttgccttgatcacgtag

SEQ ID NO: 46082 - DNA, 465 bp, Glycine max
  Peptide Sequence Number=SeqID_137767
atgttaagtgaaatatgcttacccaaggttttcagaaattacggaagcattacggaagccccggaaaacatttttcaaaaacgtggaggagcttgccgcccagttgcttcctccttaagcaacccaacttccaaaatgttatggaagggcctagagtcaaattgctatttacaccccaatcttgataagtttaccccctatttttgcatttttggctgttttctttctggaatgttgcgaaactttacggattacgcaacaatgctctttttgacttccggaatgttgcggaactttacagattacctaacgatgggggttaagtacctcgaggcggtcaagcgtgtgaatattgtttcaacaaacaaagccttgattcaagatttcttcaagatcaagccttgcctcacaatgaaaggtttcaagtcattcaaggcacatgtaatcgattaccaatacatgtaa

SEQ ID NO: 46083 - DNA, 318 bp, Glycine max
  Peptide Sequence Number=SeqID_137768
atgttttccagaaaggagggaatgatgagaatcatggagctgaccaaatacaggctaaaggcccaaacttatcaaggtaatccttgtggcgtctacccggacttatcttccttcattggaagtggcgtctaccctgacttatcttccttcaccggaagtggcgtctacccagacttatcttccttcattggaagtggcgtctaccctgacttatcttccttcactggaagtggcgtcatccaaatctctgtaacttgtatcaaacaatccgctcctactcaggttcacatcatctggtatcagagcttcggctcttga

SEQ ID NO: 46084 - DNA, 559 bp, Glycine max
  Peptide Sequence Number=SeqID_137769
atgggagatttcatcagcagactctccttccccgcatgtttgcattttagcgaagaaaacactgagactctttcaagtctcacaagttatccagaactacgtaggtctgagttcctcattggaggatacgtaggagcaagagcctcgcttttgtcgaccataccgccttttgttgccatgactcaagagctggtagcccgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 46085 - DNA, 83 bp, Glycine max
  Peptide Sequence Number=SeqID_137770
gatccccgttggtggcgactccgcgcgtattcctttcgtggaacacgcatcccgcgagtctcgcgtcgccctcccgccgaaag

SEQ ID NO: 46086 - DNA, 483 bp, Glycine max
  Peptide Sequence Number=SeqID_137771
ctgaagttgcagagatgttacagtacatggtgtcaccacaagggagaaatacatggacagtggacgatctagtgccatatgtagagaaaataacaattttatctgaagagcaaaagagaataactgaacctctgtcacatggtctagcaacagaacatgaatttccagcccaaccgttaaatattctccaatcaagtgttgaaacaaaaggcatagccagacgaagggagactgttgaagctgaaccatatttgtatccacaaatgacagagcgtggccatggaatgtattacacatcaccagcattttctcagtatccggcacagatgtatcagtatccattcgaagctcatcaaagtgatacttctacaagcgaacattcattaggtagtgttgtggagacatatgcgaatttttcatggcctactatgaccccttcacagcaacatgatgttctaattgaaacacctaatgccccattag

SEQ ID NO: 46087 - DNA, 408 bp, Glycine max
  Peptide Sequence Number=SeqID_137772
atgttgggaagacacatattagctgaaaggaaagtggaaatctatcacacagagctggatgaattcaagggcgggctggagaggcgtaactttcacaagtgcctcaccaacttagctgatagtagcattgacctcgcgttggtgaaggagttctacaccaacctctacagtctcgaggggccttcacctaaacaagtcagaaaccggggccacttaataaggattgatgcagacagcctcaattcctttctagaaacacctgtggtgcttgctgagggtgaatctttgcccacctacttaagatattgcaggatccctactgacattagagaaattgaggtttcactgtgcatacccagccgagggtttattctaaatgctgaagggtcacccagggaagatccttag

SEQ ID NO: 46088 - DNA, 441 bp, Glycine max
  Peptide Sequence Number=SeqID_137773
atgcaggaagttagttacatgggaaatcaacaaaggcaaggatacaaccaaggaggattctcaggtttccaacaaggtccctacaatcaacaaggacaatggagatcacaccctggtaaccaattcaataaggaccatggtggaccttccaacaggccgcctcaacaaggacctaatattttccagaggactaccaaactggaagaaaccctggctcaattcatgcaagtgaccatgtctaattacaaaagcactgagtcagcattgaagaaccttgagacccaggtgggtcaactagccaaacagttagctaagaaatcatccaacagctttggggcaaatactgagaagaatcctaaagaagaatgtaatgttgtgatgacaagaaacaagaagcgtttggcagttgaagatgaggatactgtggccttgaaagaataa

SEQ ID NO: 46089 - DNA, 471 bp, Glycine max
  Peptide Sequence Number=SeqID_137774
atgggaacaaatcaaactggaaaaaggttttatcaagttaagattaaaggcatagtgatatccacggaagtcgttgtatcactcacccaatactatgaccagccttcgagatgcttcacatttggagacttccaattagtactgactgttgaagaatttgaggagattctaggatgtcctcttgggggaaggaaactgtatctgttctccgggtttcttccctctttgagcaagattgcagttgtggtcagggattcggcaagagagttggatcatgtaaagaaaactcgaaacggcatagtgggcctaccacggaagtacttagaaggcaaggcaagggatatggcgaatcaagaggagtgggtcctgtttatggacgtattagcattgctaatctttggggctgtcctttttccaaacatggatggtttggtggacctagccgcaagtgatgtatgcatatcaccatag

SEQ ID NO: 46090 - DNA, 378 bp, Glycine max
  Peptide Sequence Number=SeqID_137775
atgtcaaatcataagagtactgagtcaacactaaagaaccttaaggtccaggtgggacaactagccaagcaaatagctgacaagtcatccaatagttttggagcaaatacggaaaataatcctaaggaggaatgcaaggctgtgatgactaggagtaaaaggttggtggaagctgaggatgaagagagtgtggtgtacaaggagcaaatgggtgaaaagaaaggtgttgaggttaaggaaaatgatggaaagggtaaagagaagcaggaaaaagggatgaaaataatggttcaggataaagagatggagaaccaagaaaaagaaaaaggaaatgagaaaaatgaaaaagaagaaaaaaaggatttcagagaagagtag

SEQ ID NO: 46091 - DNA, 219 bp, Glycine max
  Peptide Sequence Number=SeqID_137776
atggctgaaagaggagaaggaagtggaccaccaaggaggactcttggtgactatgcttatcaacaaggcccaaaacattacaatagcatagtcattcctcctttcagcaataaggttgtggaattaaagccaacactacttagtctaattggctcacatccctttgctggaatggatccgtgggatcctctagagtcgacctgcaggcatgcaagctga

SEQ ID NO: 46092 - DNA, 327 bp, Glycine max
  Peptide Sequence Number=SeqID_137777
atggagtggttttttcagatatcgcacccattcgtcacgcggactgaggagattgctgcgtcgagacatccgcctccccctcatcatggggagttcgtcgagccacccatccccgaggtttcagtcgcgaccgatctccctacgcattcagtggggatggctcaggatttaggagcgattgctgaggatttggagcgggtcatcaacctcaggatggtcactgagggcactgacttacatgacatcatgactcgttgtctgaggagagttagaggtgacgccgcagatggaagtcttaggccgcgccagagacaccgcatagattag

SEQ ID NO: 46093 - DNA, 406 bp, Glycine max
  Peptide Sequence Number=SeqID_137778
ctgtgtctttggcaaaaccacctccaaagcccgatccagaggtcgatgatccactttatctaatgacattgaccatcccagagcttttcttaaggccttatcaggttacatgggatgccaccgtattcggggtctttaatccagatttcccgctatacatgaagacgaagacctctccgaaatcgcacacggtggtcaatgtctcagcatatcagtgttacagttgtggattttataagcatttcattgaaacaagtatgcgagcggggaattctgatatctatggattcctcgagccacagtccattcagaggtctgggcaatcgcagtttgagtgtgaaagttacataaagatttggatgcaaagttcaaaacgcgatgtctatcttggagcctacctaaatgg

SEQ ID NO: 46094 - DNA, 273 bp, Glycine max
  Peptide Sequence Number=SeqID_137779
atgtcccagacattgtctcgacatcagggaaagctgctgcttcaggtgctggaagcaaccatcaaagccaacacagagaagaaaatggagctggaacggctgatcaaaaggctctcagaaagtggcattgatgatggagaagcagctgaagaagaagatgaagcagctgaggaagaagtagaagcagccgaggaagaagaagaagctgctgaggaagaggaagatgcagcagaggatactgaatcagatgatgattctgaagccaccccatga

SEQ ID NO: 46095 - DNA, 585 bp, Glycine max
  Peptide Sequence Number=SeqID_137780
gattcctttaaggagcaggccacacaacgatacttcatcccccatggacgtcaggatgttctcatcgctgctattggacgtccagagcaccctagacatctcttcctccctgcctctcgaagaattgcagtagttgacccaacaaatcagggacaagctagaggagtccatcacagaaaaagtgacacagcagctcatgacatccttcagccagatgcagtcccagattcagtccctgcaccacctcccgaccctctggttggtcccttcggtcctcgagtaagcacaaatgggagttgtgttgatccctcaagaaacgatcctgagacgggtgactctgataggtgcggcttgtacatagaagcagatcctgcccgcctggttgccatgggaagagtttatgagggatccactgttgttcataacactcctttgttgtttggccaagtaaaggtgagtgtggaggaggttacagatgcagatgctccagttcttgtacccactgatgaggtttccttagtggggcaggcactttacaccttccttgcttggccgacacatctggtcaagtctttatcacagtag

SEQ ID NO: 46096 - DNA, 348 bp, Glycine max
  Peptide Sequence Number=SeqID_137781
atgagttcaagatgttcaagaaggaatcaagaagaattcaagactcaagaggaaaagttgaagaacacttcaagattcaagaagaaggatgaattcaatgggttacaggttgtaccatctgcggtgaggctcatgaaacaggccaatgtactcccactgaagaaaacactcaagaaattcattatatgggaaatcaacagcgacaagggtatacttgatatgaatggcagtggaatggagaaggaagagagagaggagacgccacttcaaggagaagatgagtctagaagaagctcaccatcacaggaggccatggataagagcttggaggaagaaggagatgaatga

SEQ ID NO: 46097 - DNA, 336 bp, Glycine max
  Peptide Sequence Number=SeqID_137782
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtttcccagtcacgacgttgtaaaacgacggccagtgccaagcttgcatgcctgcaggtcgactctagaggatccccttggtaa

SEQ ID NO: 46098 - DNA, 552 bp, Glycine max
  Peptide Sequence Number=SeqID_137783
atgaccactcttacatggatatggatgacgttgctatttagcaacattctgcccagcgaccacaatgccaatctccccctgcagatgtatcagttgggatcgcgcccacaagacgcccagtggacccgaagaagtccaacagggccctggggtttccagctctgggatcgcacccacaagacgcccagtggacccgaagaagtccaacagggccctggggtttccaactctgattacgggcctctgtcagtcctacagggtgcccattcccccagcgaggaatcacacccacaaagacactcagtggacccagagaagtccaacaggggcctggggtttccagctctggttacgggtctccgtagtcctacagggtgcctgttccccccggcaaggtcacatcatcatgacatagggattgcgcctgcaagacacccagtggacccgaagaagtccaacagggtcttggagttgtcaagctctaattacgggtctctgttagttctacggagtgcttgtcacctccggcaagggcatcaggccccctactaa

SEQ ID NO: 46099 - DNA, 245 bp, Glycine max
  Peptide Sequence Number=SeqID_137784
ggcgtagaatttgtccatgcgcatttatcactcatcgagcgtgcggataaccacatgtcatcgggcccgccacctctggatgacaaaagtatgacagaaattgcctgcacggaagatgacgtaaatctccgcgtgtcaatgggcttgttggccacgattgacaaaggtatgacagaaattgtctgcgcggaagatgacgtaaatctccgcgtgtcaacggccttgttggccgtgattaacgaagg

SEQ ID NO: 46100 - DNA, 370 bp, Glycine max
  Peptide Sequence Number=SeqID_137785
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggggatgaaacctctagaaaccatcaagagagatataactaccttggggattattgctaaaagcctagcattgcatatgggttctgtcttgatccctactgtaaacaaaccaacggagg

SEQ ID NO: 46101 - DNA, 444 bp, Glycine max
  Peptide Sequence Number=SeqID_137786
gttacaggttgtaccatctatggtgaggctcatgaaacaggccaatgcttccagcagggtccatataatcaacaaggacagtggaggacacaccctggcaatcggttcaacaaagaccagagtaggccttcaaacaggccaatccaacaaggacctaacatattccagagaactactaagttggaggagaccttgactcagtttatgcagatagctgacaagtcatccaacagttttgtggcaaatacaaaacagaatcccaaggagaaatgcaaaactgtgatgacaaggagtaaaaggtttgtggaggttgaggatgaggataatgttgtacatgagaagaaaaatgctgacaagaaaagtactgatggcaagaaaaatgaggtgataggtgaaagtaatcaagaaaaagaggaacaaataatggtcaaaaatgtagactag

SEQ ID NO: 46102 - DNA, 84 bp, Glycine max
  Peptide Sequence Number=SeqID_137787
atggcagaaaactctcccaacttcccttttactctaagacacaggccctcaaaaggtcctccagtgactgtatgggttccgtaa

SEQ ID NO: 46103 - DNA, 291 bp, Glycine max
  Peptide Sequence Number=SeqID_137788
atggataaagttgatatctttgtccctcatcctctcacaaacgcatgtttgcttattcaactttcaccagaatgtgggtgcaagccattggtctgtttgctcaagctacatgcgctcctgagtgttgacttccaagactgttcaatcagagattactcgtcctgcacgttgggacaacccttcccttgtgttcaagtatcccctacaacaagagacccacagtctcttaatcccttttcagaaataagaagaagagaagaagaaatctctcttaaaagagatggattgtaa

SEQ ID NO: 46104 - DNA, 240 bp, Glycine max
  Peptide Sequence Number=SeqID_137789
atgagctgtataggttcgctaagcgcaccgcttcatctctttaagcgcatcgcttcaattcatccgctaagcgagaaaggcgcgctaagccaaaagtcagtaacatgcgctaagcagtccatacaactttgcatgtctagggtttcaagagagagaaaggtccaagttctagagagatttgagagattttgctgtgtaaagatctgcagagaccagagctcaaagcaggagccgatttga

SEQ ID NO: 46105 - DNA, 350 bp, Glycine max
  Peptide Sequence Number=SeqID_137790
tagctaagaaggaaggacattttgaagtaaagacaaatattaaagaaatttcccctcttagacaacctccacattttctccgttgtaaaaagacacttgttagcattgccacacctcttgggcttgagtttatacctcaagtaaaggagttgttggatgagggtttggttcgcaagagcttaaatccttgtgctttgttggtgccaaaaataggtattattaggcaccaaatccctaaaataggtggggttcccatgaaccctaagagaataaaggtcattcctgagtggcccgctccaccaagtgtgttgaggaaaaaagcccagcgtttcaagaacctcgggatttga

SEQ ID NO: 46106 - DNA, 630 bp, Glycine max
  Peptide Sequence Number=SeqID_137791
atggtcattgatcagtcactattcttttctttgactcatttacccagtcaaggtgcaccttttgagggcaccattgttgatgactggaaattcgattattcgagtcatgatgctcgtcgcatggtctgcaatgatcaagctgaaatgaccggtagattgctggccgggtcattaacatttgatagtcgcatcatgcactatatcattgttaggattttgcttcctcggtcttcaaatttagcacaagcctctgaggaggatttgattcttatgtgggcttttcttaccggtcgtcagatcgactgggcccatttgcgttcctttgcaattggtgctggtgcagtgaccttctttgggtatcgtaaagatcggaatggtcaatggctgaagaaggatgcactccctcctcaagatgtacgtactccttcacctcctcctcaacgtgaagattccgcactcatgaatgaagtcctctccgaattacggggtcttcgttcttatgttggtgaccgcttcgactcgttagatacacgcttttccggtatggacattcgcctcacacagcttgaagaggatgtcggatacattcgtcagagtttcgatcttccaccaccacctccgtcttcttag

SEQ ID NO: 46107 - DNA, 186 bp, Glycine max
  Peptide Sequence Number=SeqID_137792
atggctgctagtgacattgccattttgagagaccgagcccacatttctaccaagaagagtttattggagctaacctcacaggacgctctattggcacaaaacaagttgttatccaagcaactagagacattaacagaaacactcagatgtaaaatttatggtggagctcatgaatttggatgttga

SEQ ID NO: 46108 - DNA, 147 bp, Glycine max
  Peptide Sequence Number=SeqID_137793
atggtaatcgattaccagtggcctgttcctctgtgtaatcgattacacaggctggtaatcgattaccagaggcctccacaatcttccagtcccattttaagcctggagctcgcctgtttaggtacatcacaggttctcactgactga

SEQ ID NO: 46109 - DNA, 330 bp, Glycine max
  Peptide Sequence Number=SeqID_137794
atggggtcatccagcccagtgcagaatggggacgactctggttatagtgtatgtgccaggcctcgatttcgcaccgggcagccagtttcacacaatgcggttttgactgaatacgggaaatgcggacgccatgcagatttcgaggatgtgggaagccgcacaccacgcaagagcaaaagccgcatcctctttaataacggcgcaccacttgagcacattacaaacttactgggccaggccaaccccgccgcctccctgttttatatcggattcacgcaaaagactgcggatacactatcggaggagttttctctcggtgaggaatggtaa

SEQ ID NO: 46110 - DNA, 225 bp, Glycine max
  Peptide Sequence Number=SeqID_137795
atgaagctgcctctcaggaaagggctccgaagaaactctccacgaagaggtctagaagggacgtcactggagaaggctcttgtgtcgtctcagagtttgatagtcaccatttccggagtgtcgagcactagcagcgcttccaggccatcaggggatggtcattccacagggagaggcgtgtccaactcagggaagatgagtacacggacttccaggaggagatag

SEQ ID NO: 46111 - DNA, 162 bp, Glycine max
  misc_feature (47)..(47): n is a, c, g, or t
  Peptide Sequence Number=SeqID_137796
atggaggttgaggaaccttggttggggttatggctaccattgaatantcgagtggatatgggatcaagttcagcatatgacaacggaatttggggtgaaccctacaggctttttgctgtggtcttcgtcattggaagtgcggtagacaagctttgtggttga

SEQ ID NO: 46112 - DNA, 399 bp, Glycine max
  Peptide Sequence Number=SeqID_137797
atgcatgaacagcgtttgacaatcaattcatggggctacgaatattatttgatgatggaggatgcacgaacagcgttaggtaatcaattcgtggggctccggactcaatggtggaggatgcatgaacggcaatcaattcatggggctttgaataagttggtggaggatgcacgaacaacgctaggcaatcaattcgtggggctccggactcaatggtggaggatgcatgaacggaaatcaattcatggggcttcgaataagttggtggaggatgcactagatgcaatcctccctaggaagggaccaatcacaaccatgagcaagaggctccaagaagattgggctagagctgctgaagaaggccctagggttctcattaaccttagggtagatttctga

SEQ ID NO: 46113 - DNA, 449 bp, Glycine max
  Peptide Sequence Number=SeqID_137798
gcagtgccgaacgagttgtcgaccgcgtagcgccagccgtgcgtctcgtcgtagacagcgacgtcggccgtggttccggcgagagccacggcggacccgtccgggcccgtcccgctgatcgtccagtccgcgatcgccagaccaacgcccgcgctttcgaacacgtgacgaacagtcatcgtgatcggcaggttcaggccgaggaactgctcgagtgcgccgcggacggcctccgtgcccgtgaccggtgttcccggcgcagggacgaagaccacgtccggggtgttcagtgccatcaggccgtcgaggtcccgggcattgaagcggtcggcgaacgcgaggttcagctggtcgagagaagtcaccggagtgctcatgagttttcctttccgagcgtcgacccgacgccgacgttcatggaggaagacgacgcggcgccggaagtgtga

SEQ ID NO: 46114 - DNA, 216 bp, Glycine max
  Peptide Sequence Number=SeqID_137799
atgtcagtgaaaaacctcgtcgggtgcctaggagtacatgacaagacaaaccacacactagcaagtcaatcagggtcacagtgttttacgagaatgctccaaccatatgtgatcaacataggcttaaaggagcactcaaaccgtgtgacccccaaggcctacactccgaagagtcctctccctccttattcaggtccaatccaaaaaatattttag

SEQ ID NO: 46115 - DNA, 711 bp, Glycine max
  Peptide Sequence Number=SeqID_137800
atgaacttaatcattgttatcaaaaggaaagaacatgttttacggtgcccttaccaaacccgtgctagagctagagtaatgggtgaagtagagggggtgcaagagcagatgaaggtcgacatggaggccatgaaagagcaaatggccacaatgatagaggccatgatgagcatgaagaagataatggaagtcaatgcggttgcagttaccgctaccagcgttgttgctaaggtgaacccgactcccccacctagcctcaaccaaatgaattgtccaacctcatatatggtaggcaaagatttgggaagtacgggcagcccccatgatgtgcaaattcaaaacgagcacgccttcttgccatatggctggcctcccaattatacaccacccaatgtggcatacactcccaatgagaatgtcaataactccactcctatactcattaagagccaacaacctcaatctgatcatgcatatgtctctcagcccatgggggtatgtttggatgataacaaaggtgatgacaaaaagctcaaaggtcaattcaagaagtttaagatgttcaagatgttcaagattgaatcaagaacacttcaaggttcaagaggaaatttgatttcaagaatcaagaatcaagattcaaggttcaaactttcaagaatcaagatcaagattcaagactcaagattcaagaatcaagagaagacttaa

SEQ ID NO: 46116 - DNA, 81 bp, Glycine max
  Peptide Sequence Number=SeqID_137801
atgaaggccgacacggaggccttgaaagagaaaatggccacaatgatggaggccatgatgagcataaaggagattatagag

SEQ ID NO: 46117 - DNA, 153 bp, Glycine max
  Peptide Sequence Number=SeqID_137802
atgaagttaactcttaaggtggttggccctgatgcaatcctccctaggaagggactagttaccagagccatgagcaagagactccaagaggatcaggctagagctgctgaagaaggccttagggttctcatgaacctcaggatagatttttga

SEQ ID NO: 46118 - DNA, 447 bp, Glycine max
  Peptide Sequence Number=SeqID_137803
atgccgatctccccctgcggaagtatcagttggtctgtgccgtcccgacatagggatcgtgcccacaagacacccagtggacccggagaagtccaacagggccctggggtctccagctttggttacggacctctgtcaatcctacagggtgtctgttccccccagcaagagatcgcgcccgcaagacacttagtgaacctagagaagtccaacagggttctgggatttccagctctgattacgagcctctgtcagttttacggagtgtctgtcacccccagcaaggtcatcaagccccctattaactgggctttcatcaagaagtactgcgccccccaagcaggcgcaaggcgagacaccacaacagcctggggatggccggcagcgggcaacaaaatacaccgccaccacctccaaagcccctcggctcatccacaaaaaggttag

SEQ ID NO: 46119 - DNA, 237 bp, Glycine max
  Peptide Sequence Number=SeqID_137804
atggagaagtactgcacccagagacaggctcagggtgatgctccacaggccgcaggcgcaccaccaccacctcatcaggctggcccggctgggccatttgacatggagcagtatttacagcatttgctgagcctcagcatgcagagccagggcttcgcttctttttcatgccttactccagaccagttcagggcagaggtcgcatggcccggggattggcccgagacccaagcatga

SEQ ID NO: 46120 - DNA, 324 bp, Glycine max
  Peptide Sequence Number=SeqID_137805
atgccaatctccccctgcaaaagtatcagttggtctgtgtcgtcccgacatggggatcgcacccacaagacacccagtggacccggaatagtccaacagggccctaggggatcgcgcctgcaagacacccagtggacccgaagaagtccaacaaggtcttggagttgtcaagctctaattatgggtctctgtcagttctacagagtacctgtcacctccagcaagggcatcaggccccctactaatcgagctttcatcaagaagtactgcgtctccaggaaggcgcagggcgaaacaccacagcagcctggggatggctggtag

SEQ ID NO: 46121 - DNA, 465 bp, Glycine max
  Peptide Sequence Number=SeqID_137806
atggccaacaatataatcatcagcagggacaatggaggaaccacacttgaaatcagttcaatagagatcaagaagagcacagagtctgccataaagaatcttgaggtccaagtgggacagcttgcaaagcaattggcggatagatcatcaagcagttttacagctaatatacagaaaaatcccaaggaggaattggcaactaagccaacacttgaacctgtttctgattttttagaacttgaagagattaatgaggagactgaagatgacaaggaagaagagacaccaataaaagagaaagaaaaagaaagaataaaagaaggagaaaaagaaaaaaagttgaaaaatgaaaaacaaaaagagaaagttgttgacgatgagatgaggaaaggaaagagtgaggcaaacattgacaagaagaaggatactactccaaatgaagtcaaggaagtaccttatcctttg

SEQ ID NO: 46122 - DNA, 162 bp, Glycine max
  Peptide Sequence Number=SeqID_137807
atgaggataagggctacgtgggactacgtgagctcagttgaagagtggtacctggagatatgtcgcgggggtcaggagacctcggggacgtcaggtggggtgctattgcccaaagccaagcttgaccaatcccaacccaatccgggcatagtcagtcagtga

SEQ ID NO: 46123 - DNA, 361 bp, Glycine max
  Peptide Sequence Number=SeqID_137808
aggactacacgtcctcgccatcagaggactgcatgtcctcaccttcgtagggctacacgccctcacctttagaggactacacgtcctcgccaacagagggctgcacgccctcaccttgagaggactacacgtcctcgccttgagagggctatccgccctcgccttgggtactagttaccctcaccttcagaggactacacgccctcaccttcagaggactacacgtcctcgccatcagaggactgcatgtaccttcacctttgtagggctacacgccctcaccttcagaggactacacgtcctcgccatcagaggactacatgtcccccattttcaaagggggacatgccctcacctctag

SEQ ID NO: 46124 - DNA, 618 bp, Glycine max
  Peptide Sequence Number=SeqID_137809
atggttctgaaagaggagttaattgcttgttcaaggtcccaaagaagtttgtctcagcgtttatgcgagacggagaccaacatgctagctatcatcgccaagtaccaagaagagttagatctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaagcgatggcagacacctactccgccgccgaagagattcacgggcttctcggctattggaaaaacaccataactaaacgcgccgcaagggatccctatcgcaccagatccaaatctagaacgatgggtgatcaagaggagacgcatgaacagatgaaagccaacatgtcggctctgaaagaacaaatggcctccatgatggaggccatgttaagtatgaagcagctcatagagaagaacgcggccaccgccgccgttgtcagttcggctgccgaagtagacccgactctcttggcgactacgcaccatcctccctcaaacata

SEQ ID NO: 46125 - DNA, 282 bp, Glycine max
  Peptide Sequence Number=SeqID_137810
atggaggagcagttcaagactttgattgtcctatctcactatttggaggctgccccctgtcagagcctattgttagctgttggatatgaaccttttagtgaaacttttcagaatcatttttcctttaaggctcttagacacttgggttatcgtggttttggtgcacttgggcactcagtatatcgtagagagctatttcctaggttggtaaaaggcttctacgagggaactataaaacacattgctaccagtggaacacatactgcagcaatcacacaatga

SEQ ID NO: 46126 - DNA, 472 bp, Glycine max
  Peptide Sequence Number=SeqID_137811
agaagctaagaggtggcttcactcgttcaaaggcaacagtcttaagacttgggacaaagtggttgagaaatttttgaagaagtatttcccggagtttaagactttgaaaacccctgaagaagccatggatcttattgaaaatatggctgcaaaacaagttgttgtccaaggaattggaagcattgaccgaaacactaagttacatggtgtgccatttgttgtggagctcataattctggttgttgtatccccaatgaagaaccagtttatgaagccaattatatggggaatcagccaagacaaaatttcaatgcaggtggatattccgaatttcagcatggccagacatataattcacagtagggacagtagaggaatcaccttggaaaccagttcaacaaagatcagggtggttcatctaataggccacaacagtaagggcctagtctctatgatcgaacaacaaagctag

SEQ ID NO: 46127 - DNA, 355 bp, Glycine max
  Peptide Sequence Number=SeqID_137812
atgactaggggaaatccaggtgacttacaaccctttgatcctgatatagatagaacctttcatagattagttaggcatagtgtgcatactggtcattctgtgcattttgagcatcatgatcattctgtgcattttgttgctcgtgattctgaatattctgattttgagcattcgactgttaattttcatactgagaacatggctcaaactccacctcgtgagaggactctcagggagatggttgcacctgatttcacttatgaaagcttgtgcattcaatatcctgatgagggtgttccatatgttctcaagactggactaatacatttgctgcccaagtttcatggtcttccag

SEQ ID NO: 46128 - DNA, 789 bp, Glycine max
  Peptide Sequence Number=SeqID_137813
atggccaagttcgaccctgagatagtcctagacttctatgctaatgcctggcccacggaggagggagtttgggacatgcgctcatgggtaaggggtcaatggattccctttgacacagatgccctcagccaattcctgggcgacccgctgattttggaggaaggccagcagagtgagttcagccagaggaggagcagggctgacggtttcgatgaggaagccatcgcccagttgttgtgcataccggggcaggattttgcccggaccgctgcagggaggcgggtgcggatcatgcgcaccagcatgaccactttgacccagacatggatgacatgctgcttagcaatgtcttacctagcgatcacaactctgacctccctctgcctaagtgctagttggtgtatggcgtcacctgagccttcatcgagaagtactgcacgcctaggcaggtgcagcagggtgacacacatcaggccacaagtgcaccgccaccaccttggcaggtcgatcctgctgggccactgggcgtggagcgctatctatagcatttggtccgccagcaggcggccaaccaccgtgggcagcctcagtcagcaggggcagggtgtcgccccttttgtatgccctaccacagagcagtttggggctgaggtcgcttggcctggagactggcccgatgcccaagtaggggaggagcctgcaggatcccccggtgaggcggatgaaccccatatggatgaagatatgactgacctgctcggtttcttgggagggagcggagccacatga

SEQ ID NO: 46129 - DNA, 255 bp, Glycine max
  Peptide Sequence Number=SeqID_137814
atgatgttagtctccgcgcgtcaacgggctcgttcgcccccggttgatgaaagaaattgtctgtgtacggataacactcggggtatctccatacgtcacctgacttcatgggtcaggatgacagaagcggaagacgatgtaaatctccgcgtgtcaacgggctcgttggcccgattgacaaagggtgcagaagacgacgttagtcttgcatgttatcgtgctttggtcttacggatagcgaaagagtgtttatag

SEQ ID NO: 46130 - DNA, 243 bp, Glycine max
  Peptide Sequence Number=SeqID_137815
atgtcaagtgaagaattgaagttgaaggatccacgatgtcggatacaatgtcctgacatcctgcccgagaatactggaattgctgtacaatgcaagataaaaattttcaggaaagagatagatctcctccagcatcaagaagttgcagcccagaaacgcacatggctatataaacacgaaggctgcacgagttctgtaccaagtccgggatcgaagagttattttgtgagttttgggacttga

SEQ ID NO: 46131 - DNA, 234 bp, Glycine max
  Peptide Sequence Number=SeqID_137816
atggaggaagcacctgcacatgcaccttctcatgtagagcagcctcgacatgcaatggaggattgccaatcaatagctgaaaggttggaacggttgctcaacctaaggatagtgactgaagacacagaagcatacaatgtcatggaatactacctaaggatcgccaaaggtgtgactgcagatcacaatatatatgtacggtcgcgacgaaggcgacgcatagaagacacatga

SEQ ID NO: 46132 - DNA, 231 bp, Glycine max
  Peptide Sequence Number=SeqID_137817
atgacattgtattgtcttagctcttgcttcatctacactcacttcaatcttgaagctatggaaggcgcctgtgatgggcagatgaagcaaagaggccacatcgtcgagggtgatagtcacctctcctacaggaagatggaaactgcacgtttccttgtgacacctcttcgcaaaagtcgatataagtctccgattgctagtgtccaaggaacatgcaatcagaggacttaa

SEQ ID NO: 46133 - DNA, 327 bp, Glycine max
  Peptide Sequence Number=SeqID_137818
atgacaacagtagggtacagggatgagattctgttgaggagccgccaagctgatgtgatgacgttgggaatattttggggagagagttgtgttttgttaatcaactcctccatagtggttcatgatttcttttgttggattaaggatggagtgatggctggacagaatgatcgtgcaatagctgatgcccttcaagccttagctcaggctatggggaatccaaataggagagaagctggtggagctgttgagtaccaggggttggaccgcttccaacgaaacaacccttcttcttttactggaggatacaaccctgatggtgcttag

SEQ ID NO: 46134 - DNA, 183 bp, Glycine max
  Peptide Sequence Number=SeqID_137819
atgtggtcaattcctttgggaaccttagtatctccaactcctataaacacctcaaagttatcacctttcagtgttaattttaagaagccaaccacctttccatctcagggttcaactcctcctcgtgaattctctctctcccaatcagggaggcatgattgtaaaactgaatctttgacataa

SEQ ID NO: 46135 - DNA, 231 bp, Glycine max
  Peptide Sequence Number=SeqID_137820
ctccttcttccatggcttattccctagtggatggcgcctcctctcacctattctcctttgtcttccgctgcatctccatggtggaaaatcaccattgaaggacctcattgaagctcaaagatccaatctccatagaagctccacaagcaagcttccatcaggtttggggtgtcgtgagcaacaacaaacaacaatagtagaactgccaaggttgaaaactactggaacacg

SEQ ID NO: 46136 - DNA, 603 bp, Glycine max
  Peptide Sequence Number=SeqID_137821
atgcctcaagctcagtgcatgtcgcaagccaccgacgctagaaagaaagcattcgcgaagaactgcaagggatggaaaaagctctattgcggatcgtgcacattcggatccaaaggcatgaacatggtacttgacaagtgcaccacgctggaggagctctttgtcaagtgcctccgtggaatcatcgatgcggcagtggcagagctgattggtcccgacatggttgcggcgtcactgaaactttgtttcaaactttccagtcattatagggaccctgggactcttgatattcggaaaaactttgttggtttctttaattggaagagcttttgtagaatcaaacaaggttacttacaaggttatttcaacaaacattcaaaggttaagcattgcttcaagattaattcaaaggttaagcattgcttcacgattaattcaaggtcaagcaaacaagatcaagaaaaagtaaggcctcaaacaatctcatcggttgatcaagctttttcctcaaaacacattgtttccaacatccaaggctttgctaatcgattaccaggcagtgtaatcaattaccagaagataattttgaagcaaaggatttaa

SEQ ID NO: 46137 - DNA, 201 bp, Glycine max
  Peptide Sequence Number=SeqID_137822
atgaagaacgtcgaagaacggttgaaagctttgcgagattcctcacggaaaacgggaggtggttgccgcccagctcgcccaggcgagctcagctcgcccaggcgagcagggttgcttcctccagaagcaaccgccttctggaggaatcttctggagggcccaaatgggcctgggtgctatttgcacccccatttttactaa

SEQ ID NO: 46138 - DNA, 1833 bp, Glycine max
  Peptide Sequence Number=SeqID_137823
atggctacctcaccaaaagaaacttccgcttctggttcacccgctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaagagactcctgcaccacgggcaccagaacctgctccaggtgacctcattgacttagaagaagtcgaatctgatgaagaacccattgccaacaggttggcacctggcattgctgaacgattacaaagccgaaaagcgaaaactcccatcaagaggtctggacgaatcaaaactatggctcagaagaagagcactccaatcactcctaccacatccagaagaagcaaggttgctatcccctccaagaagaggaaagaaatttcctcatccgactctgatgatgatgtcgaactagatgtctcgacatcaaagagggccaagaaatctggaagaaaggtgcctggaaatgttcctgatgcaccactggacaacatctctttccactcaattggcaatgtggaaaagtggaaatatgtgtatcaacgcagacttgcggttgaaagagaattgggaagagatgccttggattgcaaggagaccatggacctcatcaaggctgctggactactgaagacagtcaccaagttgggagactgttatgaaggtctagtcagggaattcattgtcaacattccctctgacatatcaaacagaaaaagtgatgattatcaaagagtgtttgtcagaggaaagtgtgttagattctcccctgctgtgatcaacaaatatctgggcagacctactgatggagtgatagatattgctgtttctgagcatcaaattgccaaggaaatcactgccaaacaagtccagcattggccaaagaaagggaagctttcagcagggaagctaagtgtgaagtatgcaattctacacaggattggtgctgcaaactgggtacccaccaatcatacttccactattgccacaggtttgggtaaatttctgtatgctgttggaaccaagaccaaatttaattttggaaactatatttttgatcaaactgttaagcattcagaatcttttgctgtcaaattacccattgccttccctactgtattgtgtggcattatgttgagtcagcatcccgatatgttaaactacactgactctgtgatgaaaagagaatctcctctatccctgcattacaaactgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagagaagaaaatggagctggaacgcctgatcgaaaggttctcagagagtggcattgatgatgaagaagcagctgaggaagaaggagaagcagctgaagaagaagaagaagctgctgaggaagaggaagatgcagcagaagatacagaatccgatgatgatgattctgaagccaccccatga

SEQ ID NO: 46139 - DNA, 273 bp, Glycine max
  Peptide Sequence Number=SeqID_137824
atgtctatttggcaaacctcagtccacggttttttaactgtttgcggtttgctcttccctcccctgcattctcgtgattgtgagagttcacactttttgtcagatgacattgtatgttgttgtgtgatgtgcatatgtttgagtatgagaatgaatgacaatataactttagtattgcaccatggaggaagattcactccacgtgccagtgatggaaaggttgaatatataggcagagaatttgacgtttgggaggatatatctgcagcctga

SEQ ID NO: 46140 - DNA, 774 bp, Glycine max
  Peptide Sequence Number=SeqID_137825
atgtggtggtttttggacatggtggtgaggatgcgtggtgctagttgggccagtgaggggtctcgcgcttgcggatctgaaccaatgaaggggtgcgatttagatctagccgcatggtgcgatggtgatgggttgggtgggatgaaaaaaaaggtgaaggtgaaggggaaaagggatgggaagataaagatcattgtaaggctagaggtcattggtagaaggaataatagggggcatgagttttaccaagttttaccacctagcaaccacttagaggaagaagagaaacaagattcaatttctcagttttggaagatgggtttgtttaaggatgaggatccaatctatgtctggttgtatggtggagctttccccaacttctcaaaagaagatcttgctctcattcaaaatgacccccttaatgaggagagtaaatcggttgtcttcagcatcagagcccttaaagctctagggccagacgatttgaatcccctattttttttatcccaatgggatactgttaggtcttctatttttcttcgtgttaaggaagctttattgaacctctcttccattaagcttttgaatcacatgaacctgattttaatcctgaagatggtcatgaacaagcttgtatccccccatttgactagttttattcctggaaggcaggtcgaccttcagaaagcttatgacagtatccgttgtttgttcattattggcacattacaaaagccagattttggtgattttttcctaaaccttttgttttaa

SEQ ID NO: 46141 - DNA, 348 bp, Glycine max
  Peptide Sequence Number=SeqID_137826
atgtgtatacacctgaagggaccagacaaatatctacacgtcctcacctttagaggactacatgtcctcacctacagagggctacacgctctcaccttcagaggactacacatcctcaccttcagagggttgaacgccctcacctttagaggactacacgtcctcaccttcggagggaacgcgccctcaccttcagaggactacaagtcctccccttcagaggactacatgtcctcaccttcagaggactacacgttctcgccttcagagggctgcacgatcttgccttcagaagaatacacgtcctcaccttcagaggactacatgttctcgccttcagaggactag

SEQ ID NO: 46142 - DNA, 492 bp, Glycine max
  Peptide Sequence Number=SeqID_137827
atgattcttgatgcctcaactgaaggtactatgatgtccaagagcgctaaggaagaaattgtaatcattgactccattgcagccagtgattatcaagtcaccatgatagggctccagttcaaaggaaaggaaggagaggcccattatttgcaaagtcaaggtagacctcaacaaaactttcaaggaaattatcaaggctacagaggtggttcaggttcaaatcagccttatggctggaggcagcaaaataataatgcatattctagtcctactaaaccttcttttgtaggtcattctaacaactcttataagaacattgatgcttccattaaaaatcttgaagttcaggttggacagcttgaaaaacaactgtctgagcatggaagtggatcttttttagcaaacacacaagttaacccaaaggaacaatgcaaagcaattacaacaaggaaggggaatgtggttggtttgaaggataatggtgagaaatag

SEQ ID NO: 46143 - DNA, 426 bp, Glycine max
  Peptide Sequence Number=SeqID_137828
atgcaattgcaacataatagatggtggcgggcactgcggtcgatggtagttgtggagttacacaaaggggcatcggggttggtggtggtgtgcgctaatgacagggttgagagatgtggttgcgcactaattgagaactccgacacgatagaggagatgacacacaaacccaagaacaccgctgtcgcaacgtgcccttttgcgggctcacgaaggcgaggctcgcgggtgcgctttccaaaggaggaaagatgcgcggagtcgccaccaacgtttatttgtggaaaacgtcggaaaaaccgaaggaaatcggtcaaaatgaaaattctaagttcgggagttgtatttacgtttgagggaggtcgacaaaagcggggttgttgctcctacgtaccctccatcgaagaggaaatcagacctacgtag

SEQ ID NO: 46144 - DNA, 681 bp, Glycine max
  Peptide Sequence Number=SeqID_137829
atgaattcattgcctagcactgttcatgtatcctccaccatcgagtctggagccccgcgaattgattgcctagatctgttcgccaattctccattctccaatcttattcggagacctgtgaattcattacctagcgctgttcatgtgtcctccaccatcgagtctggagccccgcgaattgattgcctagcgctgttcgccaattctccattctgcaatcttattcggagacccatgaattcattgcctagcgctgttcatgtgtcctccaccatcgagtctggagccccgcgaattgattgtctagcgctgttcgccaattctccattctccaatcttattcggagacccgtgaattcattgcctagcgctgttcatgtgccctccaccatcgagtctggagccccgcgaattgattgcctagcactgttcgccaattctccattctccaatcttattcggagacccatgaattcattgtcaagcgctattcatgtgtcctccaccatcgagtctggagccccgcgaattgattgcctagcgttgttcgtcaattctccattatccaatcttattcgaagacccatgaattcgttgcctagcgcttttcatgtgtccttcgttatcaagcgcggagcctctgagaaagaagaaggagagacgagagtcgttatagactaa

SEQ ID NO: 46145 - DNA, 135 bp, Glycine max
  Peptide Sequence Number=SeqID_137830
atgtgtcacatgcaaggtggaaggcaaaggagaagaggagaggggaggcaccatccactagggaataagccaaggaagaaggagcttcaccaccaagaattgccttggataagaagcttgaagaggatgctttaa

SEQ ID NO: 46146 - DNA, 510 bp, Glycine max
  Peptide Sequence Number=SeqID_137831
atggccacacctccgaggtctcctccacagtctgatggtcaatcagaggccactttgaagcggagtagaacaacaacacgacttagaacattgacattaagaaccatggatcaacccagaccggcagtttatgtcgatcccgctaccgggagagcatcgggacctatgcgtgaaaagttccaaagctatctaggggtagttgcgcgagaaaagatccccattatccacaacaattggaaagatgtacctgaaacgcttaaggagatagtgtggaatgacatattagcaaagtttgatatcccagaagccgcaaaggtgaagacgaaggttatgtctatggttgcgatgagatggcgacaatttaagtccacattgactagcaaatttgtctttggtaagactgaagggcaacaaatgcaggatgttgttacaaaatatggattagatcccgaagcttggaaacaatttgaagcaacccgagtgacacctaactgggagattagtttataa

SEQ ID NO: 46147 - DNA, 405 bp, Glycine max
  Peptide Sequence Number=SeqID_137832
atggtagttgtcctcatggtttctccttccaccgaaggagatctccaggctaagctaagaccaagatgtggtgttgtggtggcagagcatgtgcattatgaccttaaggtagtgtgggtgattaaggggtattgttgctacaacagcttgggtgaagctttgtatagtggtgaacctgttaaggtttcaagaatagttgcatatgtgggttccatgatcataccccttctcagtggtttagagatattcacaaacaccttgaacctgattgatcttcccattctattctcctttgatggatcccatgcaatgtacccttctaattcatttaccaatggtttcaaccatcaattgtgtttgcaagtttataaggagatcataaacccacacctagaattggcataa

SEQ ID NO: 46148 - DNA, 717 bp, Glycine max
  Peptide Sequence Number=SeqID_137833
atggtgttgatgcaaaaatctcatagccacataaaattaggagcaggaaaacatatgtatcaaagcactatgacaatgctggcaacttcaatcaatttttgctgcacgtggactccaaatttcacacctacttttgttttcatcggagtctctgtttggttccactttgcatcattttttaaaaagaaaaattcaaacatatttttttacttagtaagggagaaattaccatctgtggagagacctaaggtaagtattttttattgtcaagaagaagactggagtctcttgttgaggatggaagaagaatacattgaggagctctgcatgcagatattgaagtttaaaccagatttggtgattacagagaaaggacttagtgatttcgcatgccattttctcagcaaccatggacttagtgcaatcagaaggctgagaaaaactgataataatagaattgccaaagcatgtggtgctgttattttaagaagattggagatgagttttttgcatttattgaggggtgctagcaaggaccccaaggcttgcagtgtactattgaggggtgctagcaaggatcatctaaatgaagttgaaagaaacctccaggataccgtgtctgtagcaaggaacataataaaaaattcaaaacttgttcctggaggaggtgctactgagttgactaatgactgtcaaagatgtagagatttttcttaa

SEQ ID NO: 46149 - DNA, 348 bp, Glycine max
  Peptide Sequence Number=SeqID_137834
atggcagcacaattaatccatgaccgagtggagatggagtgcctagagggagtttgggagaccctcgaaggcaacgcgaggtgccgattccgtggcatgattcgactcacgactacttcattgccagtccaagtgatagaggtgacatcatctgaagaagaccctgagaaggacccagaggagctacctcctgagcctgctgtggatgctcttgactttccagagggtgataaggacccactccctgaggtggattctcccgaggacgtcatgtcggcatctgaggcagactctacggaggagagcggtcctggagggatagcgactagtggaggttcttcatcatag

SEQ ID NO: 46150 - DNA, 579 bp, Glycine max
  Peptide Sequence Number=SeqID_137835
atgaaggtcgacatggaggccatgaaggagcagatgacaatgatgatggaagcaatgatgagcaagaggaagatgacggaggttaacactgcaatagttgttgttgtgagtactgctactgagacggacccaattcccctgtccggtttcaatcgagtgggttgtccaacctcgaatgtagtaggtcaaggaggcaaggcagaggaaaatgcatgtaggcctcattatgctcaggttcagagcaagcatcctttcctaccatatggtttgcctcctaattatacactgcccaatgttgtgtatgctcctagtgagaatgtcaacaattatgcacccatacccattgagaatcaacaaccccaacctaatcatgcccatgtttctcaacctgtgggggaaacacatgaaactccccaagaccacactctggccgattttgggccccaccctagatataccactagagggcatgcatttcctggtgcccctcgcgccaaatgctccgggggggcctctgtatcaaacaccaccctgacccttgcattttgtgatagaaggagggccttccgtagtacttga

SEQ ID NO: 46151 - DNA, 273 bp, Glycine max
  Peptide Sequence Number=SeqID_137836
atgaaattaccaacgataagtgaagaagataaatgcacacataatctcacaaaggaccaaataagggggaagctagcccaggcgagctggtttcttacaacggaaggaatcagctctcccaggcgagctagctgcttaaggctgaaggtatttcatggcccaggcatgccagatgctagcctaggcgagctagggtctagaagatctgacaatcaaacatcaaatttgagtgatcccttgatcttgcattgcaaccgatgtcaaacatcataa

SEQ ID NO: 46152 - DNA, 750 bp, Glycine max
  Peptide Sequence Number=SeqID_137837
atgcatgttgagatgaagcagcctctgcctggcttcatttgttgctatggtgttggttttcaaggtgccaggaggcttgatcccacatgtttggaagaggttgggaggccatgggagcatattcgcaaaggttcacaagtctgcaaaatcgcagccacgcttaagcatgagatccatgagagactagtcatgcttaacgtgaaatccgaagagagcacgaggaagtctagcgagtctcgcttaagcgaggatcattcctgcttaagcgtggtgataaactactttttgagtgatattctgtgtgggcttttgtaccattctgcatgtattttattggcaggattcacattcgaagactctggactagatcacgaccatggtacattgaccacaactatgggtcatggtcaactcataagggccaagggtcgaggtcaactcataagggttgtggtcaaccaagaaggtcatgacaccaataccatcttactgctcaagttacttgagggagtcacatttggcttcaagcatgaattcctacaaatgttggagaacaacctattcagtggcgctaccgatgaagatccaatgcagcacttgaggaagttcatcaagtttaccaacacaatgagaccaaaccatgtaacaatagagtacattagacactatgctttccctttctcactcaatgggaaggcatgggactggctatgctcactacctgagaacaatatcactacattggactag

SEQ ID NO: 46153 - DNA, 570 bp, Glycine max
  Peptide Sequence Number=SeqID_137838
atgtcactcatcatcgatcctagaaatttgttagtagttggaatcatagatacacccctacctcccatcaggaaggaggtgacactagataaatatgagaggtttgctaaagttgctttggatatcagaaatctggatccaatagtagctatgcatcacctagtcatggcattacgaccaggaccttttgttaacaatctttgtaagaagctgacaacaaatcttgatggtcttcattgttgggcagctaagtacatgcaattagaggagctcatcaaatacaaccgacatttaagaattgaagcatcgggatcaaagaaggatgccgaaagagatatgcaaaaagggaaagagcgtgcacatgagccccgctacaattattacatttcccttaacgctagtagatcaaggattttggagcaaggccttgctactaaagttttggcaatgccaaaatgtgctaacactccgctaagggtcgatcccttgaaacattgtcagtaccaaaggaataaaggtcattcgacggaaaaatgcccaacacttaaaacaagatcaaggatttcataa

SEQ ID NO: 46154 - DNA, 354 bp, Glycine max
  Peptide Sequence Number=SeqID_137839
atggcgtatgcaattaggaagatacggttagcttcatcttgtgttgtggctatcaatagtgtgccaacatacttccccgaccatagtcccgggaagaaccaacaacacaccaactacaatgcagcaaaactgtatagagaagtatatcgagcatcatcagaggttgataaagttatgggtggttgtgccacactattacagtcatggcctggtaccgcatgccttttattgcaccaagagtcccacaacccgaaacaacttatccacgggctaaaagatggagtggtggtagataagaatatagggccaaaccatgagtcacacctcatggtgacttggtcagatatagatctc

SEQ ID NO: 46155 - DNA, 465 bp, Glycine max
  Peptide Sequence Number=SeqID_137840
atgcatcaccaaaagaggaaaactctagatgaaacttcaccattatcaagcggttcagagacccaacatgaccatagatcaacctccactccctatggctcacacagacccggttcccagtggagtcaccatcagtcacaacctaccctacgacgggagggcaaggcaaaaagtagagatgcgtcttctcatgaagaaaacgtgtggagttgccaccaacgtttattcgaggaaaacgttagaaaaaccaaaaagaagaaggtttgcgaatttaaaaataagggttcgggagttgtttatgcatggagaaggaaaataggcacttgggcaatggcagctcgcccaggcgagctgatgcttactcctgaagtaattggctcgcccaggcgagctggttacttcaccctgaagtcttttggggacccaggcttacctaggcgagctagggtccaagaaactcaataa

SEQ ID NO: 46156 - DNA, 312 bp, Glycine max
  Peptide Sequence Number=SeqID_137841
atgatagagaagcaaatgcagaaaaccgatttgagaggcaaaagagaagcagatcgacgcgaacctatatggaggaagcaatgtgggaaaaaggtgagggagaggaagctcacgcttcgaaaaatagagatcaaatccaatgtcttggaagaggggattcatggtgttagagacctgaatatgattcttcttataagaatcagagatgttgatattgttcactcccttttttatgccttccattgttctctctcactctcactctcactctcactcgcactcgcacaacaaaaaaccctaacgattttttaa

SEQ ID NO: 46157 - DNA, 201 bp, Glycine max
  Peptide Sequence Number=SeqID_137842
atgtctcattggacaaaaatcttagcaaaatcgatacaagcacaatctacactgctcgttgctaccacgttctgtgttttggctttggtaaccaagttaccccatacaaacattgtttttgctgccaatttctgcagcaaaatttacaatccaaaccacaaagggaaggtttcgaatgtgaacagttttgggatttgttag

SEQ ID NO: 46158 - DNA, 177 bp, Glycine max
  Peptide Sequence Number=SeqID_137843
atggtttttatgatggtgatcacgaccatggtgctaaaatggagaatagagatcagtgaaggaaccacggtcgtgttgaccacaaccgtactcgggtttgacgataaaattttgggtcgtggtcatttgaccacaggtcgtagtactgatagacagattgtcttaaaactaaattaa

SEQ ID NO: 46159 - DNA, 573 bp, Glycine max
  Peptide Sequence Number=SeqID_137844
atgtctgagctttatgtgttggagttggggacaaaaggttgtgctgaagttactatcttcaaaactagttatattgtttttaaaggaggcactcaggttggttcaattgctgctggtggccgatatgataaccttatagggatgtttggctcaaggtcagtgcctgcagttggttgtggaaacatgttcatttgcatcactttgctgcatttaatgatgataaataaaactgatatatatgcaaaggctggcaggtgggaagagctacccatgcttggttcggcatcatgttgggagcaccacatacttaaaaaaaaacattttattggagtattcttaaaaaagaaacattttttaaaagaggcagatggtgatggaggttctgcagtccagctttatgccaaggaatgtagtaagctcctcctacatgttcttaaaagaggacctagtcaaaaggatgatgaagtggtgacaagcataggtgatgagaaagaggaagaagatttttgtgttatggcacgagaagaagagaagatgaagttgttgtgcaaatgtatgttgagacctccataa

SEQ ID NO: 46160 - DNA, 1086 bp, Glycine max
  Peptide Sequence Number=SeqID_137845
atgtcaacttcaaaatcttatggctctcactcttatctaaagaaagaccaaggtcaaggcatcttaggggtgactccttctaagcccaaagatgataaggggaagacaatagaaaagcaaccccttaaggctagtatgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtgaaagtgaagaagcaaaaggggaagaatctagtgaagagatctacccccaaaaagaaggacgacctttaatggttaaggaagagtgtaaggagacacttgttagcattgccacacctcttaggcttgagtttattcctcaagtaaaggagttgttggatgaggatttggttcacaagagattaaatccttgtgctttgttggttcctaaaataggtattattaggcaccaaatccctatgataggtggtatgatgaatgtgttgagtggtgcaacactcttttgtaaaatcactcatgcacccaacatcttcatgatttttggacatagggactcattaggtaggaataatcaacatgaaaataaagaaaaaggtatgttttattccattacttttcctaactttttaaatagtgatcaagggcttcccatggaccctaagagaacaaaggtcattcctgagtggcctactccaccaagtgttgaggaaagaattcatgagtttcaagaacctctggatttgaggtcaaatccttttcaagggagagggaacatggtgttagctccattggagcttgtaggcctaggatcttcttcatcaatggatttctttgcttcttggaagatgaatggcaacagaatggagaaaggaagagagagagagaggagacgccacttcaaggagaagatgagtctagaagaagctcaccaccataggaggccatggataagagcttggaggaagaaggagatgaatgaagggagagggagagaagagcacaaaattttgtgctctatatga

SEQ ID NO: 46161 - DNA, 300 bp, Glycine max
  Peptide Sequence Number=SeqID_137846
atgaccacagatcaaccaccacttcctatgtctccacagaaccggtggagtcgccaactgtcacaacctacccttcggcgggagaccgatgcgagattcacgggtgcgtcttccgaaaaaggaaaaggcgcgggagttgccaccaacgtttattcgaggaaaacattagaaaaaacaaaaaggggtctacgaattttaagaataagggtttgggagctgtttacgcgaggggaaagtattagcaccctacgtgtctgtcacaaggggcggcagcctttaatcgagtgtgcaaaaacgtaa

SEQ ID NO: 46162 - DNA, 861 bp, Glycine max
  Peptide Sequence Number=SeqID_137847
atgcctcgggctatagtgaacttcattgtgcaaagtcttggtgatttgctcattcaagaaggaatgttcctatatggggtggaagacaaagtgttgcaactgcaaactaaattgaggatgatgaggtcttacttgcaagttgcagatagaaagcaagatggtaatgaaagcctaaggaattggatttcaaaaatcggagaagctgcttatgattctgatgatgtcattgagtcatatgccctcagaggagcttcaagaagaaatttgactggtgttttgagcctcatcaaaaggtatgctttaaacatcaacaaattcatagaaacccacaaggtgggatctcatgttgataatgtcatagctaggatttctagcctcacaaggagtttggaaacttatgacataaggcctgaggaaggagaagcctcaaattctatgcatgggaagcaaagatctttgagctcctactcacatgttattgaagatgacataattggtgttcaagatgatgttaggattttggagttatgtttggttgaccccaacaaaggctatagagtagtagccatttgtggaatcgggggtttggggaaaacaacattggcaaaaaaggatacaagaaacaaaatacgagctctccactactctaagccaactaaattaaatttaacctatgatattttcctaagcttctcacatgaaactacgcggccaaaaacgcatgcggatctacttttccctactgtggatcatctacctcctaagttgtctctactgcggataaccttaagcaatcaacaatggaagcaatggaagaaggaaccttacctcaatgaagaacgaaagaatggagctcgctga

SEQ ID NO: 46163 - DNA, 96 bp, Glycine max
  Peptide Sequence Number=SeqID_137848
atgagaagtctcctcaaaagccacccacgaatcacatcagagaaatggaaaaatttagaggtggctggttggattggacccgacaaaggcacttga

SEQ ID NO: 46164 - DNA, 183 bp, Glycine max
  Peptide Sequence Number=SeqID_137849
atgttcctcatattcaacactagtgctttgaaaggacttgatgatgctccacaaccgaaatccaaggctgctgctaggtggattgttgttaagtgtaatagacaaaaaggaatcactgaatgtggctactacgtgatgcactggatgtccacgataatcttaggatctttcaggaataattga

SEQ ID NO: 46165 - DNA, 276 bp, Glycine max
  Peptide Sequence Number=SeqID_137850
atggaggtggatgatcatgttgcatcatcgacaaaaactggaggagggatgctcaaaagtattgtgtggaaccattttggtaagattaaaattactgatgggcaagacgaggcccaatgtaaatactacaaaaagcttcttgggggagcatcaaagaatggaacaaagcatttgcatgcccatgtggagaaatgcattcaaaaaaagctgctggatacaaatgaaggaatggtggcaattaaatcaaatatgtggactgcgaggcacttgaattaa

SEQ ID NO: 46166 - DNA, 813 bp, Glycine max
  Peptide Sequence Number=SeqID_137851
atggaatcatccattggaggagtatgttggaaggatccatcatcaaatagcctcatcttcaaaatattctcttggctaaaatccttttattctatcttgtacttcttcaggagtttcataaaagaacttccttatcgctctatgggcttcaaacacttcagtgaggacaacattgtggtagatgtccttcacaatgcctttgtccttcatcactttactttcaaatctattgaagagaatttggggcaattcaaagggactgccctctatcagatgatacaaaatgaacttgtgggtattggacaagaaggtgccatacttccttggcatgttggcccaattgggtccctagagggagtgcccaatttggtcttcaagttcattgccctaattgtttatgaacttggttcctcgtcgcacacacccaatggctttggcaatggtttcagcatttggcttcactggtataccaacaaccttccctgcaaagtatccttcaataacctcattgtgctagactttggttgttctccaaaactcatggatgagttcaggcaccaccaccaccttggggtcctcgaagaagtggtggatgtcgcacaacataaggtgtgcgttgatgacgtatccaacattttccaaatagtcaatatcttaaaagtgttcgatatgaactttgggttctttgtccttcagatagacttctacagcaagaatggacactcgtgcagatttctagaagcttctgaaggaaggggtagctcgggtgtagaggtttcagggagagaaaaagagaatgtgaagagtttgtaa

SEQ ID NO: 46167 - DNA, 1023 bp, Glycine max
  Peptide Sequence Number=SeqID_137852
atggatgcacctttgtccaaggttgctccaacagcacaatgtccacctcccactctggttgctcccaaggcaataggtgcaatgacccatgaacaaaaagttgcacccccttcggatgagacccctacgcctcaagtgaagaggcatctagaaggtgagcaatcctttgttgttgctgttgctaatgatcctcaacctactaatattcctcccattcgagaactgaggttattcaccttaagaaaagaaagagagctaagtccactactaacatggaggatgaagtttaaccccaagcacctccatcacccatccaccttggttgcttcgaacatcaaggaccacccaccatcgatccaaacctcacagatgaagacattgcaagaagttatcacatgcccttcgtccatgcataaggctaatgaagttgcaccatcttctactacattggatcaatctacagagattgaggtccttcctccaccaacttggaagcatcttcaccctaagatatccaagccttcgtccctaatgaccttgcagaagactgtttacaagattccatatggggcttacaaagaagtggtcacctatgacagacatttctatggccatcaagccattcctttgactaaggaagacatcttcaatgttgggatgatattgatgcagtgtggtctaactaaccagtggccaagctaccctctaggaattcttattcgactaactacaaccattaagttcatgctagatagaatagctctgaggttgcctccactggaccttaggaaaaagaaaggcaaggatacggctaaaaagactgtcattctaaagccagacattgagttcgatcagaacgacaccatgctcttttacttcaatgacatgtatgaaaactcacatcttgcgtccacattagagtatgacaaggaagacacttccaatcatatgtgcatggtgaaaatcttgcatccaacaaagatttacgaattcatggattggcagatgtgcttcttaaggtag

SEQ ID NO: 46168 - DNA, 533 bp, Glycine max
  Peptide Sequence Number=SeqID_137853
gctgctctaactcagatgctggtgcagatggtatggcatcatcagctcctctagaagaggctcctgggctacggaggccccaccccttccagaaggagaaggctggtactggagctgtggaagaagaaagagctggtgtctctggtggtgctgaagtagtgggggcctctgatctcttacctctggccttccttggccctctaaatgtcactgttggatcatcaagattccaacagttcttcttaatatatgccaagttaatgagctgtgatcaaggtagggaatccaattctggatgtgtcatgttgtgcaatcagagagatctcctgggagatgaggtgatgaacaaaaagctcaaaagatcaaagaacaactcaagtgaatcaaagaacatctcaagtaaatcaagaacaagtcaagagttcaagaatcaaggagaattcaagactcaagaagaaagcctagaatcaagaatcaagactcaagatctcaagaatcaagatcaagattcaagactcaagattcaagaatga

SEQ ID NO: 46169 - DNA, 458 bp, Glycine max
  Peptide Sequence Number=SeqID_137854
atggggacaaatcaaaacggaaaaagattttatcaagtcaaggttaagggtctagatgtcaccagcctcaaggaattaggacgattgatgggacctctccaaaggcaagccttccgcaaagtgtacggaaagattctagatttgaccgcagcggaggtatttacggaagttgttgtatccctcgcccaatactatgaccagctgttgagatgcttcacgtttggggacttccaaatggtaccgactgttgaagagtttgaggagatattaggatgccctcttaggggaagaaaaccgtaccttttctccgggtttcttccctctttgagtaagattgcagctgtggtcggagattcggcaaaagagttggatcgcatgaagcaaactcaaaacggcgtagtgggcctgccgcagagatacttggaaggcaaggcaagggatatggcaagccaagagaa

SEQ ID NO: 46170 - DNA, 403 bp, Glycine max
  Peptide Sequence Number=SeqID_137855
gggtctctgccagtcgttcggggttcctgtcgcgcccagtaaggtgatccgaccgccgatcactcgcgctttcatagagaaatactgcacagctagacaggcacagggtggcgaccctcaggccccagatgcacagccgccacctcctcaggttgacctagttgggtcatttgacacggagagcctgcagagccagggttttgcttcttttccatgccctactctagatcagttcagggcagaggtcgcatggccgggagattggcctgaggcccaggcagcagaggtaggggaggcacccacagagccacttgcagaggctcccggcgaggcagatgaggcccgtgaggacgaggagatgaccgatttgcttgatttcttgggagggagtggagccacatga

SEQ ID NO: 46171 - DNA, 552 bp, Glycine max
  Peptide Sequence Number=SeqID_137856
atgattatgaggggccaagacatttacagtagccaagtagaggctactacttcaccttcctctagtgaaagtgaagaagccaaagggaaagaatctagagaagaaatctacccccaagaagaaggacaacctttaatggttaagaaggagtgtaaggaggtaagtgtctcctccaagaggttagctaagaaggaaatttattttgcaataaagacaaaaattaaagaaacttcccctcttagacaacctacacatcttctcctttgtaaaaagacacttcttagcactgccacacctcttgggcttgaggttattcctcaagtaaagaaattgttggatgagggtttggtgtgtagagggaaggagctcagagtattaagaacctcgggatttgagataaactctagcttctcaaggaagcttctcaaggaagcttctcaaggaagtttctcaaggaagcttctcaaggagtggatggcacctcctttcacctcttcttctttatcttctactacatctctatggtggaaaatcaccattgaaggaccttag

SEQ ID NO: 46172 - DNA, 402 bp, Glycine max
  Peptide Sequence Number=SeqID_137857
atgggtgacaaagaggaagtacaggaacagatgaaagctgacatgtcggctttgaaagagaaaatggcttccatgatggatgccatactaggaatgagacaactaatggagaataacgcggccaccgccgccgctgttagttcagctgccaaagcaaacccaactctcctagctaccgcgcaccaccctatcccaaacgtggtaggacgagaaagaagcacactggggcacatcagcaaccccatccagggagggccacccctggtagcagatgaaaaggggaagctcgatctcatcgaggagagattgaaggctattgaaggctttggcgattatccgttcgcagacatgactgacctttgcttagtgccggatgtcgtacaaagggacgacttgtcctaa

SEQ ID NO: 46173 - DNA, 258 bp, Glycine max
  Peptide Sequence Number=SeqID_137858
atgcttagcgggctcatcacttatattcatcatcagggaggaatgcgcttagcacgacatggtccgcttagcacattcatctggaaatccaaaattttaacagctgcgatgaacaggctaagcgcacagggaaatccggtttgccggaaagcgcaccagattgtcaagtatttaaaaattaaaatggatgaattcgagtatcgaactcagggaaacaagtctaagactgggttaaattcagaaataaggcattgttga

SEQ ID NO: 46174 - DNA, 279 bp, Glycine max
  Peptide Sequence Number=SeqID_137859
atggttcccgagggactttggtcgcatgctctcaaacacacacgccgggaaaaacgtggagcccaagaagggaattcttttgcttctcatgcactgttcattccctttggttttggaaagctgatggcgcaaattctgctccatgggactcttcatgccactatctatgaagtcgataagctcaaaattggtggaggcaacaatttaaccaagtttattgataatcttgcaatggtatcagcgcggcctctgtcactggcttctccaaacagagaataa

SEQ ID NO: 46175 - DNA, 174 bp, Glycine max
  Peptide Sequence Number=SeqID_137860
atgggttcaatgcttgaaactgaaacaacaaatacgttgagggcaagcgagaatggtgaagggttcaatcgaaggtcacaaggctgtctacagggttcaatgctcaagggttcaatgctaggtctcagtgctgtgttcaaaggaaaagacaatacgttgagggaagcggtttaa

SEQ ID NO: 46176 - DNA, 1284 bp, Glycine max
  Peptide Sequence Number=SeqID_137861
atggacgaacaagtctcgagtgtgtcaagtgtgtcgacatttgtctggaacctcaaattggaagccaacaatcctaattgggaggcaataaaatcccaagtccacaaggcactagtagattatggttgctttgaagcaatttttgaaaaagttcctttagaacttcgcaaagccatatttgctgcactacaagagctctttgatctccctctacaaacaaagatactcaatgtgtctaagaagccttatcatggttatgttgggcaagccaatatggtcccactttttgaaagtatgggcattgatgatgcaaatgtctatgaaaatgtagaaagcatgacaaacatcatgtggcctcatggaaacccaagtttcaggcatgacatagaaagtgcttattgggaattggttgtgaaggacatacaggatacttgcaaacttctggagccaatttacaatgaaacagatggggaagatggacatgtatctcttgcaatttccccaaagctagcaaatgacaccaaggggacaactgaggcagcaaaatggcttcataatatggttggaagtccatgtgtttacatgaaaattcctgccactgatgaatccatctcttccatgaaggaggtcatttctctggggataagtgtaaatgccactctcatattctgcctccctaaatatgaagcagtgattgatgcttacttggatggccttgagtcttgtggcatgactgatctctctaaggtttcaagtgcagcagcattctacatcagtagagtggatgttacacttgacaagaaacttgagcaaattggtactactgaggctcttgatctcaaaggaaagggtgcggttgctcaagcagtcttagcataccaactttaccagaaaaaattttctggtccaagatgggaacgcttggagaatagaggtgccaagaagcagaggttgatgtgggcttcaacaaatgtgaaaaatccatcttaccttgacacattttatgttaattctgttattggaccacatacaatttcaaccttttcagtacaagctcttcatgcattcatggaccatggtattctttcaagaatgcttgatgcaaaagtatcagaggctcaagacatttacaatgaaattgagaagttggggattgattggagttctgttggatcacaactggaacatgaggtgctggattctttcacaaaaagctttgacaatgtgcttgaatgcatgcaaaagaaggctatgaacatatattcatttcaaaagcacgtttaa

SEQ ID NO: 46177 - DNA, 324 bp, Glycine max
  Peptide Sequence Number=SeqID_137862
atgttatttatgctttgtttcgttaaactttttactggagagaagtcagctggtgcaaatgtgaattctccgagaggttttgaagtaattgatgacatcaaaagtaaagtggaggctgcttgtcccagagttgtttcttgtgcagatattctagctattgtagcatgtgattccgttgttgcagacaaccgatgtaggattgctggatattctacatcgattattaggaaaaccgatgtagaatgttttaccatgggtagcattctacaacatttcgcggccacgaccgatgtagaattccaatcattctacatcggttattag

SEQ ID NO: 46178 - DNA, 823 bp, Glycine max
  Peptide Sequence Number=SeqID_137863
agggctacacgccctcaccttcagagggttgcactccctcgccttcatagggctacacatccttgccttgagagggctgcaagccctcgccttcatagggatacacgtccttgtctttagtggactacacgtcctcacctttagagggttgcacgccctccccatcatagggctacacaccctcgccttcagaggactacacatcctcgccttcagaggactacacgttctcgccttcagagggctacacgccctcaccttcagaggattacatgtccttaccttcagaggactgcaagcccttgccttcagagggctacacgtcctcgccttcagaggactatacgtcctctcctttagagggctacacgtgctcacctttagagggctacacatcctcatctttagagggttgcacgccctcgccatcaggggactacacgtcctctccttcagaggactacacgtcctcaccttaagaggactacatttcctcatcttcaaaggactacacgtccttgccttcagagggctacacgccctcaccttcagagggttgcactccctcgccttcatagggctagacgccctcacctttagaggactacacgtcctcgccttcagaggactacacgtcctcgccttcagaggactacacttcctagggcactcctcttatattggaggagggccaactgtgcgagcacaaccagaggaggaggctatcatgcaactactctacataccggggcaagatttcgcccgagccgctgcaaatagacgagtgcggatcatgcgcaccaacatgaccactcttacatag

SEQ ID NO: 46179 - DNA, 241 bp, Glycine max
  Peptide Sequence Number=SeqID_137864
atggctgcctataaatctgtcaatcttaatcatatgaactatgtgccgatgctattcactttacaacatattttgcacgtctacgagaacccctttggtttactaccacacgaatcaatgtggcaagaatataaacgagatcagtggggtcctaatccaaggagaaagaggactgcaaagggtcgttccatttcaactcgcattcctattgagatggacgaagaagaaaatgaacggaaaa

SEQ ID NO: 46180 - DNA, 574 bp, Glycine max
  Peptide Sequence Number=SeqID_137865
atggaaaccgtgaaaatccgtaatcacgatatgtattgggatattgccgccgatatccatttcccgccaaactttgacaagtcgaaaaaatatccggctatcatcagcgcacaccctatcggaagctgcaaggatcaaacctcaggcaacgtctatggtgttgctcttgccaaggagggcttcgttgtcatcgctttcgatgcgagcttccagggtgccagcggcggtgagccgcgtttcatcgaagacccaacattgcgcgtggaggactttcgccatgtggccgattatctggtgacgcttccctatgtcgacgaggatcgcatcggtgtcctcggcatctgcggtggtggtggttactcgatcaacgctgctatgaccgagcgccgcatcaaggcagtgggcactgttaccggcgcgaactatggtcgcctgatgcggggcaacttcaccggcctcaacccaataggtgctctggaggcaatggccaagcaacggaccgctgaggctcgcggcggatctctccacgtcgacaatttgctggccagttctgtcgaggaagcccgtgctgccg

SEQ ID NO: 46181 - DNA, 221 bp, Glycine max
  misc_feature (210)..(210): n is a, c, g, or t
  Peptide Sequence Number=SeqID_137866
atgagggacatcgtgcatgagcctcaagtgaacataggggcagatcaaaagttctcactcgtcgatggtggacccttgggtacttgtacctatcaccttgagaggactacacgtcctcgccttgagaggactacatgtcctcaccatcaaagggctgcacgccctcacctccagaggactacacgtcctcgccttaagaaggctacccgncctcgccttgg

SEQ ID NO: 46182 - DNA, 276 bp, Glycine max
  Peptide Sequence Number=SeqID_137867
atggtagccataaccccatccaaggttcatcaacctccatttctccgagaatacaactcgaatgcaacgtgtgcttgtcatggagaagcctcgaggcattccattgagcattgtatggccctgaagcgtaaggtgcaagccattggtctgtttgctcaagcgacctgtgctcctgagtttggacttccaagaccggtcaatcagaaattactcgtcttgcacgttggtgggggtgccgtaaaacaacgagtaaagttcaagacaaataagttttaa

SEQ ID NO: 46183 - DNA, 785 bp, Glycine max
  Peptide Sequence Number=SeqID_137868
gatcccactagaggatgagctcgagcctgtcatttcacgaggcttcaataagaccaacatggagacacttcagaaggtccgcaaggcatgggaggtgttgcaaaagaaggacaaggaactctggggcagtaacaatgggcccatcggtggctatcgtaagtggttaaaagcccacgtgcaaggtttggattggctctcgagtttgagaaccgctaaaagggaggaagttgaggcaccggaggaagacgaagaggtgcaggcccttaggatggaactcaagcaagctcaaacagtcaaagaaaggttcaaatcagcagctcttaaaatccgaaaggagaatgccgaactgagagatataaatatagctaccaccaaggctttggaacaagagaccaagagggcttgtagggaagagcacggccggaacaagttccgaggggctctgtggggtagcaacagcgaccttaaactccgaagagaggaaagggaccaatcacgagtagacaagaccaacatgttagctattatcaccaagtaccaagaagaactaaatctagccgcggcccacgagcatagagtggcagacgagtatgcccaagtgtacgcagaacaggaggctagaggaagggtgatcgactcattacatcaagaggcaacaatatggatggaccgattcgctcttaccttgaacgggagtcaagaacttccccgattgctagctaaggccaaagcaatggcggacacctatttcgccctcgaggagatccacgaacttctcggctatt

SEQ ID NO: 46184 - DNA, 229 bp, Glycine max
  Peptide Sequence Number=SeqID_137869
ctgggcagaaggaaaagaggctcctagcgtgaaggttgcttgtctcgcccaggaggtgggaacagttgaaaacaaagtggcgaacgggctgaccaagccaatgatgcttagctggtcttttcggatgatcagccacactgggactgagacacggcccggactcccacggggggcagcagtggggaatcttggacaatgggcgaaagcccgatccagcaatatcgcgtga

SEQ ID NO: 46185 - DNA, 591 bp, Glycine max
  Peptide Sequence Number=SeqID_137870
atggaggaatcccatcgggaaaacaacaaatataacatttcccagtcaagagggtccgctcttgacggtgaagaacacattggagaatggaggaatccaatcgggaaaataacaaagataacatttcccagtcaagagggtccgctcttgacggtgaagaacacattggagaatggaggaatcccatcggaaaataaaaaatataacattacccagtcaagagggtccgctcttgacggtgaagaccaccttggagaatggaggaatccaatcgggaaaataacaaatatcacatttcccagtcaagagggtccgttcttgacggtgaagaacacgttggagaatggaggaaaatccaatcgggaaaataacaaagatcacatttcccagtcaagagggtccgttcttgacggtgaagaacacattgtacaatggaggaatcatcgggaaaacaacaaatataacatttcccagtcaagagggtccgctcttgacggtgaagaaaacacgttggagaatggaggaatcccaatcgggaaaataacaaagatcacatttcccagtcaagagggtccgctcttgacggtgtag

SEQ ID NO: 46186 - DNA, 486 bp, Glycine max
  misc_feature (42)..(42): n is a, c, g, or t
  Peptide Sequence Number=SeqID_137871
atgcagctcccggagacggtcacagcttgtttctgtaagcgngatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctttcaacaaggtggggtttgggagggtcgagggagaaggttggagtcccattcaagtggctcaatatactaagtccctggcgtga

SEQ ID NO: 46187 - DNA, 207 bp, Glycine max
  Peptide Sequence Number=SeqID_137872
atgatggcacatcatggaagcagtgttttccaagattattttgatgatgccaaatactcaagtctagaatcaagagtcaagcaagtttcaagaatcgaagagtctttcaatcaaagcaagtttcaagaatcaaagagtcgttcaatcaagactcgttcaatcaagaatcaagattcaagtaaaagaatccagagaagactcaattaa

SEQ ID NO: 46188 - DNA, 384 bp, Glycine max
  Peptide Sequence Number=SeqID_137873
atgggaacaaatcaaaccggcaagaggttttaccaagtcaaggttaaaagcctagataccaccagcatcaaggaattagggcggttgatggaacctctccaaatgcaagccttccgcaagacttacggaaatatcttagagttgaccacagtagaggtatccatagaagctattgcatcactcacccaatactacgaccagcctttgagatgcttcacgttcggagacttccaattggggaagaaaaccatacctttcctccgggtgtctcccctctttgagcagaattgcaactgtggtcaaggattcagcaagaggtttggaccgcataaaacagactcgaaacggcatagcgggcctaccacggaagtacctagaagataa

SEQ ID NO: 46189 - DNA, 240 bp, Glycine max
  Peptide Sequence Number=SeqID_137874
atggagccgctagaactccaccaacgtaagatcccgggaaattcaaatggtcgtaacttctcacacggaggtccgattcaggcgcataatatatcgagacgctcgaaattgaacaacggaagctctcgagaattcaatggtcataacttttcacacggatgtccgattcaggcgcataatatatcgagacgctcgaaattgaacaacggaagctctgtcgagaaattcaaatggtcataa

SEQ ID NO: 46190 - DNA, 573 bp, Glycine max
  Peptide Sequence Number=SeqID_137875
atgaagaagaaccgttccgcgaacaccgtgtcccgcaagcgagcgaaggtcgctcgcagagccgcccggcgaacctcgtcggagccgacgaccccgatccgtcggcgaaccgcggtgatgctcggtggcgagctcttgatctgcagccgatgcgggcgcaccgccgtcgacatggcggacgccgaccggtggaacgccgcattcgactcgggatacgtccgtggctacatctgcccggaggatcagtcgccgctcgactcgctcgaggcccagatcaatgatgtggatctcggggcacctgtctcgtggaacgacctcgactcgcgtcaggtcgccgagctcgtagtgcggacgatccagcagcgcacgactcgcgtgatccgcggtcacgcggaccgtgcggccgcagcgggggcgacggcgatagagatcgacgtccgggcctggctcgatgagatcgttgacgtccgtcatccgctcttccaggggcagtctgaggcactgctcgaaagcgcacgggccgccgccatcgacgagatccgcgagatcctgccggctggcatggatatctga

SEQ ID NO: 46191 - DNA, 441 bp, Glycine max
  Peptide Sequence Number=SeqID_137876
atgacggtgaaaacctctgacacatgcagctcccggagacggtcacagcttgtctgtaagcggatgccgggagcagacaagcccgtcagggcgcgtcagcgggtgttgtcgggtgtcggggctggctttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccaaatatgcacatcgttga

SEQ ID NO: 46192 - DNA, 390 bp, Glycine max
  Peptide Sequence Number=SeqID_137877
atgcggtcatgggtgaggggtcagtggattccctttgacacagatgccctcggcaagttcctgggtgacccgctagtgttggaggaaggccaggagtgcgagtttagtcagaggaggaacaaggccgatgggttcgacgaggaggccattgcccagctattatgcacaccgggtgcggatcatgcgcaccagcatgaacaccttgacccagatgtggatgacattgctgctcagcaatgtatgccacccaccaggcaccctctagacccgaataagtctaacagggccctggggtttccggcattgatcacgggcctctgccagtcattcggggttcccgtcactcctagcaagatgatccgaccgccgatcacccgggccttcatttaa

SEQ ID NO: 46193 - DNA, 1285 bp, Glycine max
  Peptide Sequence Number=SeqID_137878
agggctacacgtcatcgccttcagaggactacacgtcctcgccttcagagggctacacgtcctcgcattcagagggatacacgccctcgccttcagaggacaacatgtcctcgccttcaaaggactacacgtccacgccatcagagggctatatatcctcgcctttagaggactacacgtgctcgctttcagaggactacacgtcctcgccttcagagggctacacgtcctcgcatttagaggactgcacatcctcgccttcagagggctccacgccctctccaccaataggctacacgccctcgccttcagagggccgcacatcctcacctttagaggactacacgtcctcgccttcagaggaatacacatcctcgcgttcagagggatgcgcgtcctcgccatcagaggactagacgtcctcgaattcagaggactacacggtttcgccttcagagggctacatgtcctcgccttgccttcagagactacacgtcctcgccttcaaagggctacacgccctcgccttcttagggctacacgcccttaccatcagaaggctacccgccctcgccttgcttttagaggactacacatctttgcaatcagaggactacatgtcctcgccttcagagggctacacgccctcgcctttagaagactacacgtcctcgcctttagaggactacacctccacgccttcaaagggctacaccttctcgcgttcagaggactacacatcctcgccattagaggagtacacatcctcgccttcagaggactccacgtcctcgccttcagaggtctacacgcccatacctttacagtacgacacgtcctcacctttagaggactgcacgccttcgccttaagagggccgcacatcctcgccttcagaggtctacccatgctcgccataagagaattacacgtccccgccttcagaggtctacaagtcctcgccttcagagggctacacgtcgtcctcgccatcagagggctacttgcccttgcctttagaggactacatgtcctccccttcagaggactacacgtcctcgccatcagagtgctacacgcccttgctttgagagcactacacatcctcgcctttagagggctacatgccctagccttcagagggctacacgttgtcgccttcagagaactacacgtcctcgccttcagaggactacacgtcctcaccttcagaggactacacgtcctcgccatcagagggctacatgcccttgcctttagtggactacacgtggggatcctctag

SEQ ID NO: 46194 - DNA, 3502 bp, Glycine max
  Peptide Sequence Number=SeqID_137879
aggactacacgtctcgccttcagagcactacacgtcctcgccttcagagggctacacgtcctcgcctacagaggactacacgtcctcgccttcagatagctacacttcctcgccatcagacaactacatgtcctcgccttcagaggactacacggccgcatatcctcgccttcagaggactacacgtcctccccttcataggactagacgtcctcgccttcagaggactacacgtcctcgccttcagaggactacacgtcctccccttcataggactacacgatctcgccttcagaggactacacgtcctcgactatagaggactacacgtcctcaccttcagaggactacacgtccctgccttcatagggttacacattctcgccctcagaggactacatgttctcgccatccgagggctacacgtcgtcgccttcagaggactacacgtcctcgccttcaagggactacacgtaatcgccttcagagggctacacgtcctggccttcagagggctacacgtcctcgccttcagaggactacacatcctcgccgtcataggagtacacgtcctcgccttcagaggactacacgtccttgccttcagaggactacacgatgacacttcctcacctttagaggacaacactcctttgccttcagacggccgcacatcctcgcctttcgaggactacacagggctacacattgtcgcctttagaggactacaggttttcaccatcagaggactacaggccctcacctttagaggactacacgtgctcaccttcagaggacttgacgtccgcaccttcagagggctacacgccctcgcctcgacaacagaggactctacgactacacgtcctcgccttaagaggactacaccccctcaccttgctttcagagaacatcaaatcttcgccatcagagcactacacgtcctcgccttcagaggactacacgtccttgccttcagaggactacacgtccccgccttaagagggatacaggtcatggccttcagaggactacacgcccttgccttaagagggctacacgtcctcgccttcagaggactacacgtcctcgccttcagagggctacacgtcctcgccttcagaggactacacgtcctcaccgttagatggctacacgtcctcgccatcagacaactacacgtcctcgccttcagaggactacacgtcgtcgccttcagagggctacaggccctcagctttagaggacaacacatcctcaccttcagaggactagacttcctcgccttcagagggctacacgcccttgcctcgacgacaaaggactctacgactacacatcctcgccttcagatggctacacaccctcaccatcaaagggctacataccctcgccttgcttttggaggagaatacattctcgccatcagaggactacacgtcctcgcattcagaggactccaggtcctcgccttcagaggactacacgtccccgccttccgagggctatacgtccctgccttaagaggactacaaatcctcgccttcagagtgccacacgtcctcgccttaagaggactacacgtcctcgcctttaaaggactacatgtcctcgccttcagagggctacaagccctcgccttcaaagagctacacgccctcaccatcagaaggctacccgccctcactatgctttcagaggacaacacatcgtcgccatcagaggactacacgtccaaacctttagtggagctacacgtcgtcgccttcagaggactacacgtcctcgctttcagaggactacacgtcatcgccttcagagggctacacgtcctctccttcagaggactacacatcctcgccgtcataggactacacgtcctcgccttcaaaggactacacgtactcgccttcagaggactacacgtcatcgccttcatagggctacacgcccttgccttcatagggctacacgtcctcgccttcagaggattgcacgtcctcgccttcagaggactacacgtgctcagcttcagaggactacacgtcctcgccttcagatggctacacgccttcacctttagagcacaacaaatcctcaccttcagaggaccagatgtcctcgccttcagagggctacacgccctcgcccgacttcagaggactacacgttctcgcattcaaaggactacacatcctcgccttcagatggctacacgccctcaccatcaaaaggctacacgccctcgccttgctttcagaggacaacacatcctcgccttcagaggactacacgtccttgcgtttagaggactacacgtccctgccttcagagggctacacgtccccgctttcagaggactacacgtcctcgcctttagaggactacacgtccttgcctttagaggactacacagggctacacgccctcaccatcagaaggctactcgccctcgccatgctttcagaggacaacacatcgtcgccatcagaggactacacgtccaagccttcagaggaggactacacgtccctgccttcagagggctacatgtcctcgccttcagaggactacacgtcctcgccttccgagggctacacgtcctcgccttcagaggactacacgtcatcgccttcagaggactacacgtcctcaccttcagaggactacacgtcatcgccttcatagggctacacgtcctcgccttcagaggactacacgtcctcgccgtcataggactacacgtcctcgccgtcataggactacacgtcctcgccttcaaaggactacacttcctcgccttcagaggactacacgtcattgccttcagagggatacacgccctcgccttcagagggctacacgtcctcgccttcagaggactacatgtgctcggcttcagaggacttcatgtcctcgccttcagatggctacacgtcctcgccatcagaggacaacacgtcctcgcctttataggactacaggtcctcgccttcagagggctacaggccctcacctttacagggctacatgcccttgcctcgacttcagaggactacatgacaacacatcctcgccatcagaggactacacgtcctcgccttcagggactacacatcctcgccttcagaggactacatgtccccgccttcagggctacagtccttgcctttagaggactacatgtcctcgccttcagggctacacgtcctcgccttcagaggactacacgtcctcgccttcagaggactacacgtcccttcagagggctacacgtcctggtctttagagggctacacgtcctcgccttcagaggacaacacgtccaagtcttcagagggctacacgccctctgtcataccctaatttcgtccggagaccttttcttggtggcatgcaactttcatttaaccattttgaggcccacttgggccctccagaagattcctccagaaggcggttgcttctggaggaagtcaccttgctcgcctgggcgagctgg

SEQ ID NO: 46195 - DNA, 498 bp, Glycine max
  Peptide Sequence Number=SeqID_137880
atgccaccacgagatccgctccggtcatcgtgcgcaaaggccaggtacccaactctctgcttccaaaccctctccaacttctcaaacctcgccacgaagcccttggacctagcccaagccgcgatcaaggttagcctggctcgcacgcgcaccctctccgtttacttcaagacgctgaatgccacgtcgtcgcgtttcgggaagaggcagcgagttgcggtgagtgactgcgtggagcagatatccgactcggtgactcagttgatcaacacgctcaacgagttgcagcacctccgcgccggaaccttccagtggcagatgagcaacgctcagacgtggaccagcgccgccctcaccaacggtgacacttgcctcagcggcttcaacgacgggggtaccgagctcgaattcgtaatcatggtcatagctgtttcctgtgtgaaattgttatccgctcacaattccacacaacatacgagccggaagcataaagtgtaa

SEQ ID NO: 46196 - DNA, 202 bp, Glycine max
  Peptide Sequence Number=SeqID_137881
atgggtgccaagtacctcgaagcggtcaagcaaaggttgcatgccatcaaacaatggtccccggacaaaattaggaaaaatgtatgtgatagtgtcattgggatgctcctttacgttcaaggcaagacgaaagatggtctgaattcccgtcaagatctagctgacatgggtatacaatcgcaattgcatccaaggtttgatg

SEQ ID NO: 46197 - DNA, 540 bp, Glycine max
  Peptide Sequence Number=SeqID_137882
ggctgcactacctcgcctttagaggactgcacgtcctcgtcttcagaggactacacgtcctcaccttcagaggactacacgtcctcgcctttagagggctacatgtcctcaccttcagagggctgcacgtcctcgccttcagaaagctacgcgctctcgccttcactcctgggccaccccctgatattggaggagggccaactcaactttctgcccagcgaccgcaatgccgatctccccctgcggatgtatcagttggtctgtgtcgtcccgacataggtaagtatgcatatggttcaactgatttcttataccatccactatttgcagggatcgtgctcgcaagacacccagtggacccggagaagttcaacagggtcttgaggtttccagctctgattacgggcttctgtcagttctacggagtgtctgtcaccctcggcaagggcgaaacaccacaataccctggggatggatggcagcgggcaacaaatgcactgccaccacctctagagttcatctcagctcatccacgaaaag

SEQ ID NO: 46198 - DNA, 621 bp, Glycine max
  Peptide Sequence Number=SeqID_137883
atgacaagcagagaccaagtttggtcattctgcacccaagatacgcggagataccttacggttgtccgcacccttttgtcatccagaggcggcgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatccgcacccttttgtcatccagaggcggcgggcccgatgacaagcagagaccaa

SEQ ID NO: 46199 - DNA, 1068 bp, Glycine max
  Peptide Sequence Number=SeqID_137884
atggtggaaccattaaagaagcacaaaggttcttcgagtagaagccaacgacactccgagactcaggatattccaattccttcctctatttcctcctcctcattgttctcatcggatgaacaacgtatacagtacacaaacctattctcctctcattctatcattgaccctaagttcatagatatgtatttcttttctgatgagagtttcgaatgcattcaagcatttcaaaactcaaatctcattccctttatgtctccaaaattgcctgtatactctgaattggtaaaagctttttattctaaccttgaaattcaagaaagtaccttgatttcagaagtttatgggataaatatggtcattgaccaatccctcttctatgttttgacccaattatctagtgacggtgtaccatttgaaggtacattggacgacgattggaaatttgatttttctgtgcatgatacccgtcggttggtttgcaccaaccaagcggatatgaccggaaggatgcttgccggttcattggctcttgaaagccgcacccttcactatcttattgttcatattttacttccaagatcttcaaaccttgctcaggtttctgaagaagatcgtatagttatgtgggcttttcatactggccgacaaattggttgggcacatttagtccgatattgcatgcataaggcattgcaattaaatgctcctttaccatatccacatttagtcactcttttccttcaacatttcaacatccttcttgattttgaaccttatgttccaatcaagagatctttcttaatcggtgctgttgtggttgcatcatttggttaccgcaaagagcgtgatggctcttgggtaaaaaagggtactcaaccaaatgatgatgaaggacaattatcagttgaaggggactcttctctccttcaaagtattttagacaggttcgatggactccaaacatatgttggtgaaaggtttgaagcactggtgcacagcattccacaatgcctattttgggaaaagagccctagaagcaacgaagaggaacaacttgcgcattga

SEQ ID NO: 46200 - DNA, 225 bp, Glycine max
  Peptide Sequence Number=SeqID_137885
atgcgtgttccacgaaaggaatacgcgtggagtcgccaccaacgtttatttgaggaaaacgtcagaaaaaccggaaaagacgcgatctacgaactcttaagtgaaaggttcgggagttgtatttacgcacggggaagaacttgtaaaaggaatttacaagatagtggaactctcaagcgggttgcttggggactggacgtaggcacaagggtgtggccgaactag

SEQ ID NO: 46201 - DNA, 231 bp, Glycine max
  Peptide Sequence Number=SeqID_137886
atgttgggacctatacacgattctcctcaaatttcagccagcccacatcaattagactttgcaccttacgctttagggtcatacgatgctcaatggaatgccccggggctcctccatgataagcacacgttgcgttcgagtcgtatccttagaaaaatggaggtgggttttgttgttgatttagggatgacctttgtggataaatgggtggtgggtaatgagaatggctga

SEQ ID NO: 46202 - DNA, 420 bp, Glycine max
  Peptide Sequence Number=SeqID_137887
atgggtttaggagaagaagtattagctcaagaagatgagaggggtagatgttttgagcctgaaacctctgaggatgagtggcgaaagtctcgaactagatctcttaggagaaaagcaatgactgcttcaaccagactcgcttatagtctcaggaagcgtaatacacgtgtagcaaatagtgactttgcttcaattttcatagaagatgtccgcgatgctaacgaggaaaaatctgtgaattcattttgtcaggtgctacttacaagagatctgcttccaaattcccatgatgattatcatgaaatgctgaggagtatgaagaggtacagtgttattatcctcatggctaccatggtgtgggcaaagagggccaaccggtttatattgaaagacttcgcaaagttgaacccaacaagttga

SEQ ID NO: 46203 - DNA, 780 bp, Glycine max
  Peptide Sequence Number=SeqID_137888
atggaagaaagcatgtctcctttccttgtgagggatttcggcgcacaaaatttcaaggctatacaagcaatccataaagcatgggaaaccccgttagattggctcgccaagttaaaagtcgtcagcaaggagagttttgaggcaccggaggaggacgaagaagtccaagctctcaaaagtgagttaggaaaggcgaaacttgccaaggagaagttcaagttggccgctacacacatcgggaaggagtgtgtcggattacgggaagagaatgcaactaccgcgagagcccttgaacaagagaccaagagggctcgcaaggaagagtatggccgtaacaaattttgcggagctctgtggggtagcaatagtgaactcaagctgcgaagggaagagagggaccagtcgcgagcacatagcatggtcttgaaagaggagttagttgcctgttcaaggtccaaaaggagcttgtctcagcatttatgcgagacggagaccaacatgctagctatcatcgccaagtaccaagaagagttagatctagccacggcccacgagcatagggtcgcggacgagtatgcccaagtatacgcggaaaaagaggctagaggaagggtgatcgactctttacaccaagaggaaaccatgtggatggatcagtttgctcttaccttgaacgggagtcaagaacttccccgattgttagccaaggccaaggcgatggcggacacctactccgcccccgaagaaattcatgggcttctcggctattgtcagcatatg

SEQ ID NO: 46204 - DNA, 291 bp, Glycine max
  Peptide Sequence Number=SeqID_137889
atgccgctcagccccgtgatatttgttaccttggctgacaacgagctgatgtcggtggcctcttccttcctttcagttggaggtgcatacctccacgagattgcgtggctgtttcggtatggaaacggaacaggtttaactaccgaggggtatcagggcttttggggagctgcgtctttggtgaaatataccaccaaaggcttaggtcttccaaaacttctctcatctggggactgcatacatatatgctgctcttccctcccctcatcgccgacttccagtcggctttga

SEQ ID NO: 46205 - DNA, 249 bp, Glycine max
  Peptide Sequence Number=SeqID_137890
atggtccatgacatctttgtcaaggtgaaactggaagtaacaaggacatcaacaatcctaaatgtgtttggcagtagacgaagcagcgataggaaaacgaaggatcatgcatgggcaaacatgaaaacaaaaggtatgcagtttgtacaacaaaaacaacctacccttcggcgggagggcgacgtgagactcacgggtgcatcttccaagaaaagaatacgtgtggagtctccaccaacgtttatttga

SEQ ID NO: 46206 - DNA, 708 bp, Glycine max
  Peptide Sequence Number=SeqID_137891
atgggtgatcaagaggagacacaggaacagatgaaagccgacatgtcggctctgaaagaacaaatggcctccatcatggatgccatgttaggaatgaggcagctcatggagaagaacgcggccaccgctgccgctgtcagttcggctgccgaagcagacccaactctcttggcaactgcacaccatcctccctcaaacatagtaggacggggaagggacacactggggcacgatggcagccctcacctgggatacaaccgagcggcttacccttatggattgccgcccaactactcaccacccgtcttgcaagacgatgcgggccatattgcttctcccgtccttgaaagagagcctcctcaacagcccgaagaagtccacaaagaccctcaagactatgctctaagggaggtcgagttctatcccctgatccccgaagggccggcacccagcacgttgcctcagcccaacatcgcaacacaaccaatagttttgtccacggaaggaccgttcccggcaactgaagaaaggaggaagctcaatctccttgaggaaagattgagggccatggaaggatttggggactatccgttcgcagacatgacggatctttgcttagtacctcgatgtcctttaatggtggttttccaccatggagatgcagcggaagacaaaggagaagaggggagaggaggcgccatccactag

SEQ ID NO: 46207 - DNA, 251 bp, Glycine max
  Peptide Sequence Number=SeqID_137892
ccggaagtggcgtctacccagacttatcttccttcaccggaagtggcgtctacccagacttatcttccttcaccggaagtggcgtctaccctgacttatcttccttcaccggaagtggcgtcatccaaaaactctacagcctgtatcaagtgatccgccccgtaagattcacatcatctggtatcagagcttcggctcttgatacagtgggcctcaaacagacaaccgtagcaaaagttatgagcatttga

SEQ ID NO: 46208 - DNA, 1239 bp, Glycine max
  Peptide Sequence Number=SeqID_137893
atggctgctacatttcctcaacaacttctggtgaagccaatccactttttcaagatcataaccgctcacaatgttcatgaaggaaagctacatgtgctgagaacaatactaccgatatcgatgatgatcccaaataagtttgtgaagaaatatggaaaacgcttacaaaatactctatttctgaagactccaaatggtgctgaatggaaaatgattttgaaaaaacgtgacggtaaaatatggtttcaaaagggatggaaagagtttgcagagtatcactctctagctcatggccatcttttggtacacatctttgatttgagtgccttagagattgagtaccctaccgaaataataaaaggtaaaacagcctccaatagaaaaggaaatgaatctccaggtgatgaacatttggagtgtcacagatcaggtcaaaagagaaaagttaactcagttgaatttcttcaacaatgtcaaatgagaagtcgcaagtgtgttaaagttgagaacacgatgatactgccaaggcaggctctgcatcacactgccacaaaatgcaaaggaaaatcgaaggctatggataaccaagttacagctcttgatagagcaagttctttcaaatcttgtaatccattcttcttgaccgtcatgcatcgaacccacatcagttctcacggtagtctgaacttaccaatgaagttctgtaggagtcaccttgatttgcacaagaagcggagacttatcagccttcaggtgttaagtgggagaatttggcctgcaaagtatcagatccataaacaaaagactgctataagatttaaactctcatggaacgcatttgtcaaggacaataacttgaaagttggtgatgtttgcatctttgaactcgttcatggaactaaactaaccttcctggttcacatcttcagagagacagatagttcaaattgttcaacgtctcaaggtaggattgatgtttgcttttctattccaacaattccttatatgtctggcagttatcactatccggatagtgaaggtactcagtcactcaattatagctatttggatagttatactcattctcgacgtctcgttctgaaagaagatattgggccactctcactcgctaatcgctcaagcctcaagggtcaaggactctttctctacttcgttgccctttctgtagctaccattggcatcgctctccaatgtccccacttttgtagccaccgttag

SEQ ID NO: 46209 - DNA, 1083 bp, Glycine max
  Peptide Sequence Number=SeqID_137894
tcgattgggaccaacatttggctgggataagaggcagcgcaatcaattggtttcctcgatggaaggaaggcaaggagggagttcttttctcgtgtggggactaccctaatgttccattgatagggactaggggttgtattaattataatcccgtactcgccataagacagctagggtaccccatgaggggagcgccaacggaagggagtctctcacctttccttgtgaaagatttaggcccgcaaggtctcaaggttatacaaagagtccacaaggcgtggagaagtccgttgaggaaagacaaggagcttagaggcatccgaaatggcgtcatcggtggttatcatggatggctaagagttcacacgcgagggttagattggctctccaagttgaaagttatcgatgaggagaacttcgaagctccggaggaagatgaagaagtacgagctctaaaattagagctagggaaggcaagactcgccaaggagaagttcaaattagctgctacacacatccggaaagagtgcactgagttacaagaggaaaacgcggtcattgcaagagcccttgaacagaaaccaaaagggcccgcaaggaggaatatggccaagagaaatccgaggagcattgtgggaagaagtttggctcaacacttggaagccacggagcaaagcatgctagctatcatagggcaatacaaggaagaattgaaccagtctatggcccatgaacaaaagctagtggccgaaaaagaagcaagagggagggtgattgatgcattgcatcaagaagcgactatgtggatggataggttcgccttgaccttgaatggaagtcaagacctcccgcgtctactagccaaagcgaaagccatggccaaagaacagatgaaggccgatctatcggccttaaaagatcaaatgacttccatctcggaggtcatgttaaaaattcagaaaaccatagaggacaaagccacggcaaccggctccagtacggttagggaagcggagccggtgctgcaacccggtttaaatccgcaagcttatccttatggcttgcctctggacttcactcccc

SEQ ID NO: 46210 - DNA, 258 bp, Glycine max
  Peptide Sequence Number=SeqID_137895
atgtccgagcgctcctccactcgccaatttcctagtcggcaatcaggtgggcatggtcctaccaaatccgacccactcggagcatcatcttcgcatattgcagcgacttggccttcgtcccctagacccgcgcttataaagctcctacttatgtggcagggcgggcttccttcgtcttcttgtcttaatcgcgagcctcgacttccgcttttccttctagcaatgtttttccttatatctgcctgtgtgggtttatag

SEQ ID NO: 46211 - DNA, 135 bp, Glycine max
  Peptide Sequence Number=SeqID_137896
atgtggaggagtaactggtttcttgaggttacatttgaatccttcatcacacaactgactgatgctgatcaagttcgcagtcagtcccttcaccagcagtactttgttcagactaggaagtccatcatggactag

SEQ ID NO: 46212 - DNA, 242 bp, Glycine max
  Peptide Sequence Number=SeqID_137897
atggaagaaagcatgtctcctttccttgtgagggatttcggcgcacaaaatttcaaggctatacaaagaatccataaggcatgggaaaccccgttaaggaaagatcaagaacttaggggcattcgtaatggcatcattggtgtcgtcagcgaagagagtttcgaagcaccggaagaagacgaagaagtccaaactctcaaaaacgagttaggaaaggcgaaacttgccaaggagaagttcaa

SEQ ID NO: 46213 - DNA, 198 bp, Glycine max
  Peptide Sequence Number=SeqID_137898
atggaatgccccagggctcctccacgatatgcacatgttgcgttcgagtcgtatcctcagaaaaatggaggtttgagggaacctagaaggggttatggcttcctttgcattatcaagctttcttgctgcacaactcatttcttggttggtgttttggtctacgctaaaggtggtgttttgtcattggaagtgcggtag

SEQ ID NO: 46214 - DNA, 447 bp, Glycine max
  Peptide Sequence Number=SeqID_137899
atgggtgaagtagaggaggtacaagagaagatgaaggccgacatggaggccatgaaagagcaaatggccacgatgatggaggccatgatgatcatgaagaagataatggaagccagtgcggttgcagttgccgctaccagcactgttgctaaggtgaacccgatgcccccatctggcctcaaccaaatgaatcatccaacctcagctatggtaggcaaggatttgggaagtacgggcggcccccatgatgtgaaaattcaaaacgagcacgccttcccgccatatggcttgcctctcaactatacgccacccaagtggcgtacactcccaataagaatgtcaataactccactcatatacccattgagagccaacaaccccaaactgatcatgcacatgtctcttaaaccgtgggggagacacatgaagttccccaacacaatctag

SEQ ID NO: 46215 - DNA, 255 bp, Glycine max
  Peptide Sequence Number=SeqID_137900
atgtcaaagaataatcaaacaaggttgcttcaagattacttcgacaaccattcaaaggttaagcattgctccaagattaatacaaggttgcttcaacaaacaagcattgcttcaagattcattcaagatcagcttttgtctcaaaacacgttgcctccaacatatcaaggcactggtaatcgattaccagacagtgtaatcgattaccataagacaagtttgccaatcagctttttaaaagggtttgaaatttga

SEQ ID NO: 46216 - DNA, 270 bp, Glycine max
  Peptide Sequence Number=SeqID_137901
atgcatgctcatgtcgtgtcatcacccatgcatcacatttgtctcgtcatctttgtcacaggaagccggaaggtccgcatcaccttcttaattgcatgcattgggcaccatgactcttgggtccgtagtgtcgcaacctacccttcggcgggagggcgacgtgagactcacgggtgcgtcttccaagggaggaaaatgctcggagttgccaccaacgtttatttgaggaaaaacgttagaaaaaccaaaaagcgggtctatgaactttaa

SEQ ID NO: 46217 - DNA, 429 bp, Glycine max
  Peptide Sequence Number=SeqID_137902
atggatgaatgcatgatggaatgcataggacacagatgcaatctaggaatgcgggggtccggggaattggtccccttcttagatacgacgtctaggggtagcaaaatgccccaacgcacgtttttaagaaggcgacacggaccctccgttggtttgtttacagtagggatcaagaagaacccatatgcaatgcctatgcaaaagacaccatgcgggaattccccagtggagtcgccaactgtcgcaacctacccttcggcgggagggcgatgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 46218 - DNA, 165 bp, Glycine max
  Peptide Sequence Number=SeqID_137903
atggaaagcaagaaagagaacaggagatcttcggaccagatgaattttcagcgagtcgctctcgactggcgatgtcctgccccacctaaacaaagaggaaaagaccgaaacacccagcttcctctccaaaaacactaccctcgagaaaatcctattgatccgtga

SEQ ID NO: 46219 - DNA, 480 bp, Glycine max
  Peptide Sequence Number=SeqID_137904
atggtaggttacacaccttcaagctttgcggatttggtcttcaccggtaaaaggatcaaagtgggtctaaaaaagggaaaatctgatcatcatgctttcatgaaaaaaactggggaaagtgaagaggatgagaatgaaggagaaacccatgctgtggctgccattcctatatggccaagtttcccaccaacccaacaatgtcattactcagccaataacaacccatctccttacccaccacccagttatccacaaaggcaatccctgaatcaaccacaaaatccacctaccacccaaccaatgctaaacaccacctttagcacgaaccaaaacaccaaccaagaaatgagttttgcagcaaaaaagcctatagaattcacccccattctggggtcctatgctgacttgctcccatatctacttgataattcaatggtagccataaccccagtcaaggttcatcaacctccatttttctga

SEQ ID NO: 46220 - DNA, 728 bp, Glycine max
  Peptide Sequence Number=SeqID_137905
agggctccacgccatcaccttcaaagggctacatgccctcgccttcagaggactacacatcgtcgcttcagagggattcacgcccacgccttcagaggattgcacgtcctcacctttagagggctacttgccctcaccatcagagggctacacgtcctcagcttcagagggctacacgtcctcgccttcatagggctgcacgccctcgcctttagaggactacacgtccacgccttcagaggactacacgtcctcgcctttagaggactacacgtcctcgccttcagagggctacttgccctcaccatcagagggctacacgtcctcatgttcagaggactacacgtccacgccttcatagggctgcacgccctcgccctcagaggactacacgtcctcgcctttagaggactacgcctcctcaccttcagaagactacacatcctcacctttcgagggctacacgccctcgccttcagaagactacacgtcctcaccttcagaggactacacacccttgccttcagaggactagacatcctcacctttagagggctatacgccctctccttcaaagggcttcatgccctcgcctttagaggactccacatcgtcgcttcagagggatacacgccctcgccttcagaggactgcacgtcctcacctttagagggcttcttgccctcaccatcagagggctacacgtcctcactttcagaggactacac

SEQ ID NO: 46221 - DNA, 446 bp, Glycine max
  Peptide Sequence Number=SeqID_137906
cgttgatcacgggtctctgccagtcattcggggttcccgtcacacctagtaaggtgattcaaccgccaatcacccgggccttcattgagaagtattgcacgcctagacaggcgcagggtgatgcaccacaggccgtagacgcaccgcccccacctcatcaggctgatccagctgggtcatttggcatggagcggtatttacaacacttggtgcagatccatgagtgtctctaccagctcagcctcagtctacagagccagggtttcgctccttttgcgtgccctactccagatcagttcagggctgaggttgcatggcccagagattggcctgaggcccaggcaggggaggcgcccgcagaggctcccggcgatgcagaggaggcccgcatggatgaggagatgtcggatttactcggtttcttgggagggagtggagccacatga

SEQ ID NO: 46222 - DNA, 150 bp, Glycine max
  Peptide Sequence Number=SeqID_137907
atgtgtgttcaagaagaggagagattgataatggaagagggtgagaagggtatggaaaacctaaggaagccagtgggaagtgagcagtgcatctactcagggagtaggatgagctcgcatgtagaggccattggaacactttggttttaa

SEQ ID NO: 46223 - DNA, 900 bp, Glycine max
  Peptide Sequence Number=SeqID_137908
atgccagccgcaataattatcacccagctaggtggacccgaagtactccgtaccactgacattgccattaaagcccccggccctgatgaagttcagatccggcatgaggtgataggcgttaattttgttgatatttactatcgctcaggcctttatccacaatcctcttccccagccatacctggctttgaggggggcggcatagtgacagcaaccgggattaacgtccgggcttttgctcagggtgatcgggttgcctataccggcaatccgatgggagcctatgccgaaataaggaatatcccggccagtcgcctcgtcagaattcccatgaatattgacatacgaaccgccgggagctctatgctccgcggacttaccgcgcatatgcttcttcataaagtcagaaatgtcagagagggcgactggattcttgtacattctgctgccggaggtctgggccagcttgttacgcgctgggcaacaatgaaaggtgcacgcgtcatcggcacaacgggctctgctgcaaaagtcaaaattgcacaggcagcaggggcaaaagaggtacttcttcataccgacgccgcatgggcggataaggcacgtgaaatttctgatggtcgcggtgtacatcttgccgttgatgggatcggcggaaccatgctttctacaacgctcagcgtggtacgtccgtttggcacggtggccagtctgggacaaccggctggtcccattcctccggtacgcgttgaagagctgggattcacccgcttgattgcactgatgaggccaagctcaatggcttatgctgatgacgcagaactttacgcgcagggagcgagagatcttatatcggcccttcagaacggacttataaaccctaggcacacgcagacctag

SEQ ID NO: 46224 - DNA, 132 bp, Glycine max
  Peptide Sequence Number=SeqID_137909
atggctggattagctcaacaaagcaagctcgacatatctatatatggcattaaaagtgagtcagagggctacaacaactatagtggaaaccctgcagcttcaattcctttgcacactagagctagtaattaa

SEQ ID NO: 46225 - DNA, 1001 bp, Glycine max
  Peptide Sequence Number=SeqID_137910
aaatacttggaaggtaaggcaagggatatggcgagccaagagaagtggggcccgtttgcggatatattagctttgttgatttttggggttgtcctctttccgaacgttgacggtttggtagacttagccgccattgatgctttcctcgcatatcaccatagcaaggaaagtccagtggtggctatcttggcagatttgtttgacacctttgaccggagcgcgatcaattggtttcctcgttggaaggaaggcatggaaggagttcttttatcgtgtggggactaccctaatgttccactgatagggactaggggggagcgccaaccgaagaaagtctctcgcctttcttgtgagggatctaggcgcgcaaggtctcaaggttatacaaagaatccacaaggcgtggaggagtccgttgagaaagacaaggagcttaggggcatccgaaatggcgtcattggagttatcgatgaggagaacttcgaagctccggaggaagatgaagaagtccgagctctaaagttagagctagggaaagcaaggctcgccaaggagaagttcaagtcagctgctacacacatccggaaggagtgcaccgagttacaagaggaaaacgcggccactgcaaaagcccttgaacaagaaaccaaaagggcccgcaaggaggaatatggccgagagaaattccgaggagcattgtggggtagcaacaatgagctcaagctccgaagagaggagagagatcggtcacgggcgcatggcatgatcttaaaagaagagttagttgcttgcgcaaggtccaaaaggaatttggctcaacacttggaagccaccgagcaaagcatgctagccatcatagggcaattcaaggaagagttgaaccagtctgtggccaatgaacaaaagctagtggaggattttgcccaagtgaacgccgaaaaagaagcaagagggagggtgattgatgcattgcatcaagaagcgactatgtggatggatag

SEQ ID NO: 46226 - DNA, 183 bp, Glycine max
  Peptide Sequence Number=SeqID_137911
atgggtgccaagccctcacaaggaccaaagaaaggtcgcatgtcatcaagcaaaggacccggacgaaaattagtgtatgacactaatttcctcctctcgggttgcgagatcggatgcaaaagaaggtgttcggataaccactcgggtattccgcgtatcatcgggcccgccgcctctggatga

SEQ ID NO: 46227 - DNA, 579 bp, Glycine max
  Peptide Sequence Number=SeqID_137912
atggttgattatgagtatttgaagatcgttcttgggggtggagtttctagcgggaataattctatatcagtcgatccagatgatactgatgcaaaaacttttgagccagaaaatagaactgttgggatagaagaattttcatatgatcctaatacatatcagcctccatcaccaaaccaaccaagtccaccatcccacccccctttagattcagaggttcccatagaaaaacaaaactatcacaagcgaaggagatccgagtatggagggagttcaagcgctgttgggattaacaatcaaggcaacgttctggaaaatctttctgttggcattgggactattgctgtgaattttgaaaaaatatccaacatgatggagaaaagagaaaaagatagagatagagatagagagctcgagggtattatttgggatgttataaaagaaattccaaatttggatgacataacgcgtttcaagacagctgaattgttaaatactaaagcaaaaaaggattttttcttgccgatgtcacaggaagaacgctcatcttggataaactttaagttagggaataattaa

SEQ ID NO: 46228 - DNA, 282 bp, Glycine max
  Peptide Sequence Number=SeqID_137913
atgtcggctttgaaagagcaaatggcttccatgatggatgccatgttaggaatgaggcaacttatggagaataacgtggccaccgctgccgctgttagttcggctgccgaagtagacccaactctcccagctaccgcccatcctctcccaagcgtggtaggacaagaaagaagcacacttgggcacatcagcaacccccatttgggatacaatcgagtggcttacccttatggattaccacctaattacacgccaccagtcatgcctgatgacccgggtcat

SEQ ID NO: 46229 - DNA, 471 bp, Glycine max
  Peptide Sequence Number=SeqID_137914
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgacagggttttcccagtcgactctagaggatccccggttagggctagtggaggttttgaagtgagggtcatgtttggggtggaaaatgctatggtagacattgttgtggacgaggtcatagtaaagatgggggttgtaatagggatcaataagggtagggtgagggaagtagaaatcgggggagtggatgagagaagggaaggggtaccgagctcgaattcgtaa

SEQ ID NO: 46230 - DNA, 291 bp, Glycine max
  Peptide Sequence Number=SeqID_137915
atgacaattgaggaatcaatacatgttacttttgatgaaactaatattacctccccgagaaaggagtttgttgatgatattgcatatgctttggaagatactcaaaatgaagaaagaaatctgaaaagaatgagagatgatgaagacaaggatgatcaagatgacacaacacaagaaaatgataatcttcccaaagaatggaaaacttcaagaaatcatcctcttgacaacatcatcggtgatatctcaaaaggggaggaggtatatgtggaacaacctcctgggttttaa

SEQ ID NO: 46231 - DNA, 267 bp, Glycine max
  Peptide Sequence Number=SeqID_137916
atggctcaaactccacctcgtgagaggactcttagggagatggctgcacctgatttcatgtatgaaagcttgtgcattcaatatcctgatgagggtgttccatatgttctcaagactggactaatacatttgctgcccaagtttcatggtcttctaggtgaagatcctcataagcatcttaaggagttccatattgtttgttccaccatgaagccccctgatgtccaagaagatcatatctttcttactcctttcctagttctctag

SEQ ID NO: 46232 - DNA, 570 bp, Glycine max
  Peptide Sequence Number=SeqID_137917
ggctgcacgccctgcgccctcagaggactacacgtccacgccttcagaggactacgcctcctcgccttcagaggactacacgtcctccccatcagagaactgcacgtcctcgccatcagaggactacacgccctcgcctacagaggactacacgtcctcaccttcatagggctgcacgccctcgccctcaaaggactacacagggctccacgccctcaccttcaaagggctacatgccctcgccttcagaggactacacatcgtcgcttcagagggatacacgccctcgccttcagaggactgcccgtcctcacctttagagggctacttgccctatccatcagagggctacacgtcctcaccttcagagggctacacgtcctcgccttcatagggctgcacgccctcgtcttcagaggactacacgtccacgccttcagaggactacacgtcctcgcctttagaggactacacgtccacgccttcagaggactacacgtcctcaccttcagagggctacttgccctcaccttccgagggctacacgtcctcgtcttcagaggactgcac

SEQ ID NO: 46233 - DNA, 1821 bp, Glycine max
  Peptide Sequence Number=SeqID_137918
gacatcgatggcgatcccgctgacgccaacgtcggcaatctgcgaaaaagtgagacgaaagccgtagagaatgatcccgagacgcagcaggtgctgtttggcgaagatcacgccgccgtcacaggatttccagatatgtgggtaaacggtgttacccacgaccatgccgagcaatatcgccagccgcaagacccggcacgaagtgccacaatgtacgatgatgctgtaagcaaccatgcacattacattgcgccagctggaagtctttgccgaagtgctgaaaagcgggtcgacgacgcaggcatcgcagatgctggcgctctcgcaatctgcggtcagcgcagccctgaccgacctcgaaggtcagctgggcgttcagcttttcgacagggtagggaagcgcctggtggtcaacgagcacgggcgccttctctacccgcgcgcgctggccttgctggagcaggctatcgaaatcgaacagctgttccgcgaagacaacggggcgatccgcgtctacgccagcagcaccatcgggaattacatcctgccggaagtgattgcccgttaccgtcgggattttcccaccctgccgctggaatgagcgtcggtaatagccaggacgtcatcaacgcggtgatcgatttccgcgtggatatcggtctcatcgaaggtccctgtcataacgtcgatatcattgccgagccctggctggaggatgagctggtggtctttgcgtccccggcctcgtctttattgcagggcgaagtgacgctggagcggctggcgcaggcgcagtggatcctgcgtgagcagggttccggcacgcgggaaattgtcgattacctgctgctgtcccatctgccgcatttccagctggggatggagctggggaactcagaggcgattaagcacgcggtgcgtcatggcctgggcatcagctgtctttcacggcgggtcattgctgaacagcttgagacggggtcgctggtggaaattcccgttccgctcccgaaactggaatccggatcgtctgctacaatcgcgcctcatttattaaatggacagcattttcatatggtttcagaaattaaaaccacagaagcgcccacgctacgtcgtgaactcaaggcgcgtcacctgacgatgatcgccattggcggctcaatcggaacaggtcttttcgttgcctctggcgcaacgatttcggcagccggcccgggtggggcgctcttctcttatatcctgattggcctgatggtgtacttcctgatgaccagtctcggcgaactggccgcgtacatgccggtatccggttcgttctcgacctacggtcaaaaatacgttgaagaaggcttcggcttcgcgctgggctggaactactggtacaactgggcggtcactatcgccgttgaccttgtcgccgcacagctggtgatgaactggtggttcccggatacgccgggctggatctggagcgccctgttcctggccgtcatcttcctgctgaactacatctccgtgcgcggtttcggcgaagcggaatactggttctctttgatcaaagtggcaaccgtcatcatctttatcgtcgtcggtgtggcgatgatcgttggtattttcaaaggcgcagaacctgcgggctggagtaactgggcgataggcgatgcgccgtttgccggtggcctttcggcgatgattggcgtggcgatgattgtcggcttctccttccaggggaccgagctgattggtatcgccgccggtattctggcgtatcctgctgttctatgtgttcgcgatcctgattatcagcctgatcatccc

SEQ ID NO: 46234 - DNA, 312 bp, Glycine max
  Peptide Sequence Number=SeqID_137919
cgtttcgtttctaaacgaccatttagaggaaagactgggtccaacaaaatagaagaaaatcactcaaagtgtatcaatctcacacagatctttgatcgggaactttctttgttctggaagcgtgttagcagctcaatagtgaatgactttttttcttgggagaccccattgttccttcttccgaggacagggatggaaatctcatcctgggtcaaggtttatagtggtttgaggtcttggctcaaaaggcttgcagaacggccaaacatgatgtatgtcacggtgttggtttggccagtggttcagggataa

SEQ ID NO: 46235 - DNA, 261 bp, Glycine max
  Peptide Sequence Number=SeqID_137920
atggatcgtgttacatcgctgcttcgtctactgccaaacacatttaggactattgatgtccttgttacttccagtttcaccttgagccatgttgaaaaatctaaattgattcaacctcatgtcctgcaacatgctttacggtgcccttaccgaacctgtgctagagctagagtaacgggtgaagtagaggaggcgcaagagcagatgaaggccgacatggaggccatgaaagagcaaatggccatgatgagcatgaagtag

SEQ ID NO: 46236 - DNA, 216 bp, Glycine max
  Peptide Sequence Number=SeqID_137921
atgaggggagcgccaacaaaagaaagtctctcgcctttccttgtgagggatctaggcgcacaaagtctcaaggtgatacaaagagtccacaaggcgtggagaagtctgttgaggaaagacaaggagcttagaggcatccgaaatggcgtcatcggtggttatcaaggatggctaagagttcacacgcgaggagaacttcgaagctccggaggatga

SEQ ID NO: 46237 - DNA, 222 bp, Glycine max
  Peptide Sequence Number=SeqID_137922
atgcttcatgagctagttcctttgcggagatctataagagaaaggagaaatgctattccagatgattatgtggtattttgccaggaacgtgaggaaaataatggtatgattaaagcaatgaatgaaaagcataagtccatgcaagacaacaagaccaagcgggattccaatggtaatgtggagaggtataaagctcgtcttgtggcaaatggctatacctaa

SEQ ID NO: 46238 - DNA, 435 bp, Glycine max
  misc_feature (295)..(295): n is a, c, g, or t
  misc_feature (397)..(397): n is a, c, g, or t
  Peptide Sequence Number=SeqID_137923
atgacagatcttgtgagcgcggaagatgacacagcaataaagaatgtttatacggataaccactcgggtttttccgcccgtcagcgtgactcaaatgtcagtatgacagatcttgtgagcgcggaagatgacgtaaatctccgcatgtcaacgggcttgttggccgcaattgacgaagggcgcagaagacgacgtcagactctgcgtgctatcaggcttttcgccttacagacagcaaaaaagaatgtttatacggataaccactcgggtatttccgcccgtcagcgtgactcanatgtcagtatgacagatcttgtgagctcgaaagatgacacaggaaaaaagaatgtttatacggataaccactcgggtatttccgcccgtcagcgtgactcanatgtcagtatgacagatcttgtgagcgcgaaagatgac

SEQ ID NO: 46239 - DNA, 219 bp, Glycine max
  Peptide Sequence Number=SeqID_137924
atgaccggatacatatttgaaggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 46240 - DNA, 141 bp, Glycine max
  Peptide Sequence Number=SeqID_137925
gatgccaccgtgttcgaggtctttaatccagacttcccgctctacataaagcacgaaaacctctcggaaatcacacacggtggtcttgatgatgctccacaacctaaatcaaaggctcctgctaggtggattgtcgtcaag

SEQ ID NO: 46241 - DNA, 138 bp, Glycine max
  Peptide Sequence Number=SeqID_137926
atgggtttgtcaggcttaaaggagcactcaaacccggtgacccccaaggcctacactccgaagagtccgtcagggtctctccctcctgattcaggtccaacccctaaaatcattttagcacacagacactgctcgtga

SEQ ID NO: 46242 - DNA, 165 bp, Glycine max
  Peptide Sequence Number=SeqID_137927
atgtcattgcctagcgctgttcatgtgttctccattatcaagcgcgaaacctctgaagaaaaaagaaggagtagagacgatagtcgtcatcacggaaaagggcaggacggacgaaatcagtgtcctatctttgctttcctcttatctccgatgaggggtaagtaa

SEQ ID NO: 46243 - DNA, 411 bp, Glycine max
  Peptide Sequence Number=SeqID_137928
atgccaaccttggatcccaacaagaagaaaaatccaaagccaattgctccatctctgcctatgtggcaagtagtaaaatggaaaaggttctcatccttaactgcggaaaatttgaagcaattatctaatgatgctaatgtgttggcagcaatgcctatgcaagcagaggactggaacttgcaacttcatcatctcaaaaaaatagagaaaaaactcttactcaggggaggagaattgcatccatgcaaatcttatcagtttgatgatgagaagggagacacaaaagaattcaagcggttagtcctttgtttttttggaaaagggagaagagagacaccaaaagaattcaagcggttagtccttggcggattctttttggcaaagggagaagagaatgaaaaagatgaatag

SEQ ID NO: 46244 - DNA, 393 bp, Glycine max
  Peptide Sequence Number=SeqID_137929
atgtggagtcgccaactgttgcaacctacccttcgacgggagggcgacacgagactcacgggtacgctttccaagaaaggaaaatgcacggagtcgccaccaagtttatttgaggaaaacgtcagaaaaactggaaaaaggtgtggtctacgaactttaagtgtgaaaggttcaggagttgtttttatgcacggggaagatgaatggcagcggaatggagaaggaagagagagaggagacgccacttcaaaggagaagatgagtctagaagaagcttatgaccataggaggccatggataagagcttggaggaagaaggagatgaatgaagggagaggaagagaagagcacaaaattttgtgctctaagagagctttgaaatctgaagtttaa

SEQ ID NO: 46245 - DNA, 315 bp, Glycine max
  Peptide Sequence Number=SeqID_137930
atgatagaagtctttattgaagccattgcatccctcactcagtattacgatcagttactaagatgcttcacgtttggcgactttcagttagtaccgaacgtggaagaatttgaagaaatcttgggctgtccgctaggaggaagaaagccgtatcttttttctgggttctatccctccatggggagaatagccaaggtagtcaaaatcttcgcacaagaattggaccgagtaaagcaaaatagaaatggggtggtcggaataccgaagaagcacttggaggagaaagcgaaggctttggcgaatcaaggtgaatag

SEQ ID NO: 46246 - DNA, 87 bp, Glycine max
  Peptide Sequence Number=SeqID_137931
atgtggagccctctgaaagtgaggacgtgtaacccactgaaggcgagaaataggagtagtgggggcaagatacgcgggttaggctaa

SEQ ID NO: 46247 - DNA, 303 bp, Glycine max
  Peptide Sequence Number=SeqID_137932
atggcatttaagaaaaggaaggctcctactacaccttcccaagttagagttgatcgatctaggttcacatctcaagaagcttgggagaggtataccgatattgttgtgcctaggaaactactaccaaaaaggaatgtggtagtttattacactgagtttgatgagttcaaggaggaactcgagagaagacactgggatgaggagttgactgattttgctgacggcagcatagatattgccattgtgaaggaattttacgcgaacctctatgaccccgaggataaatcacctaagcaagtgagg

SEQ ID NO: 46248 - DNA, 703 bp, Glycine max
  Peptide Sequence Number=SeqID_137933
cgggcatcgcgaaagggaaaaaacacgcgatcgtggccatcaccgagcatatctgggacgttgacgagctggcgaagtacatcgaaaccgaaaccaaacgtgaaacgcgcgcaaccgtactgggtcacatccagcgcggtggttccccgggtccttatgaccgtattctggcgtcacgtatgggcgcatatgctatcgaactgctgctgcagggtcacggcggccgctgcgtcggtattcagaacgaaaaactggttcaccacgacatcattgacgccattgaaaacatgaagcgtccgttcaaaggtgactggctggactgcgcgaaaaaactcgttctggctaaggacatccagttactgaacgtgtcatacgacccgacgcgtgagctgtacgagcaatacaacaaagcgtttgcggcgcactggaagcaggaaaccggcgacaacgtggtagttcgccagtctcacggtgggtccggtaaacaggcgacctccgtcatcaacggtattgaagccgacgtggtgaccctcgcgctggcctacgatgtcgacgctattgccgagcgtggccgcatcgacaaaaactggatcaaacgcctgccggataactccgcaccatacacatcgaccattgttttcctcgtgcgtaaaggcaacccaaaacagatccacgactggaacgacctgatcaaacctggcgt

SEQ ID NO: 46249 - DNA, 627 bp, Glycine max
  Peptide Sequence Number=SeqID_137934
atgaggggagcgccaaccgaagaaagtctctcgcctttccttgcgaggaatctaggcgcgcaaagtctcaaggcgatacaaagagtccacagggcgtggagaagtccgttaaggaaagatcaaggacttaggggcatccgtaatggcatcattggtggctaccatgaatgcgaagagagttttgaagcaccggaagaggacgaagaagtccaagctctcaaaagcgagttaggaaaggcaaaactttccaaagagaagttcaagttggccgctacacacatccggaaggagtatgccggattacgggaagagaatgcaattaccaccagagcccttgaacaagagaccaagagggctcgcaaggaagagtatggccggaataaatttcgcggagctctatggggtagcaatagtgaactcaagctgcgaagggaagagagggaccagtcgcgagcacatagcatggttctgaaagaggagttagttgcttgttcaaggtccaaaagaagcttgtctcagcgtttatgcaagacggagaccaacatgctagctatcatcgccaagtaccaagaagagttaggtctagccacggcccacgagcatagaatcgcggacgagtatgcttaa

SEQ ID NO: 46250 - DNA, 276 bp, Glycine max
  Peptide Sequence Number=SeqID_137935
cagcctgtggagtggatactatctacacctactccatatcgactagtggagccagttcaagtgatagaggtgtcatcctctgaagaagatcctgaagaggacccagaggagttacctcctaaacctgctgtggatgatcttgacttacccgaggatgatgaagaccccctccctgatgttgattccccagaggatgtcatgtcagcatctgaggcagactccacagaggagagcggccctagagggacagcgaatagtgatgactcttcatcgtag

SEQ ID NO: 46251 - DNA, 349 bp, Glycine max
  Peptide Sequence Number=SeqID_137936
cgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggcagactttgtggttgatttagggatggcctttgtggataactgggcggtgggtaagcaggaggtttgttattggctgagtaatgacattgttgggtttggtgggaaacttggccgtataggaatggcagtcacagcatgggtttctccctcgttctcaccctcttcatttgccccagttttctcagtcgtcctagtaggatga

SEQ ID NO: 46252 - DNA, 408 bp, Glycine max
  Peptide Sequence Number=SeqID_137937
atgaatgtaggagctctcatctctggccatatcacatctatggcccagtctaactcctctagacttgggttccctggtcttatcacaactctatgtaggtctagagggagggaggatgagtcatccgagacttgcactccagaacctcttataagaaggaagagggtagttgaaacacaagaagctacagccacttatgagaaatctcttgaggccacttttgagccttcagaaccagtggtagagacagcttcaattcagcctatagtagacccctccactcctgaggatcaaactacaccagtcctgtcttcgaacacctctcctccagctacccctgtgcttcacttaacagatgatgaggatgttcagacacaggatactcaggatagatcacaggatttttaa

SEQ ID NO: 46253 - DNA, 204 bp, Glycine max
  Peptide Sequence Number=SeqID_137938
atgacggagtggtacttggagatatgtcgtgggggtcaggagaccttggggacgtcaggtggggtgctattggccaaaaccaagcttgaccaatcccgacccaacccgggcatagtgagctcctggcagtcaaccgataaaagaacaaagaccacaaagcaaggaggctcgtgtggtggctggccagctatggatcttgagtaa

SEQ ID NO: 46254 - DNA, 363 bp, Glycine max
  Peptide Sequence Number=SeqID_137939
atgtcgcggaacttcacggattgtgctacaatgccttcttttgacttccggcacatcacggaacttcacgaattgcctaacgatgggccacaacagcagatgccaagtctctatgatcgaaccatgaagctagaagagactctagctcaatttatgcaagtgccaatgtctaaccaaaagagcacagagtctgcaattaagaatctgcaagttcaagtaggccagcttgcaaagcagttagctgaaagaccatccaacagctttacatcaaacacagagaaaaatcctaaggaagactacaaagcaatgataactagaagcagaatggtgattcaagttgaggaaagtagagatgatcataag

SEQ ID NO: 46255 - DNA, 279 bp, Glycine max
  Peptide Sequence Number=SeqID_137940
atggaacttatgagactaaatcaacatgaagaaaatggcaagaaaaagaaaggaattacacttaaagcctcatcttcaattcaagaagaaagtgacaaagaggacttgaatgaaatagaagaagatgatgatttcagtttcttctgttatgaatgtaaccaacctggacatttgagagttgattgccttagtttcaagaaaagaatggaaaaatctgacaccaaaaccttcaatgataagaaagaaaagaaagcttacgtcacttgggaagatatgtag

SEQ ID NO: 46256 - DNA, 639 bp, Glycine max
  Peptide Sequence Number=SeqID_137941
atgggggatagggtcacgaccgaccgtcgtctcttcccggcactagacgagcaaaggacgtcgctgcaaggcagcccaaaatggccccgaggaagctggcctcaaagagatctaggaaggataaagcggctgaaggaaccagcttcgctcccgaatatgacagccaccgttttaggagcgctgagcaccaacagcgcttcgacgccatcaagggatggtcatttctccgggagcgacgcgggtcagtggatcccgttcgatgcggatgctctcagccagttcctgggataccctttagtgctggaagagggccaggaatgtgagtatggccagaggaggaaccggtccgatgggttcgatgaggaggtcatcgcccaattgctgtgtataccgggcaacatccagcccagcaatcataattccgacctccctctgccgaagtgtcagctggtgtacgccatcctgacacggatgagcattcacgtggctcagttaatcgctgatgccatctatctatttgttgggatggcgcctaccaggcaccctctggacccagataagtccaacagggccctgagatttcccgctttgatcacaggactctgccagtcgttcggagtccccgtcgcacctagcaag

SEQ ID NO: 46257 - DNA, 459 bp, Glycine max
  Peptide Sequence Number=SeqID_137942
atgcgctatctgcacctggccgataagcacgacctaccacgcatcgtcacgattcaaaacccgtacagcctgcttaaccgcagctacgaagtggggctggcggaagtgagccaatatgagggcgtagagctgctggcgtattcatgcctggcgttcggtacgctaaccggtaagtacctcaacggcgcgcagccggctggcgcacgcaatacgctattcagccgctttacccgctacagcggcgagcaggcgcagaaagcggtggccgcttatgtggacattgccaaacgccacaatctcgatccagcgcaaatggcgttggcctttgtgcgccgccagccgtttgtcgccagcaccctgctcggggccacgaccatggagcagctcaagaccaacgtcgaaagtttgcatcttgagctgagcgaagaggtgttagcggagattgaagcggtgcataag

SEQ ID NO: 46258 - DNA, 812 bp, Glycine max
  Peptide Sequence Number=SeqID_137943
gactacacgtcctcaccttcagaggactacacgtcctcaccttcagaggactacacgccctcgctttcagaggactacatgtcctcgccttcagaggactacacatcctcaccttgagagggctacacgtcctcaccatcagagggctacacgccctcgccttcagagggctacgcgctttcaccttcagaggactacacgtcctcgccttcagaggactacacgtcctcgccttcaaaggactacacgtccttgcctttagagggctacatgccctcgcctttagaggactacacgtcctcgtcataagaaggttgcatgccctcgccttcagaggactacacgtcctcgccttcagaggactacacatcctcaccttcagaggactacacgtcctcccctttagaggactacacgccctccccttcagaggactacacatcctcaccttcaaaggactacacgtcctcaccttcagagggctacacacccttaccttcaaaggactacacgtcctcaccttcagagaacaacacgtcctctctttcagagggctacgcgccctcaccttcagaggaatacacgtcctcgccttcagagaactacatgtcctcgccttcagagggttacacgccctcgccttcagaggactacatgtgatgcaatcctaccccccaagggtattggatagaagactccaagaggattgggctagagctactaaagaaggctctagggttctcatgacccttagggtatattttctgagcccatggaccaaggttgggtcctctcttctttgtaaatattag

SEQ ID NO: 46259 - DNA, 498 bp, Glycine max
  Peptide Sequence Number=SeqID_137944
atggatggactagtggacctagcagcgatcgatgccttcgttacttatcaccatagcaaggaaagtccgctctttatgtatgactggtctcgcacctctttcatcatgaaagtagacccgcctgtcccttgcaaggtcaccgcatatgcgtcaagaaagggaaggccaattgggagcagctcttggctagtatggtgggggcatccattaattggttcccccgatggaaggaaggaagagtcggggttttgtcctcatgagcaccgtcggaagaaagtatcacgcctttcatcgcccgaggtttcagtgaccccaatgcaaggatatttcaaggagtccgcaaagcatgggagtgcagtacaaaggaaagataaggagcttaggggaagcagcaattgggatcatcaaccgggctatcacaagtggctgaaggctcaaacgcaagagttagattggcttcccgaagctaaagaccctcaagtgaggaaagaggcttga

SEQ ID NO: 46260 - DNA, 366 bp, Glycine max
  Peptide Sequence Number=SeqID_137945
atgtcccttgccactttatttggaaagttacaggaacacgagatagaattattgagattacaccaacatgaagaaaatgacaagaaaaataaaggaattgctcttaaagcatcatcctcaattcaagaagaaagtgatcaggaaaatgatccagatgatgatgatgatctaagtctttttgtaaaaagattcaacaagtttcttaaaaaaaagatggacaaatctgaaaagaaaaatcttagtgaaaagaaactgaagaaaacatacatcacatgggaagataacgatatggaatcttctgaagattcagaaaatgaagagataaatctctgccttatggctaaaagttatgaaagtgatgaagag

SEQ ID NO: 46261 - DNA, 237 bp, Glycine max
  Peptide Sequence Number=SeqID_137946
atgtcctcgccttcagaggactgcacgtccttgcctttagagcactgcatgtcctcgcctttagaggactacatatccttgccttcagagggctgcacgccctcgccttcagaggactacacgtcctcaccttcagagggctacacgtcttcgctttcagagggctccacatctgcgccttcagaggacttaagggatcgcgcccgcaagacacccagtggacccggagaagtctaa

SEQ ID NO: 46262 - DNA, 147 bp, Glycine max
  Peptide Sequence Number=SeqID_137947
atggaggaattgttgggttgggttcccctcttaggagaatcgaaagaggggaaattaacctatggagaggagagagtggcgggacttaacgacgacgtaacgtgtgatagaggagaacgcggatctaaattcaattctttaaagtag

SEQ ID NO: 46263 - DNA, 492 bp, Glycine max
  Peptide Sequence Number=SeqID_137948
atgctctcacttgaagtatctgaaaagactgagatgaaagtttatggcgcggctaaagttggtggagtgtatctgagtggaacccttaattgggttaagggaaaagaaaccattcattctgaaatcataattatttctgtagacctggagaaggagacttgcagatcactgtttcttctcgacgatttttgcttttttgatacaaatattggagtttttagagactcgatgtgcgtttggcaagatagcaacacccatcttggcttgtggcagatgaggaagtttggagatgacaagtcttggattcaattaataaattttagttatttacatcttaatattcgtccttatgaagaaaaatcaatgattttaccattctgcatgtctaacaatggagacttcttcatgctgaaattcactagaaatgctgatgatgaataccaaacaattttgtataaccagagggatgctttgaacgatttcaacctataa

SEQ ID NO: 46264 - DNA, 315 bp, Glycine max
  Peptide Sequence Number=SeqID_137949
atgtattacaacgggaagtggaacatatcacgccagggtgagtttttgggttactccttcacaagaacaaatccaataagatttggcattccttcgggatatagcatggacaaactcaaggatttaatcaaacaagttgcacctataggggttccacattatggaattcacgaatcacaattggttagacgattgttctttcgacaatcaggtcatgctaagtattcagaaaagttaattgaatatgaaataatagaattgaaagataacgaagacatgctaaaggtgtcagtacaatccaactattggaaatga

SEQ ID NO: 46265 - DNA, 333 bp, Glycine max
  Peptide Sequence Number=SeqID_137950
cttgtgagagaaagtgaggttttgactcctcctcaccttcatttcaagttggcatcagagcaggtgtcatccgccgtcgcccgccgccgtcgccgcaaccgccgccgtctgccgccgccgccgtcactttccggcggccatttctccggcgaagccagggttaggctcgccttgggaagcgcgagccagccggccaactcgcgtcagcaacggagcagccacgcgccgccgccaccgtcccgcgcgtcctccggcgcgtgcagtccacgcgccgccgtcccgacgccggaatcgcgccacgcctccgccgttctcttggtcggcttctcctga

SEQ ID NO: 46266 - DNA, 729 bp, Glycine max
  Peptide Sequence Number=SeqID_137951
atggtcattgatcaatccctattctatgacttgacccaattgtctagtgaaggtgtaccattcgaaggtacactgaatgatgattggaaatttgatttcaatgtgcatgatgcccaccggttagtttgcaccaaccaagcggatatgaccggaaggcttcttgtcggttcattggcttttgaaagccgcatccttcattatcttattgtttctgaagaagatcttattgtcatgtgggcttttcatacaggccgacaaattgattgggcacacttagtccgatatcgcatgcataaggcattgcgattaaatgctccattgccatatccacacctagtcactctcttccttcaacactttaacatccctcttgattctgaacccgatgttccaatcaagagatccttcttaattagtgccgctgtgattgcatctttcggttaccgtaaagatcatgatggctcttgggtaaaaaagggtgctcaacccattgatgaagaaggacacttaccagttgaagaagattcctctcttcttcaaatgattttggacaggttcgatggtcttcaaacctttgttggtgaaaggtttgatactctggggttacaagtggacatgcgattcgatgagatggattcaaggatcaccaaggttgaaggagatgtttcttacatcttcacatgctttgatctaccaccactgccaccaccatcatctttgactttataa

SEQ ID NO: 46267 - DNA, 47 bp, Glycine max
  Peptide Sequence Number=SeqID_137952
atggcttctatggatacctctgctatggtcaactctaagatctttct

SEQ ID NO: 46268 - DNA, 282 bp, Glycine max
  Peptide Sequence Number=SeqID_137953
atgagggtgtcgaagctatctatggatcttggtgggagtccaccataccaggtcaatgttgctccctcgagggatatagggaagacacgacatagaattgtgtcgaaggcgtccatatgctcgtctggatctgttgtctcatcataccgctcgaggttaagtgatttccaccccaagggtatgtctacctccataacgcggtcgataaaaggatgtcaatggacagtctgtgttgttggacgatgcatgagagagactcggatcgtctgcagtgttgcttga

SEQ ID NO: 46269 - DNA, 225 bp, Glycine max
  Peptide Sequence Number=SeqID_137954
atgggggtgcaaatagcacccaggcccacttgggccctccagaaggctgttgcttctggaggaagcaacctggctcgcctgggcgagctgagctcgcctgggggaggaagtgaagaagaaaagggttcagcccctttggcacttctctctctttcgaattttgcttggaaaaattgtttccgtgaagaaaatctaagccgaggcgcttccgaaacgtttccgtaa

SEQ ID NO: 46270 - DNA, 294 bp, Glycine max
  Peptide Sequence Number=SeqID_137955
atgggatcgaaagtaatagaggaatttatagctggacaattaaagaatagagtttcgtttcgtaaagcaatgaaaaaagctattgaattaactgaacaggcgggtacaaaaggaggtacaaattgcaggacgtatcgaaaaagaaattgctccattgtcgaatggatcagagaaggtagagttcctctacaaaccattcgagcgaaaatcgattatgttgctatacagttcgaactattatggggtagggatcaaagtttggatgggaacgacgaaacctgcaaattactttaa

SEQ ID NO: 46271 - DNA, 249 bp, Glycine max
  Peptide Sequence Number=SeqID_137956
atggccccgaggaagcttgcctcaaagaggtccaggaaggataaggcggccgaaggaactagttccgctcttgagtatgacaatcaccgctttaggagcgttgtacatcagcagtgcttcgaggccatcaagggatggtcatttctccgggagcgacgcgtccagctcagggatgacgagtatactgatttccaggaggagataggtcaccggcggtgggcatcactggttaccccggggatcctctag

SEQ ID NO: 46272 - DNA, 271 bp, Glycine max
  Peptide Sequence Number=SeqID_137957
ggattgtgcccacaaggcacccagtggactcgaagaaagccaacagggtcttggagttgccaactctgattacgggcctctgtcagttctacggagtgcccgtcacccccaacaaggtcatcaggccccctactaatcgtgctttcatcaagaggtactgcgcccctaggcaggcgcaaggcgaaacaccacaacggcctggggatggccagcaacagacaacaaatgcaccgccgccacctccaaagcccctcagctcatccacaaaaag

SEQ ID NO: 46273 - DNA, 246 bp, Glycine max
  Peptide Sequence Number=SeqID_137958
atggtggtcatcatgcccaaggaacacctagttgtctggttttgtttattacataacaggccagacaactaccttaaggggataattaacagcctaaatcaaaggctccggctaggtggattatcgttaagtgtaatagacagaaaggaatattttaacaatcctagaccattggtgccagagagattaaaggcactgcgaatccagtgggcacaatattatcttcgagttagagctcagagctag

SEQ ID NO: 46274 - DNA, 474 bp, Glycine max
  Peptide Sequence Number=SeqID_137959
atgaaggtcagtgttgaggaggttaaagatgcagatgctcccattcctgtacccactgaagagtttaagttagtggggcagacacttaacaccttccttgcttggccgacacatctcgtcaagcatttatcagaacagggagctgtgggaccagcaaaacctgcagataggccagatcatgaggtcgatgatcccctatatctgatgacattgaccatcccacaactttttctaaagccattgcaggttatgtgggatgctatagtgtttggggtgtttaatgaagacttccccttgtacataaatcatgaagatctgtctaaaatagcacacggtggtcaatgtcttaacatctctgttatacagttatggattttgcatatgactgagacaagtatgcgagcggggaatgccgatgtgtatggatttcttgagccacagtccatccagagatctgggcaatcacaaatttga

SEQ ID NO: 46275 - DNA, 474 bp, Glycine max
  Peptide Sequence Number=SeqID_137960
atgggatgttacaatggtcaatgtctcagcatatctgtcatacagttgtggattctgcatttgactgagacaactatgcgagcggggaattccgatgtgtatggattcctcgagccacagtctattcagagatctaggcaatcacagtttgactcagaaagttacatcaagagttggatgcagagttcaaaatgcaatgtctaccttggaggctacttaaatggtgctttgaatggacttgatgatactccacagcctaaatccaaggcttctacagggtggattgtcgttaagtgtaatagacaaaaaggaagcactgagtgcggctattacgtcatgcactggatgtccaccatcatcttaggaagttttaggaataacagggaagcgtattttaacgatgctagaccattggagccagagagattaaaggcgcttcacatccagtgggcacaatattatctccgactttag

SEQ ID NO: 46276 - DNA, 237 bp, Glycine max
  Peptide Sequence Number=SeqID_137961
atggtggccaaagatcaactaactatgaaagataagagggatgaggaagaaaaactagaaaaacaaaagaaaaagaatgatagtaaggccttgtcttcaaaggctaggggaagggaaatatcccttagcactgtcatacctcttgagcttgaggttattcctcaactaaaggagttattggatgagggtttggtttgtaaaaccttaactccttgtgctttgttgggcccaaaatag

SEQ ID NO: 46277 - DNA, 225 bp, Glycine max
  misc_feature (7)..(7): n is a, c, g, or t
  Peptide Sequence Number=SeqID_137962
atgggtnccaagcacctcacgaggaccaaagaatggtcgcacgtcatcgagcaaaggtccccggacgaaattaggcatctcgaaatattacgggacttaatcagacatccgagtaaaaagttattgtcctttgaatttgctcagagcttccatattcaatttcaagcgtctcggtatattacgggactcaattggatctccaagaaaaaagttattgtcgtttga

SEQ ID NO: 46278 - DNA, 342 bp, Glycine max
  Peptide Sequence Number=SeqID_137963
acttatcaaggtaatccttgtggcgtctaccctgacttatcttccttcaccggaagtggcgtctacccggacttatcttccttcattggaagtggcgtctacccagacttatcttccttcaccggaagtggcgtctatcctgacttatcttccttcactggaagtggcgtcatccaaaacctccgtagcctgtatcaaacgatccgccccgtaagattcatatcatctggtatcagagcttcggctcttgatacagcctattcaaattctgtttggggtaaaaattgcctaattgctgaattgctaaattgtcaaatttgcctaatgatgattgcctattga

SEQ ID NO: 46279 - DNA, 456 bp, Glycine max
  Peptide Sequence Number=SeqID_137964
atgactaaaggcaatccatctaacttacaaccctttgatcctgagatagataggacatttcatagattagttagacatcatttagtaccttttgagcatcctgagcattctgctattggtgattttgagcattattgttttgaatattctaattttgaacattctgagaacatggcacaacctccacctcgtgagaggactctaagggaaatggctgcacctgatttcacctatgaaagcttgtgcatccaataccctgatgaggatgtcccatatgttcttaaaactggactaatccatttgcttccaaagtttcatggccttgcaggtgaagacccgcacaaacatctgaaacaatttcatattgtctgctctaccttgaaacccccggatgtccaggaggatcacatatttctgaaggcttttccttattctttagagggggggatcctctag

SEQ ID NO: 46280 - DNA, 255 bp, Glycine max
  Peptide Sequence Number=SeqID_137965
atgttggtgcgcatgatccacacttgtctctttgcagcggcacgggcgaaatcttgccctggtatgcatagtagctacgtgatagcctccctctctggttgtgcttgcacagtgtggatatggagcccactgaaagtgaggacgcgtagccctctaaaggagagggcgtgtagctctctgaagttcacgacgtgtcgccttttgaaggcgagggagtgtagtcctatgatggcgaggacgtgcaatcctctaaag

SEQ ID NO: 46281 - DNA, 432 bp, Glycine max
  Peptide Sequence Number=SeqID_137966
gtagtccatgatgaactcgctggcggcgaacgccatgctgcggtgcgcgccggtcacgccgacgaacacgatctcgtcgccgggatacagcgcgccgacgcggtggatcaccgtcacccgctgcagcggccaacggctgcgcgcctcggccacgatctccgccagcgccttctcggtcatgccagggtagtgttccagcatcagcgcgctgacgtcgtcacccagattatggttgcgcaccttgccggtgaaggtcaccaccgcgccatcggcgtcgcactgcgccagccactggtactcgtcgccgacgttgaacggcgcttcgcccacgcgaatgcgggtattttccatgcttaccccccggtgaccggcgggaagaaggccacttcatcgccggcgcgcagcggatggtccgccgccaccagcgactga

SEQ ID NO: 46282 - DNA, 387 bp, Glycine max
  Peptide Sequence Number=SeqID_137967
atggcgagggcgtgcagccctgtaaaggcgaggctgtgcagccctctgaaggcgagggtgtgcaaccctctgaaggcgaggacgcatagccctctaaaggtgaggatgtgtagccctctaaaggcgaggacgtgtagccatctgaaagtgaggatgtgcagccctctgaaggtgagagcatggagccctttgaaggtgagggcgtgcagccctctaaaggcgaggacgtgcagccctctaaaggcgagggcgtgcagccctctaaagtcgaggacatgtagtcctctaaaggcaataggtgataattcatgcaacctcttcctatcttttgaaaatctcttcgggaactccctcaaagtgtatgtcttgtttgatttactcacttga

SEQ ID NO: 46283 - DNA, 615 bp, Glycine max
  Peptide Sequence Number=SeqID_137968
atgttggaaagttttaaacaacaaggacaaatgtcagttctggaattgtacatagaaaaggatgtggttggtggttcaatgtttcattctgcaaattcgcttacatcatgtggaaattatttatctaatgatgagacacaaccgacaacaaatatgagcaatttacatattgacgaagatgatgatgatgatgattatcttgtgtctaactcatacgttgaagagtctttagacgaagatgacagtgttgacggtatatctgatactgacgatgaagtcaccaacattcctcaaccagtaaggattgttcacccagcagaaggtgcacaacgaattgaaaatccattttggaatgatgctatgctttataacaatatcaactggagttatcctgatgaggaggacatttgcggtttggagttgtcgtcgacctttaatattggtcaagaattatatgttggcatggaatttgatagtaaagatgcggtcaaaaatgcagtcaaacaatatgttatgaaggtgcatcaaagtttcaaagttgttgaaagcaaatcgaacaagcatgatcagagaagatccatcaataaaaatttctttgattcaagagaggattaa

SEQ ID NO: 46284 - DNA, 729 bp, Glycine max
  Peptide Sequence Number=SeqID_137969
atggcggtggcctgctgctcaagcagagcccaatgggccggcttactacgtggtcactctgtgcctggtcggcttcctcgtcgggctctacctgctggcgcagaaaaagccggctggcgaggcggtttcggtgggctgaaagcgcttccggcggttgttcgtcgcagcggttcggtcccgaaagggattcgaaacgaagcttcaccgaggtgcttgacagcgaatttgaacgctgtagaatgcgccatcccgctgatcggaagatggtttgaaggtcggcgcaagcggttgagtagaaaaggaaattttcgaaaataccgcttgacggaaagagaggttgctgcagaatgcgcggcctcggttgagacgaaagccttgaccaactgctctttaacaagtcgaatcaagcaattcgtgtgggtgcttgtgatattgaacgctggcggcaggcctaacacatgcaagtcgagcggagtgatggtgcttgcactatcacttagcggcggacggtggggaatattggacaatgggcgcaagcctgatccagccatgccgccaccggctaactctgtgccagcagccgcggtaatacagagggtgcaagcgttaatcggatttactgggcgtaaagcgcgcgatggtagaattccaggtgtagcggtgaaatgcgtagagatctggaggataccgatggcgaaggcagccatctggcctaacactgacgctgag

SEQ ID NO: 46285 - DNA, 826 bp, Glycine max
  Peptide Sequence Number=SeqID_137970
atgggatatgtcagaaagtatagacccgcttatcaatcgcgcgccgctgcgtctgcagtacgcgcgatttacggggggttatcaaccatttatgcggctgaaaagattatcacgccttacggctgcgcgtcttctgtggttgtaacgccgtcacctgactctccacccagccatcatccagccgggtacgcagcagatcgccgcatcggtggtgacgctaaagccgcgcgccagcgtcgccagcggacttacgccttccagctgtgctgccagcccggtagtgccactgctgtaactgctgctgagcgcgcagaatacgtccctgcggctgctgggattgcaggcgctgcagcaggcgatcctgctggcgatgcgccaggcgcaaccgctggtcggccgcctcctgcagacgacgctgcagctggatcagcgtggtttgctggcgtgcccttcacggcgcgcgcggatgcatgctgttcgataatcagcgtgatagtcggcgcggctcatacagcggcgaaagctgacgcgtcgattgctgttgcggaacatggcacagcgcaaacctgcgcgccatcgtccttcagagtgaagtaccattggcgcactccacgctggttgctcgatggcggcacagatattggcggtggagatattgcaatgttacgaatcgcgaaagaagccctcacatttgacgacgtcctgctcgttcccgctcactccactgttttacccaacacggccgatctcagcacccagctgaccaaaaacatccgtctcaacattcctatgctgtctgcagcgatggacaccgtgaccgaagccg

SEQ ID NO: 46286 - DNA, 216 bp, Glycine max
  Peptide Sequence Number=SeqID_137971
atgagtgtctctaccagctcagcctcagttagcaggggacagggtttcgctccttttgcgtgccctactccagatcagtttagggctgaggtcgcatggcccgaggcccaggcaggggaggcacctgcaggagctcccgacgatgcagaggaggcccgcattgatgaggagatgacgaacttgctcggtttcttgggaggaagcggagccacatga

SEQ ID NO: 46287 - DNA, 195 bp, Glycine max
  Peptide Sequence Number=SeqID_137972
atgtcgcaacgtgcccttcgcgggcgagcgagggcgaggctcacgggtgcactttcccatggaggaaagatgcgcggagtcgccaccaacgtttatttgtggaaaacgtcgggaaaaccaaaggaaaccggtcgacaaaggcagggcttttgctcctacgtaccctcctttggagaggaaatcagacctacgtag

SEQ ID NO: 46288 - DNA, 363 bp, Glycine max
  Peptide Sequence Number=SeqID_137973
atggccccaaggaagcttgcctcaaagagatccaggaaggataaagcggctgaaggaaccagttccgctcccgaatatgacagccatcgttttaggagtgctaagcaccagcagcacttcgagaccatcaagggatggtcatttctccgggagcgacgcgtccagctcagggacgacgagtataccgacttccaggaggagatagttcgctggcgaggagggcgtgtgagatatgcgatcctgggtgaggggtcagtggatcccgttcaatgcggatgctctcagtcagttcctgggatatcctttagtgctggaagagggccaggagtgcgagtatggccagaggaggaaccgggccaatga

SEQ ID NO: 46289 - DNA, 204 bp, Glycine max
  Peptide Sequence Number=SeqID_137974
atgttgggtctttctaacaaagaagctgatgcatataaatatatttctctaagcaatcatgctcttgtgttctatgctgtagccaaaattactaaaccccgatccctcgtcaaaccgaatcaatccaagcttcgtcctcagatccctcttgttggactaggcccaaatccctcttgtaagactagactcagctcaagcaactaa

SEQ ID NO: 46290 - DNA, 318 bp, Glycine max
  Peptide Sequence Number=SeqID_137975
atgttagctatcgtcagcaaataccaagaagagctaaatctagccacggcccatgagcataaagtggcggatgagtatgcccgagtgtacgcggaaaaggaagctagaggaagggtgatcgactcgttacatcaagaggcaacaatgtggatggaccgatttgctcttaccttgaacgggagtcaagagcttgcccgattgctagccaaggccaaagcgatggcggacacctactctgcccctgaggagatccacggacttctcagctattgtcagcatataatagacttaatgacccatataattagaaaccgctag

SEQ ID NO: 46291 - DNA, 504 bp, Glycine max
  Peptide Sequence Number=SeqID_137976
atgagtcatcattcatctagtgttaatggtgagggtactagtcataaggaccctctatctagaatcttagatgagttgagttcccttaagttatggaaagaaaaactagaaagaaaagaaaaaggaaaagagagggtagaaataaatcaagatgagagggaacaaataagggcagaagaaagaaggaaaatactaaaagaattaagaaaagaaaaacatgcctcctatagtagtcatgacccttgcaagagcctaattgaagaacttcatgactattatgaaggaaggcataggtcacatcttagacctcactcccataggagagaaaaggaaagaaagcctcaagaggctaacattaacctcccatgcctccatgggaaggacaatgtagaggcttacttagattgggaaataagggtagagcaacaacttaaaggaagtctacttcaaattcttatgtcactcactcatatccaaagaaagaccaaggtcaaggcatcttag

SEQ ID NO: 46292 - DNA, 688 bp, Glycine max
  Peptide Sequence Number=SeqID_137977
catcagagggctgcaagccctcaccttcaaaggactacacatcctcaccttcagagggatatacgtcctcaccttcaaaggactacacttcctcaccttcagaggactacacgtcctcgccttcaaagggctacaagtcctcgccattagagagctacaggtcctcgtcttcagaggactacacgtcctcgccatcagaggcctacacgtcctcgccttcagaggactacatgtccttactttcagaggactacacgtcctcacctttagagggttacacatcctcactttcagaggactacacgtcctcgccttcagaggactacacgtcctcgccatcagaaggctgcacgccctcacctctaaaggactgcacctcctcaccttcagaggactgcacgtccttacctttagatggctgcacgccctcgccttcagagggctacacgcccttgcctatagaggactacacggctataggccctcaccttcaaaggactacacgtccttaccttcagggggctacacgccctcaccgtcaaaggactacatgtcctttccatctgaggactgcacgccctcacctttagaggactacatgtcctcaccttcagaggactacacgtcatcaccttcagggggctacacgccctcgcctttagaggactacacgtcctcgccttcatag

SEQ ID NO: 46293 - DNA, 357 bp, Glycine max
  Peptide Sequence Number=SeqID_137978
atggggtgtatgattggtcccttcctagggaggattgcatcaccgggtatagggcctaatatctcaaagtgtgtgcaaacagtgtgggtgtcatgtgtgaatggagcaatcttagaattacccctccctacctttcaagcaaacaaaaaattccaaggtagatacaacaagtacatcacaggtcgtccatcccaagattcaatggcacaaagtatttctaactacaaaagtaatagatacaaagatacacaccaagaggcaataacatggcaaaagttatatacaaatatgaacaaaacaaaggataaaagaaatgaggttgaagcaaaaaccacaaaaagaactgtagcggaatga

SEQ ID NO: 46294 - DNA, 515 bp, Glycine max
  Peptide Sequence Number=SeqID_137979
actgttggaatcctgaggatctaacagtctctatccgaggggctaggagagcaagggcaaggccaattgaggctccttccacatctgcagctcctcctccagcacataccttagtagctccttctaccctatcttctacagactttcaacatcttgaagccatgcttcaaagcatacatcaggggcagattgttttattacaaagtttacagctgagggaggatgagtcatctgatacttccactccagagcccctgatcagatggaaaaggatagttgaaacacaagaagttgcagccacttctgagaaatctcttgaggccacttctgagccttcagaacgagtggtagatacaacttcaattcagcaggcagtagacccctccactcttgaggatcaaaatacaccggtcctgtctccgaacacctctcctctagctacccccgtgcttcacttaacagatgaggaggatgttcaaacactagatactcaggacagatcacaggatttttaa

SEQ ID NO: 46295 - DNA, 303 bp, Glycine max
  Peptide Sequence Number=SeqID_137980
atgtcaggctgcgcaactgtaatgaatcggaaccgcgggcgatcgggtgtccagtcagacagtgtgtggcagaaaaaagctgacggctcagctgaatatgtgaatacgactcatatgcgcgaattcctcgctgagctccaccgctcggtcgtcactgcggcgacgctcagaaagtggatcccttacaacggggcaggaattcggatcaatttacagaagatactcgtatacagggaagagagtattcgcgcaaagtcccgttttttagagctccgcccccctgacaagcatcacgaaatctga

SEQ ID NO: 46296 - DNA, 397 bp, Glycine max
  Peptide Sequence Number=SeqID_137981
gaatcatccaaatctgagatgggcaaatcctccacaacaacagcagcaacaacagcttgtccctcctttccagaatgttgttggtccaagcaggccatatgttcctcctccaatccagcaaatgaccatccagaatatgcaatttcagcaagagacaagagcctccattcagagtctgacaaatcagatgaggcagatggctactcagttgaaccaagctcagtcccaaaattctgacaaattgccttcacaaactgtgcagaatccgaaaaatgtgagtgccatcaccttgaggtctggcaagcaaattgaagtgcctccacctgtagcagcacctgcacttgaacctgtcaagcttcattctacacccggaaaagaggatgagctagctgcataa

SEQ ID NO: 46297 - DNA, 327 bp, Glycine max
  Peptide Sequence Number=SeqID_137982
atggaggagacacatgaaattccccaccatgatctagccaacttcgagccttgcctcggatatgctgctgaagggcaagcagttggtgccttcattaaccctagccagtgtcagtcaattcctgattctccgagaataggatgcaactacaaacaacgtgtgcttgtcatggaaagccccgggggttccattgagcatggtagggctctgaagcgtaaggtgcaaggtctaattgatgcgggcgccgaaattgaggagagattggcaactcaagtagcaacccccaaaaacagagacaagagattatgccacaatggggaattttag

SEQ ID NO: 46298 - DNA, 237 bp, Glycine max
  Peptide Sequence Number=SeqID_137983
atgtgggccatcatcgaccagtacaaggaaaagctaaacctagcagcgactcatgagcaaaggatagaggatgtgtatgccaagagaagtgatgatgtggatggacagattcaccttgactttgaatgggagtcaagagcttccccaactgctagccaaggccaaggcaatggcggatgtgtactcagccccgaaggaggttcacgggctcctcaattattgccaacacatgattaa

SEQ ID NO: 46299 - DNA, 381 bp, Glycine max
  misc_feature (69)..(69): n is a, c, g, or t
  Peptide Sequence Number=SeqID_137984
atgggtgccaaacacctcgaagtggtcaaacgagggtcacatcccaacaacggatggtccccgaacganattaggggtgcagaattcgtctatgcgcgtttatctctcaacgagcatgcggataatcgcatgtcatcggagatagcaaaagaaagttttaaaagtgcggataaccacttgggtatctccgcatgtcacatgactccaggggtgcagaagatgacattagtctctgcgtgctatcatgctttgagtcttagagatagcaaaagaaagtttaaacggataaccactcggggtgcagaagacgacggtcagtatgacagagattgtggggtggccggcaaaagcgaggctcttgctcctacgtatcctcaatga

SEQ ID NO: 46300 - DNA, 414 bp, Glycine max
  Peptide Sequence Number=SeqID_137985
aatccatcaacacaaggttgtgccacatctcaaagtacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46301 - DNA, 304 bp, Glycine max
  Peptide Sequence Number=SeqID_137986
cccagagattatagggaagttctttggcatgaagcatgacctagcagctttgcaaagtcctgtttttcctttcaactatgccattctgttgtggtgtaatggctgcagagaactcatgagtgatgccttcagatgtgcagaattcagtaaacttgctgttttcaaactctctgccatggtgtttgatttctctgataaagttgacccaggtaaatctggagaaatcatccacaacaacatagacatacctctttcctccaaggctttcaacttgcataggccccatcaagtccatgtgaagtag

SEQ ID NO: 46302 - DNA, 402 bp, Glycine max
  Peptide Sequence Number=SeqID_137987
atggcatttccttacatgggatcagcaatctctttccatagtgagccagtaataactgctctaagagtcatcgtgttgacccaacatcacaaaaacccagtagccaatctccttaacattctcttgtcattgtatacggaaaaaaggtccctggttacaggcgacatgagcaccgggggattctttgtctcgactctgtttgattttttcgaaaaccggttccatcttgcagtctcactatccacaggacgcgccggttctcgctcaagagttatgagagatgggctcgcaggtaggggtgaagttgagaacatcggatgccaaggtggtcaatgcatcgaccatttgattctcttcccgaggtatgtggtggaaagaaatgtcgtcaaagaattcagctaa

SEQ ID NO: 46303 - DNA, 229 bp, Glycine max
  Peptide Sequence Number=SeqID_137988
tggcttctgtttctatcagctgtccctcctgtcagctactgacggggtggtgcgtaacggcaaaagcacccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 46304 - DNA, 279 bp, Glycine max
  Peptide Sequence Number=SeqID_137989
atggaaaacggctttgcgcggccctctcacttccctgttaagtatctttcctggcatcttccaggaaatctccgccccgttcgtaaagccatttccgctcgccgcagtcgaacgaccgagcgtagcgagtcatgccaacatagtaagccagtatacactccgctagcgccccaatacgcaaaccgcctctccccgcgcgttggccgattcattaatgcagctggcacgacaggtttcccgactggaaagcgggcagtgagcgcaacgcaattaatgtga

SEQ ID NO: 46305 - DNA, 225 bp, Glycine max
  Peptide Sequence Number=SeqID_137990
atgacttggcaggatctgccggaaatctccaccaaagaccatgactttacctccaaagattgtactgtcctttgcagttgttattcacagcaaatgattatctctaagactgtgatcaagtgcctcaaagcagaaaaatcaattacaagtctgcagcctcttcaaaatgccaagatttgtcaaactttagaatgtcagttgctaccatctagtgcaatagcatag

SEQ ID NO: 46306 - DNA, 802 bp, Glycine max
  Peptide Sequence Number=SeqID_137991
atggcttcccgtaagagaaaagccatagcttcaatgtctcagttcaccaacttgactgagggaagcattgatgtggcaattgtgaaggaattctatgcaaatctatatgtccctgaggacaagtctcccaagcaagttagggttcgaggacacctgataaaatttgatgttgattccctcaacaccttcttggagactccaatgggtctgccgtggaagctcttgaggaaagatcttaccactctggcccaaacctggagtgttctatcttattctaacttggccccgacatcccatacttctgatcttaatctagagaggaccaagttagtctacgagcttgtaatgaagatgaacatgaacttaggatcactcatttctggtcagatttcactcattgctcagtccaactcctcgcggcttggatttacagctttgattactgccttgtgcaaggcccgaggagtcacctcagattctcttaccttcgagtcacttaacctagccattaatttggcctatattaagaagaattgttggaacttggatgaaccttcagtcacttttccagggacccaaaaatccaaggctagaagatctgaggccccatctacatcagctgcctctactccccctacatcagctccatctacttctgctcttccttcaccaccagcagctccagttcttccagagcctgcatcagggccagctcctgatcatacagagtttgcaggatgtggtccaacagcggccagttatgagcttggaggagtttgttcagaagatggcctggccagga

SEQ ID NO: 46307 - DNA, 726 bp, Glycine max
  Peptide Sequence Number=SeqID_137992
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttttttggtagctctctagcttctacaatagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46308 - DNA, 573 bp, Glycine max
  Peptide Sequence Number=SeqID_137993
atgcatgaccggcccgcgcaggcaccgcaacggaagatacctgcgcgggcgctggcgccaatgcccgccgccgacgccaagggattgcagacactgcgccaacaggcgctggcctgccaccagtgcccgctgtgggaagcggccacgcagggggtgttcggtgaaggcccggccgatgccccgatcatggtggtcggcgagcagccgggcgacgtcgaggatctgcgcggccagccattcgccggcccggccggccagctgctggatcgtgccctggccgagctgggaatcgatcgcgccacgctgtacctgaccaatgcggtgaagcacttccaccatgagcgccgcggcaagatccggctgcacaagcgtccggaaagccgccacatccaggcctgccggccatggctgatgggcgagatcgcgcgggtgcggccgcaggtcatcgtctgcctcggcgcaaccgcggcagcctcggtatttggccgtgacttcgacctctcacgcgaccgcggacgctggcacacgctggaggacggcacccgcggctacgccaccgtgcatccgtcgtgg

SEQ ID NO: 46309 - DNA, 378 bp, Glycine max
  Peptide Sequence Number=SeqID_137994
atggggcttaagaatcaaggaagtcacttagtacattatgtaagccaccaagggaatcaaggagctgaaaagaaatttatgaagaagcatgataaaggcaaagggccattaaagataaatgaagactctttgcaaatccagcaaaaggtatcaaaggacaataattgccaattttgtgggaaatatggacatttccaaaaggattgccaaaagcgtaagtcttggtttgaaaagaaaggtgagcttaatgctcatagattccttacaatccaaaccataagcccaaatgagaagttcatctttatagggaatagagtgaaagctctagtggaagccgtcgggacttatcgtttaaaactcgacactgatatgatttaa

SEQ ID NO: 46310 - DNA, 1378 bp, Glycine max
  misc_feature (1329)..(1329): n is a, c, g, or t
  Peptide Sequence Number=SeqID_137995
atgcagcgcatcttccggccacagaacttcacatccggttgccatcgcggcagccagctgtaccagcgcatcctgctcgttatccgctacgcaaagtacatgctcgcgcggcatcagcgtccaggtgttgcgctcgccggttggccccggaagcagacgctgcgtgccttcctgcgccagctcgccgtactgctgcgcaatggctcgcagttcaggacgtttttccgcccaggcgatcagcgcttcaagcggctgcgtcagcacggttttcagctgcgcgtctaccggatagtctgcgtcctgacgtgccaccgtcacgcccagcgcgttctctggacggttcgccagcagacggtacaggtaaagcggaccgcccgctttcggaccggtgccggacaaaccttcaccgccgaacggctgcacgcccacgaccgcgccgaccatgttgcggttaacgtacaggttgcccactttggcgctgccggtcacctgcgcgatggtttcgtcaatacgggtgtgtacgccgagcgtcaggccatatgcggaggcgttgatctgatcaaccagctcgttaaggttgttacggttgtagcgcaccacgtgcagcaccgggccgaagacctcttttttcagctcgtcgaagcttgccagctcaatcagcgttggcggcacaaaggttcctgtccgccattcgcgggcatcttcgctgttctcgcggaccgcctggaacaccggacggcctttcgcgcgcatggtctgaatgtggttttcgatgttggctttggcttccgcgtcgatcaccggcccgatatcggtggtgagacggcccgggttgcccatgcggcattcggccatcgcgccgcgcagcatcttcagcgtgtggtccgccacgtcgtcctgcaggcacagcacgcgcagggcggagcagcgctggccggcgctgtcgaacgcggaggccagcacgtcgaccaccacctgctcggtaagggcagaggagtcaacgatcatggcgttcatcccgccggtttccgcgatgagcggagtagggcggccctgcgcatccagacgggtggcaatattgcgctgcagcagagacgccacttcggtcgaaccggtgaacatcacgccgcgcacacggttatcggaggtcagtttggcaccgaccgtttcaccgcggcccggcagcagctgaaccacgcccgccggcacgccggcttcgagaagaatgttgatgccctgcgcggcaatcagcggggtttgctctgccggttttgccagcacgctgttgcctgcggccagcgcggcggcaatctggccggtgaagatcgncagcgggaagttccacgggctgataccagacgaccggacccagcggaag

SEQ ID NO: 46311 - DNA, 52 bp, Glycine max
  Peptide Sequence Number=SeqID_137996
atggaggataggcgaacaacgctaggcaatcaattcgcggggctccagactc

SEQ ID NO: 46312 - DNA, 81 bp, Glycine max
  Peptide Sequence Number=SeqID_137997
ttccgagacgtgtcagaaatcaaaaggaagcgggctagcgcaatccgtgaaattctgtgatgtggcggaaatcgaaaagag

SEQ ID NO: 46313 - DNA, 363 bp, Glycine max
  Peptide Sequence Number=SeqID_137998
atgggagcctctggtaatcgattaccagcctgtgtaatcgattacacagaggaatgggtcactgatgaacctgcacggacgcttcagcgcacggtggagtggatactacccacacctacaccatatcgtctagtggagcccgtccaagtgatcgaggtaacgtcatccgaggaagaccctgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccgggggagatggcgatcagcggaggttcttcatcctag

SEQ ID NO: 46314 - DNA, 294 bp, Glycine max
  Peptide Sequence Number=SeqID_137999
atggcgcctcaacgcctaactcacaaaaagttcccagtggagtcgccaactgtcgcaacatgcccttttgcaggcgagcgaggcgaggctcacgggtgcgctttccaaaggaggaaagatgcgcgaagtcgccaccaacgtttatttgtggaaaacgtcagaaaaaccgaaggaaacccggtcataaagaatattccaagttcgggagttgtatttacgtttaaggaaggtcgacaaaagcagggctcttgctcctacgtaccctccatcgaagaggaaatcagacctacgtag

SEQ ID NO: 46315 - DNA, 306 bp, Glycine max
  Peptide Sequence Number=SeqID_138000
atggcccctatgatgtctatcccccacaaggaaaaaggccaagggggcggacatgacattcagaggatgtggcggaacattgacattgtccgcgaacgcttgacatttatggcatttccttacatgggtgcagcaatcactttccatggtgagccagtaataacctgctctaaggatcttcctggccatagcatgcccattggcgtgcgttccaaacgaaccctcgtggacttcctcgatcatgtggttcacctctttggcatccatgcatcgcaggagggtcatgtcatggtttctcttgtatag

SEQ ID NO: 46316 - DNA, 563 bp, Glycine max
  Peptide Sequence Number=SeqID_138001
gtgaagttgtggagactttacagtatatggtgttaccacaagggaggaacacatggacagttgatgatctcgtgccttacgtgggaaagttagcgattatatccgaagagcaagagagaatcactgagccagtgtcacatggtccagcatcagagcgtgaattttcagcacaagagtttcacattcttcagtcaagtgttgaaactcgaggcataggcagacgaagggagtctgttgaagcggaagaatattcccaacaaatgatggagcgtggtcatgaaatgtattacacgccagcaacattttcccaatatccttcacagatgtatcagtatccttttgaaggtcattacactgatacttctgcgagcgaacatttgttctgtggtgttgtgaaaacacagcctcattttttatggcccactatgactccttcacagcaacacgatgtcccaatggaaacacctaacgccccattagctccgcaatggaatgagttttctgctgaggctgagcaagtagaagcggggagacaacgcgacagaagaaatcctgatcgtcaa

SEQ ID NO: 46317 - DNA, 291 bp, Glycine max
  Peptide Sequence Number=SeqID_138002
atgtcgctgcatgttctggatctggatgtgttttctggatttcccccagggattccccgtctactgggcaggatcatcttgagctaccttctggggtggggacaaaacatgaacagcagaaaccaatcaaggtacttaggaacggatgcaagtggggatggggtcacaactgaccgatcgttgccccttctctgcgctaaacaagcagagaacgtcgcgcaaggcagcccagtatcctttggattcgcagtattttactaccattgtttgtttttattaattaacgcctaa

SEQ ID NO: 46318 - DNA, 497 bp, Glycine max
  Peptide Sequence Number=SeqID_138003
ttgtaccatctgtggtgaggctcatgaaacgggccaatgtattcccatggaagaaaacactcgagaaattcattatatgggaaatcaacagcgacaagggtatactcaaggaggattttcaggcttccagcagggtctctataatcaacaaggacagtggaggacacaccctggcaaccagttcaataaagaccagagtaacaatgtcaaatcataaaagcactgagtcaacactgaagaaccttgaagtccaggtgggacaactggccaagcagatagctgacaagtcatccaacagttttgtggaaaatacagaacagaatgccaaggaggaatgcaaagttgtgatgacaaggagtaagaggtttgtggaagctaaggatgaggaaagtgtagtgcacaaggagaaagcggctgaaaagaaaggtactgaagttatgaaaaatgatgtgagaggtgaaggcaatcaggaaaaagggaaacaaataatggtctag

SEQ ID NO: 46319 - DNA, 261 bp, Glycine max
  Peptide Sequence Number=SeqID_138004
atggcacgtagcgtgtccgcttcgtgcccctattcaaaggacctatatgggagagagctaaaaaggaagtccccaaagatgttgaagcacccaaggccgattcatatatactgggaggagaagtctgggagcttctaccatggcaggtcccagattttaccgtgctttgcaaaaattgtttatttgcttggtacccgcttattgtttatagctgaccatgcaactgctctagctcttttgaagaaggctggtgattcctaa

SEQ ID NO: 46320 - DNA, 624 bp, Glycine max
  Peptide Sequence Number=SeqID_138005
gcgagacttgccaaggagaagttcaagttagccgctacagacatccggaaagagtgtgtcggattacgagaagagaatgcaactaccgcaagagcccttgaacaagagaccaagagggctcgcaaggaagagtatggtcgtaacaaatttcgcggagctttgtggggtagcaacagtgaactcaagctgcgaagggaagaaagagaccagtcgcgagcacatggcatggtcttgaaagaggagttagttgcttgttcaaggtccagaagaaacttgtctcagcgtttgtgcaagacggagaccaacatgctagctatcatcgccaagtaccaagaagagctaagtctagccacggcccacgagcatagggtcgcggacgagtatgcccaagtatacgcggaaaaagaggctagaggaagggtgatcgactctttacaccaagaggcaaccatgtggatggaccggtttgctcttaccttgaacgggagtcaagaacttccccgattgctagccaaggccaaggcaatggcggacacctactccgcccccgaagaaatccacgggcttctcggctattgtcagcatatgatagacttaatgacccatataattagaaaccgctag

SEQ ID NO: 46321 - DNA, 319 bp, Glycine max
  Peptide Sequence Number=SeqID_138006
tgatcttccgtcacagtggcttctgtttctatcagctgtccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcccagtcaagagg

SEQ ID NO: 46322 - DNA, 612 bp, Glycine max
  Peptide Sequence Number=SeqID_138007
gatgttctggtcgctgctattggacgtccagagcaccctgggcgtgtccgtgctgctggagccggtgtcaccatcaaacaatactttggatcggctccacagacgtcccgcagcgcttcctccctgcctcctgataaattacagcagctgacccaacagatcagggaccagctagaggagtccatcacagagaaagtgacgaggcaggtcatggcatccttcagccagcttcagtcgcagatgcaatctcaggaacttgcagtgcctcttgagcctttggttggtcctggtccctttggtcctcgagtgagcacaaaggggagttgtgttgatccctcaagaaacgatcctgagacgggtgactctgataggtgcggcttgtacatagaagcagatcctgctcgcctggttgccatggggagagtttatgagggatccgctcttgttcataacactcctttgttgcctggccaagtaaaggtaggtgtggaggaggttacagatgtagatgctccagttcctgtacccactgatgaggtttccttagtggggcagacacttcacaccttccttgcttggccgacacatctggtcaagtctttatcacaacag

SEQ ID NO: 46323 - DNA, 225 bp, Glycine max
  Peptide Sequence Number=SeqID_138008
atgagcacaagctttgaagatattatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaagctgcaccg

SEQ ID NO: 46324 - DNA, 363 bp, Glycine max
  Peptide Sequence Number=SeqID_138009
atgtcctctcgggggaagaaaaccatatctttcctccgggtgtctcccctctttgagcagaattgcaactgtggtcaaggattcaacaagaggtttggaccgcataaaatagactcggaacgacatagcgggcctaccacgggggtacctagaagacaaggcgaggggtatggccaatcaaggagattgggtcccgtttatggatgtgttagctttgctaatttttgggatcgtcctctttccaaacgtggatggtttggtggacctagcagcaatcgacgctatcggccagctcctgggatatccgttagtactggaagagggccaggagtgcgagtatggccagaggaggaaccggtctga

SEQ ID NO: 46325 - DNA, 848 bp, Glycine max
  Peptide Sequence Number=SeqID_138010
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatactttccttttaacgccttgcgcattgcactacaatttaacacctcaggttcctaacttggaactctacactttccttttaacacctcggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46326 - DNA, 183 bp, Glycine max
  Peptide Sequence Number=SeqID_138011
atggtgaaagttggaacctcttacgtgccgatcaacgtctcattttcgccaaaagttggcccagggcttcccggtatcaacagggacaccaggatttatttattctgcgaatcttccgtcacaggtgctccagtggcttctgtttctatcagctgtccctcctgttcagctactgacggggtg

SEQ ID NO: 46327 - DNA, 708 bp, Glycine max
  Peptide Sequence Number=SeqID_138012
ggtggacccttgggtactagtaccctcacccttagagggctacacgcccttgccatcagaggactacacgtcctcgccttcagaggactacacgtcctcgccttcagaggactacacgtcctcgccatcagaggactacacgtcctcgccttcagagaactacacgtcctcgccatcagaggactacacgtcctcgccttcagaggactacacgtccttgccttcagagggctacacgtccactccttcagaggactacgcgccctcaccttcagaggactacacgtcctcaccttagaggactacacatcctcagaactacgcgtcctcgcaatcagaggactacacgtcctcaccttcagagggctacacgtcctcaccttaagaggactccacgtcctcgccttaagagggctgcacgccctcaccttcagaggactggacgtcctcaccttcagagggctacatgctctcaccttcagaggactacacgtcctccctttcagagggctacacgccctcacctttagaagactacatgtcctcgccttcaaagggctgcacgcccttgcctttagaggactggacgtcctcaccttcagagggctacacgccctcaccttcagaggactatacatcctccccttgagaggactacacgtcctcgccttcggagggctacatgcccttaccttcagaggactacac

SEQ ID NO: 46328 - DNA, 561 bp, Glycine max
  Peptide Sequence Number=SeqID_138013
atgggtaaagcggaggaggtacaagagcagatggaggccgacatggaggccatgaaagagcaaatggccgcaatgatggaggccatgatgagcatgaagaagataatggaagccaatgcggttgcagttgcctctaccagcgctgttgctaaggtgaacccgacgtccccatccggcatcaaccaaatgaatcatccaacctcaaatatgacacatgaaattcctcaccacaatctagccgacttcgagtcttgcctcggatatgccactgaagggcaagcagttcgtggtatacccctgcaaaacactttggagggccctcagtatcacccacaactacacctcttgcattccacaacaagtaaaaaccctcatgctatggcagaaatgggaaagttggatcatctagaggaaaggctcagggccattaaaggaggtgaagattatgccttggctaacctagaagagttgttcctagtacccaatatcatcacccttcccaatttcaaggtgttgtactttgacaagtacacggaactacttgccccaagaaccatctaa

SEQ ID NO: 46329 - DNA, 482 bp, Glycine max
  Peptide Sequence Number=SeqID_138014
atgacaggcgccgccgatgctgttcacacagagggagtggctactgatgggagcttggagtcacctgctgcaaatgagggattccccggtgggccacgcgacccttcggttttgaccgattttgctgagcatgtcgcacacaacatctggagtggacaacgcctgagatcgaaaggcatgattgctgccaccggattgagtccactgatcaggtgttctgttatcactactgatcctggactcatatccgtcttcgtcgagaggtggcatcgcgagactagcacgttccacttgccagtaggcgagttgatgatcacgctggatgacgtggcgtcactcctacacgttcccatcactggcgcgctgcataagtttgagccgctagttacttcagacacgattggtctactgatagagcttcttgaggtcagtcatgaggaggctacatttgagacccgacaggctggtgggcctcatgtccg

SEQ ID NO: 46330 - DNA, 390 bp, Glycine max
  Peptide Sequence Number=SeqID_138015
atgggcagaaccaacggttttctagaattgtggttgaaagatgaccagaggtttgaagaaaggaagtcccggaaagacgccgatcgcacttcttttcggcgaggcaacacacaatttcaggataaaggtttagttatctatcgagctttacaacgaagattttgtattcgacaccggcatgctaaccttgacaagattaaaatacttaatgccaaccttgggcaattaaaaaaaaacttaatggattctgagcctgtaactgaaattgtggcaaccgaaaatcacccaatgctagccaacgtcggccaccattggtcccaaaaggtaatgaccgatcgaggtttaaaaaagcacaccggatggacgccgttattacgaacattgaactaa

SEQ ID NO: 46331 - DNA, 195 bp, Glycine max
  Peptide Sequence Number=SeqID_138016
atggggagagttaacttagagtcaaatgtgagaatgatagtgttgtgggtggaaaagattgagattttgagggttagaaaagtcaaatttggggttagtggaaattggagtctaaagacttgtaggaaagcttgggcggagcaaatgagaaaaatgagtgacaaatgtgaaaggaaagagccatttctagggtaa

SEQ ID NO: 46332 - DNA, 247 bp, Glycine max
  Peptide Sequence Number=SeqID_138017
tgctttaaaaggtcttgatgatgctccacagcctaaatcaaaggctgctgctaggtggattatcgtcaagtgtaatagacaaaaaggaagcactgagtgtggttattatgtcatgcactggatgtccaccatcatattaggaattttcaggaataactggaaagcgtattttaacaatcctagaccattggagacagagattaaaggcgcttcggatccagtgggcacagtattatctccgagttag

SEQ ID NO: 46333 - DNA, 427 bp, Glycine max
  Peptide Sequence Number=SeqID_138018
atggctctagtgactggtcccttcctagggagtattgcatcaactaggatcagcaaagaatgtgatgagctgaaggatatcaacatgattgtggttgaagcactagataatgagctcaaacttagaaaggccaagagggaaaaatcaaggatggaaagcatgatgtttgaggataagttaaagagttgtcagaggtcgaagagaactgctagtcacatgcggatgctggaagacaaacagacaaaggtgtcggctttgcaggttgaaaaggaagcgagagaaggggtgatagagttattacacaaggaagccatgaaatggatggatagatttgctctcactctgaatgagagtcaagagcttccaaggttgttagccagagccaaggaagtggctgacacatactctgctcctgatgaagttcaca

SEQ ID NO: 46334 - DNA, 405 bp, Glycine max
  Peptide Sequence Number=SeqID_138019
atggtgggatacacacctttaagctttgcggatttggtcttcgtcggtgaaaggatcaaagtgggtctgaaaggaggaaaatttgatcttcttgctttgatgaatgcgaaaactggggcaaatgaagaggatgagaatgagggagaaacccttgctgtgactgccattcctacacggccaaatttcccatcagcccaacaatgtcattacttagccaataacaacctctctcattacccaccacccaatcattcacaaaggccatccccaaatcagccgcatggcctaccttcgcacgaccaatgccaagcaccccctttagcagaaaccaaaacaccaaccaaggaaggaattttgcagcaaaaagcctatagaattcaccccaattccagtgtcctatgctaa

SEQ ID NO: 46335 - DNA, 789 bp, Glycine max
  Peptide Sequence Number=SeqID_138020
atgcacgccctcaccttcagaggactacacgtcctcgccttcagagggtcatgtatcctcaccttcagaggactagacatcctcaccgtcagaggactacacgtcctcacatttagaggactagacgtcctcaccttcagaggactagacgtcctcgtcgtcagaggactacatgtcctcacatttagaggactagacgtcctcactttcagaggactacgcgtcctcacctttagaggactacatgtcctcactttcaaaggactgcatatcctcactttcagaggactacacgtcgtcaccttcaaaggactacacgtcctcaccttcagaggactatgcgtcctcactttcaaaggactgcatgtcctcactttcagaggactacacgttctcaccttcagaggactacatgtcctcaccttcagaggaccgcatgtcctcactttcaaaggactacacgtccttaccttcagaggactacacgtcctcaccttcagaggactacacgtcctcaccttcagaggactacacgtcctcaccttcaaaggactacacgtcctcaccttcagaggactagacgtcctcgtcgtcagaggactacacgtcctcaccttcagaggactagacgtcctcgctgtcagaggactagacgtcctcgccttcagaggactagatgtcctcgccgatagaggactagacgtcctcgccttcagaagactacacgtcctcgccttcagtgggctccacatccacaccttaagtgaatttaaggtcctctacccgtaa

SEQ ID NO: 46336 - DNA, 471 bp, Glycine max
  Peptide Sequence Number=SeqID_138021
atgtccggcactcgcacaccgcgcgatgcgagtgttgactcaggccggggccgcagatcagtcgctcgttcggagacgcggtccgaactgctcggacaggaacttccaggatgctcgggatcaggccaccgacacgcccaggccggtgcccggaccgatcaccgcgtagttgcgcggctggcccggcttgcccggcacccaggcggcaccaccgacctggaccacgtcatcgggctgcagcagcgaaatcgccatcgcctgtgcggcgaaatcgttgatcaggtgcagttcgtcgaacccgagcatcgctgcggtgcggctgcgcgagatcacccacggatggttggtgatgcgcgcttcgtcaccatcaacgcgaccggccactgcgaacacgccgcggctggcggtggcgccgatctgttccagatggtggcgcgcggcatcacccagcgatgggaactccgccaccgc

SEQ ID NO: 46337 - DNA, 74 bp, Glycine max
  Peptide Sequence Number=SeqID_138022
agaaagaaggagagacgggagtcacttatttcaaatcgcttatggttggaactattgtgattgagatcaattaa

SEQ ID NO: 46338 - DNA, 438 bp, Glycine max
  Peptide Sequence Number=SeqID_138023
atgaccatgattacgccaagctcgaaattaaccctcactaaagggaacaaaagctggctcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46339 - DNA, 1260 bp, Glycine max
  Peptide Sequence Number=SeqID_138024
atggttaaggaggattatagagagacacttgttagcactgccacacctcttgggcttgaggttattcctaaagtaaagaagttgtcagatgagggtttggttcgtaagagcttaaatccttgtgctttgttgattatggttagaaccagaggtttgggttgggctttaggcagggttataggaagagccctagggagagaacatgtggatcatgcagatgacgaggtccatgaacagcctaaagaagcagctgttgatgatgaacgtcctgagctaaagttatcctcccatggaagcaaggttgagaaatttggtaggcctgctccagagattaaaggcttagtggctgccacaggattaagtcctctgattgcatgttcgctggacacgagtgatcgaggacttatgtttgcttttgtggagaggtggcataaggaaactagtagtttccgtctgcgagtaggagaggtgactatcaccttggatgatgtggcatcgttgctgcatttgtctattacatgcgtgttccattgctttgagcctcttcatgtggatgattttgtgtttctcttagtcgaattgcgtgaagtcagtgctaaagaggaaagagctaaaacagtacaatgccatagggcatatgtgcgactatcctggttgcgagacaatgcaacacacatgcatgtggtattcttggatgcatttcgtgacctgacgcaaagtggaagctatgcatggggagctactgtactggtgcatatgtatgacaatttgaatgatgcgtcaaagagcacggcccgacaactattacaatgttggatctacgagcattttcctactgttggttctgctattgctaccgaggattatgatgagaggacaccacttgtctgccgttggaactctgggaaggcattaccggtatcaacgtactataagaatttggatagattgacgtctgatgatgtgttctggattttgtatggggggcaccgtgcattcagagagtttgagactattcctccacaccctgctactccttctctatgtatagaagacattgataatagatggattcagttttctgaatacattgcatcagtgggtcagatatgtgtagcacctggacaatgttctctagactacatggagtggttctatatgatatctcatcctttcatgagtctagcacagcctggggatcctcctagacatccgcctatgcagcaccatgacacatttgttgaaccagatgttgcttag

SEQ ID NO: 46340 - DNA, 1329 bp, Glycine max
  Peptide Sequence Number=SeqID_138025
atgtcttccagaaaaagaaagagcattggtgcaaggcccacaactcaatatgacacaagaagattccactccttcgaggcctggaccagatacacagataatgtgctaggaagacatttactagctgagaggaaggtagaaatataccatatggagttggatgagttcaaggctgaattggagaggcataacttccacaagcacctcaccaatttagctgatagcaacatcgacctagccttggtgaaggagttttatgccaacctctacagtcccaaggggcctttaccaaaacaagtcagaattcaaggccacttgataaaaattgatgcagacaacctcaacaccttcctggagacacctgtggtactggctgagggagaatccttacccgcttactctagatactgtagaatgcccattgatatcaaagagattgaggctgctttgtgtatacccggccgagggtttgttttaaatgctgaaggccatcctgggaagatcctcaggaaatatctggatctgacaactcttgctcaggtttggagtgttctctcatactccaacctgtctctgacttcccacacctcagatttgatttcagatagagctaggttaatctttggcctagtctctcagctggacatgaatgtaggatctctcatctctggccagatcacatcaatggcccattctaactcctctagacttgggttccctgctcttatcacatctctatgtaggtccagaggggttgcttctgatagcctagtcttcgaacgcttgagcccattcattaacttggcctatatcaggaagaactgttggaaccttgccgatctgacagttactattagaggggctaggagagcgagggcaaggccagctaaggctccttccacatctacagctcctcctccagcacgtaccttagcagctccttctaccccatcttctgtagactttcaacgtcttgaagccatgcttcaaagcatacatcaagggaagattgttttattacaaagtttacagctggtagcacctccagactctatcccttctgttgaacaatttaatgaatgggtagcctggcccgggactcagcctccccttcacagggaagacgaaggtctcactgctcaggtaccacagcagagggaggatgagtcatccgagacttccactctagagcccctgatcaaaaggaagagggtagttgaaacacgagaagctgcaaccacttctgagaaatctcttgaggccacttctgagccttcagaaccagtggcaggcttcaattcagcaggcaatagacccctccactcctaa

SEQ ID NO: 46341 - DNA, 510 bp, Glycine max
  Peptide Sequence Number=SeqID_138026
atgtatccggaagaaattttcggcacagaaggaggaaggtccggaatgaccacttccggaagaccttcttccggaatgtataatggtataatattaaatgatttaggtgtagtaaatttttggatgtggttatatgataatttgaatgtacttgtgtatgatgcatatgtccttaagatggacgaagatcaatggaggtatgactttgcgatgtcacaagaagttcatatggattatgattatgataatcaagaagaatgtggagtgaatgaacgacatgtcgattgttcaaatgcttttaatacatctcaggtattcgctactcgagatgatgttttgcaatgggctcgaacagttgcccatgaaaatggatttgttgcagtgattatgagatctgacacagagaccgaaataaagaattcgttagaaaagacaccgggagtaggaaatgtggttgtcccttcaggcttcgtgggaaaccagtgcgtggaggggaaggttggatggtga

SEQ ID NO: 46342 - DNA, 336 bp, Glycine max
  Peptide Sequence Number=SeqID_138027
atgggctctttagaagctcatgaagctagaatgaaaagatttgagcagccactagagcaagcattccaatctaaaattaatatctctaaaaatgatggagataagaaaaataaccacggtaaatttcctcaaaaaagaggaggagcatttactaatcgtggtaaaaggagcggaaagcaatggagtaataatgtttcaagctcctattgcaaattatgcaagaaaaataatcacgatagtaatgattgtcggtccaaatgcaaaaaagtgcaaaaggcacctacactaccaaaaatattgtttttaccgacaaaaagaagaagcaaattttcctga

SEQ ID NO: 46343 - DNA, 530 bp, Glycine max
  Peptide Sequence Number=SeqID_138028
atgggtgatcaagaggagacacaggaacagatgaaagccgacatgtcggctctgaaagaacaaatggcctccatgatggaggccatgttaggacggggaagggacacactggggcacgatggcagccctcacctgggatacaaccgagtggcttacccttatagattgccgcccaactactcaccacccgtcttgcaagacgatgcgggccatattgcttctcccgtccttgaaagagagcctcctcaacagcccgaagaagtccacaaagaccctcaagactatgctcgaagggatgtcgagttctatcccccgatccccgaagggccggcacccagcacgttgcctcagcccaacatcgcaacacaaccaatagttttgtccacggaaggatcgtccccggcaactgaagaaaagaggaagcttgatctcttcgaggaaagattgagagccatggaaggatttggggattatccgttcgcagacatgacggatctttgcttagtacccgatgttgttattcccccgaa

SEQ ID NO: 46344 - DNA, 465 bp, Glycine max
  Peptide Sequence Number=SeqID_138029
atggaaatgtttctcttttttttttttttttccttgagacggagtctcactctgtcacccaggctggagtgcagtggcatgatcttggcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46345 - DNA, 733 bp, Glycine max
  Peptide Sequence Number=SeqID_138030
gcgtaaaacaaagatgtttgtcgacccaaacaatgcaaacacagctgcattgggtgaagttgtcgagactttgcaatatatggtgtcaccacaagggaggaacacatggacagttgatgatctcgtgccttacgtggataagttggcgattatatcagaagagcaagagagagtcactgagccagtgtcgcatggtccagcatctgagcgtgaattcccagcaccagagtttaacattcttcagtcaagtgttgaaactcggggcttaggcagacgaagggagcctgttgaagcagagcaatattcccaacaaatgatggagcgtggtcatggaatgtattacacgccaacaacattttctgaatatccttcacagatgtatcagtatccttttgaaggtcatcacactgatacttctgcgagcgaacattcgttcggtggtgttgcggaaacacaagctcatttttcatggcccactatgactccttcgcaacaacacgatgcccccatggcaacaccttacgccccatttgctccgcaatggaatgtacccggagcaatacctgatatgggtgacttattaggtgttgatttgcgtcaggaattttctgctgaggctgagcaagcagaaacggggagacaacgcggcagaagaaatcctgatcgtcaagcgcgaagatgggatcgaccatgtggcacatcatcacgacatcgcggacaccataatgactga

SEQ ID NO: 46346 - DNA, 564 bp, Glycine max
  Peptide Sequence Number=SeqID_138031
atgcgagcacaacccaagagggaggttatcgcacagcaactatgcatactggggcaagatttcatccaaccgctgcaaggagacgagtgtggatcatgcgcaccaccacaactccgatctccccctaccgaagtgtcagttggtctgtgccatcatgacatagggatcgcgcctataagacacttagtgggcctggagatgtccaacagggtcctggggtttctagctttgattacgagcctttgtcagttctacgaagtgccattcgcccctaacaaggtcatcaggcctcctactaatcaagctttcattaggaagtactgcgcccccaggcaagtagggcgagacaccacaacagccaggggatggctggcagcaggcaacagacacaccgccgccacctccagagcccctcagctcatctacaaaagctggagcgttgcctacgacccgtggtcgacaaccaggcgaccaagtccaaagccaaaggtaagcaaaagtactaggtccgtgaccgacaagtcatcatgcgtccagctcaagacgttaaagaagcgctactag

SEQ ID NO: 46347 - DNA, 162 bp, Glycine max
  Peptide Sequence Number=SeqID_138032
atgggggttaagtacctcgaggcggtcaagcgaaggttgcatgccaccaaacaatggtccccggacaaaattaggggcttcggacttgatggtggaggatgcatgaacaacgctaggcaatcaattcatggggctccagactcaatgatggaggatgcatga

SEQ ID NO: 46348 - DNA, 240 bp, Glycine max
  Peptide Sequence Number=SeqID_138033
atgggtaaagcagaggaggtgcaagagcagatgaaggccgacatggaggccatgaaagagcaaatggccacaatgatggaggccatgatgagcatgaagaagataatggaagccaatgcggcaaagatttgggaagtacgggcggcccccatgatgtgcaaattcataacgagcacgccttcccgccgtatggcttgcctcccaacttacaccacccaatgtggcgtacactcccaataa

SEQ ID NO: 46349 - DNA, 321 bp, Glycine max
  Peptide Sequence Number=SeqID_138034
atggctaagtttgaccctgaggtagtcctggagttctacgctaatgcttggcccacagaggagggagtgcgagacatgcgttcatgggtgaggggaaggctaggagtgggagttcagtcagaggaggaacagggccaacgggttcgacgaggaggccattgcccagctgttatgcacaccggggcaggatttcgcccggaccgctgtagggaggcgggtgtggatcatgtgcaccagcatgaccaccttgacccagttgtggatgacattgctgctcagcatcctcgtccatcaaatcttattcggagccccatgaattga

SEQ ID NO: 46350 - DNA, 195 bp, Glycine max
  Peptide Sequence Number=SeqID_138035
atgttggtgaagaaggacatgagggagatgattcatctcttctttatagattttgaaaagagatttgatactttggaattgcaagtggatatgcgcttcaatgaaatggagtcaagaatgacaaaggttgaagaggatgtatcttacattcggtcaagctttgatcttccaccaccgccgccaccatcatcttag

SEQ ID NO: 46351 - DNA, 210 bp, Glycine max
  Peptide Sequence Number=SeqID_138036
atgggggccaaatacctcgaagtggtcaaacgagggtcgcgttccaacaacggatggtccccagaccaaattaggatagctgtcgcaacgtgcccttcgcgggcgagcgagggcgagactcacgggtgcgctttccaaaggaggaaagatgcgcggagtcgccaccaacgtttatttgtggaaaacatcgggaaaaccgaaggaaactag

SEQ ID NO: 46352 - DNA, 174 bp, Glycine max
  Peptide Sequence Number=SeqID_138037
atgtacgattaccatgagaaagaaagagcccctgatctggaaagtattttggcagacttcatgacatatcaagcaagctctaaaggaaccagtcttctgcaagttatcaatggggagtcataccggcaatctgattatcacaataaagaagaaggagttcttaatcttagatga

SEQ ID NO: 46353 - DNA, 561 bp, Glycine max
  Peptide Sequence Number=SeqID_138038
atgggatcaagtcaaaagccttcgcttaaaaagaggttttatcaagtcaaaatcaagagcttagaggtcactagtttaggagagttggggcaattaatgggtcaacttcaacgggtagaagtctccatggaaccgattgcatccctttcccagtattatgaccagcccctaaggtgcttcacatttgaggacttccagctagtgccgactgtgaaagagttggaagaaatcctgggatgccaactgggaggaaggaagccatatcttttctttgggttctatccctccacgacaagagttgccaaggtagtgaaaatctcagcacaagagttggaacgtctaaagcaaaacagaaatggagtagtcggagtaccaaggaagtttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcaccgctcgtgcgtcgaaaagggaaagg

SEQ ID NO: 46354 - DNA, 468 bp, Glycine max
  Peptide Sequence Number=SeqID_138039
atgggtagagcggagggggtacaagagaagatgaaggacgacatggaggccatgaaagagcaaatggccacgatgatggaggccatgatgagcatgaggaagataatggaagccaatgcagttgtagttgccgctaccagcgctgtcactaaggtgaactcgatgcccccgtctggccttaaccaaatgaatcatacaaccttagctatggtaggcaaagatttgggaagtacgaatggccccatgatgtgcaaattcaaaacgagcacgccttcccgccatatggcttgcctcccaacttacaccagccaatgtggtgcacataaaaatgccccaccacaatctagccgacttcgagcctttgcctcgaatatgccactgaagggcaagcagttggtgatatacccttgcaaaacactttggagggtcctcagtatcacccacaaccacacccctcacattccatag

SEQ ID NO: 46355 - DNA, 189 bp, Glycine max
  Peptide Sequence Number=SeqID_138040
atgacccaagagctggtagcccgcggagacaccttacggttatccgcatctcgtcattcagtgaccccaagtgtgattgatgagcagaggccaatgtggtcatctgtgccctttccggagatgtcagcatcttccggtggagactttttcaagtctcaatggagtcacatgacatgcggagatacctaa

SEQ ID NO: 46356 - DNA, 279 bp, Glycine max
  Peptide Sequence Number=SeqID_138041
atgtcccatgctgtcaaggaccatcgagggaaatgggccccgaactacgaagggccttttgttgtgaagagggctttttccggaggagccctggggcaggatcaccttgggctaccctctggagtgaagacaaaacatgaatggcagaaaccagtcaaggtacttaaggatgaacgcaagcggggatggggtcacgatcgaccgatcgttgctcttctctttgcgaaacaagcagggaatgtcgccgcaaggcagccccgtatcctttctattttgtag

SEQ ID NO: 46357 - DNA, 252 bp, Glycine max
  Peptide Sequence Number=SeqID_138042
atgaagaattggatgcagaattcaaaatgggatgtgtacctaggagcctacctgaatggtgcacattggcaagtggccatcattttgcctaaggaaactcttgtcgtctggttttgttcgttgcataataggccagacaactacctgaaaggaataattaacagtgctttgaaaggacttgacgatactccacaatctaaatccagggctggtgctaggtggattgttgttaaattaacgttcaatatgtaa

SEQ ID NO: 46358 - DNA, 216 bp, Glycine max
  Peptide Sequence Number=SeqID_138043
atgtgggatgctacggtgtttggggtgcataatgacaacttctccttgtacataaagcatgaagatttgtctgaaatagcacacgatggtcaatgtctcagcatctctgttatacaattgtggatttttgctttgaaaggacttgacgatactccacaaagtaaacccaaggttgctgctaggtggattgttgttaaaataaaaaggaagcactga

SEQ ID NO: 46359 - DNA, 343 bp, Glycine max
  Peptide Sequence Number=SeqID_138044
gcgattgaagaaagcatttaatggaacccatgagagtgaaggtgccccagaaccattagctggccatgaagtgtatgatcagacacaatggaaggatcatgatgacaagaacatttggaagaaaaggcaagacaaaggatggtcgtttgaaatgttgacaagatttggtcgagatgggtatacgacaacagttgcatccgcagacacgcggtcgacgaacttatttgccctcagcatgttacacaatgtcaaccaaggagaaaaaacatttttgtcattttctgaaaaatgtaaaagtcccacaaggatactcttccaatatcaagagccttgtctcaattaa

SEQ ID NO: 46360 - DNA, 1497 bp, Glycine max
  Peptide Sequence Number=SeqID_138045
atggggttgccacaggtggcttcaggctgcactgccgaggaagtggcagcatcactaggcacatttgtgcaaactgcacctagaatggccagcataggcagctatgaggtgaacttgttggctggagaagacctagagctttcaaaagaaacacatatttcaagtatgtgtagtgatagtaagttgaagaatgaccccatggaacaaattagcaagttgtttgtcaattcagagaaaactaggcagacacctgtttctaggactgtaggttttcaaattagagcatcaactcctcgtgttaatggtttcggaggaaatggatattcatcacctgtgtttaatgtcatcagtgatgcaactgaggcttctgagtcacaacttagaaagcagttattgtcacctttgaatgggatgctgcttgcagatcattttaaaggtgatccactagacataggtgctggtatttatcaaagtcgttcaaaggctggtgatgataattctaatgctttacatgagtataagaaggatcatattggaaacaacaatcagattcactcaatgatctggtctacatcttgtttccaggaatttacaaattcattctgtaatgactctactataaaccatattgtatctagtcatcaccaacgtgcagagccatggtcttataagcattttaaatcatctccagtacgtaatgtttctgaagaaacaactaaaacaaggtcccaaacagctgcattgtctataccacaaaaaaatgtgtcatcacctcccttccctttgtctcctctgggtaaaaaatcttctaaaaatgaaaatttgggagaatgcagaaatattgatgttatcttggatgatggcaattttacttttaatagtgtggaacagtcacttgatagaacttgtcaaggcattttatcagctcaggagataccaggtaaatcacagctcaatttgaacaatatgcagcaaaagtctgacctgtttactcctgacaacatgattgatatgaaagaatactggactcattctggtagctttcctcctcgggatgccaagttatgtggaactatgagtagactgccaattagaaggtccttggttggttcatttgaggaatctttgttatctggtcgcctactatctgggaaagttagtccgaaaattgaaggctttcttgcattgctgaatgtaactggtggcaatttctcacctcaatcacaaaaaataccatttgcagtaaccagcgtggatggagacaagtacttactttattattcatcaattaatctttcaggaaagctattatcaggcaagtctagagttgctaaatttcagagaacccttagcatggatgaatcacgatctgaaaagcctcgtatacgtatacctatgaaaggacgtattcaactgaaaatggttatgcaaagtgttgcagacttgatgcataaaactcgacaaggtagcattatacaactgccaactttgatttga

SEQ ID NO: 46361 - DNA, 282 bp, Glycine max
  Peptide Sequence Number=SeqID_138046
atggaaaggataaattttattgaaaatggagtgagtggattgcctccaggttttcgtttccagccaacagatgaagagcttttgcctgcttcaatcattcctgagattaatgtcagcaaatatgatccttgggatttgccagctgtaacttcccaaacacaagaatatgaagaagattttaaaggaaattgtgatgtgcaagagaggtactttttcagctccaaggaagccaagtatcgaaacggcaatcgcatgaaccgaacaactaactctggctactga

SEQ ID NO: 46362 - DNA, 474 bp, Glycine max
  Peptide Sequence Number=SeqID_138047
atggagtgttctttacatagaaattacagattctactacatgtttgttttctctgcaacccttctttgtttatatgttcatggcttttgctgggtctacattaagagaatcatggactcagaggagatatcaatttggaaagcaatgatcaaaactcctgcttccattgcactaataatatactccttcatttctgtctggtttgttggtggcctcactgttttccacacatatctaattagcaaaaaccagtctacttatgaaaattttagataccggtatgatcaacaatccaacccttataacaaaggagtagctgcaaacttcagagaaatattttgctcctgcattcctccatccaagaacaacgtcaggtccaagattccaattccaaaggaaccatcagattcatctagaagaagagttgttaaatccctgagccctatgatgagaaaaacagcaggagacctttaa

SEQ ID NO: 46363 - DNA, 1305 bp, Glycine max
  Peptide Sequence Number=SeqID_138048
atggcaattgcagacatgtctagcattaaacttaacgtaaagcagcaaggagaaccgacacgagttctgccagcagaggaaacagaaaagggactctacttcctctcaaacctagaccagaacattgctgttccggtgcgcacggtttattgcttcaaatctggttctagaggaaacgaggatgctgcacaagttatcaaggaatccttgtcaaagattcttgtcccttactaccccatggccggtacgttgaggataagctccgaagagaagttaatagtggataacccgggggagggtgcagtgttcgttgaggctgaagcagattttgacattgaagagattggggacttgacaaagcctgaccctgatgctcttgggaaactggtgtactatgttcctggtgctccaagtattcttgagatgcctcttatgactgttcaggtgacaaagttcaaatgcggaggatttacattggggctatgcatgatccactgcatgaaagatggactttgtgccatggagtttgtgaatgcatggagccagatagcccgaggtttgaacttaaagaccccaccatttctcgaccgaaccataatcaaagcacgtgaccctcccaagatagagttccaacacaccgagtttgccgaaatagaagacatatcaaacactaaaaaactctacgaggaagaaaacatgctctacagatccttctgcttcgacactgagaagctcgacatgctcaagaaaaaggccacagaagatggggttttggaaaagtgctccacttttgaagcactctcaggttttgtatggagggctcgaactgcagcattaggaatgcaacctgatcaacaaacgaagcttctgtttgcggttgatggaaggaaaagatttgtgccaccaataccaaaagggtactttgggaatgctattgtgttgacaaattcgttgtgtaatgctggggagttattgaagaaccctttgtcattttctgtgggactgattcgtgaagctattgacatggtcacagatagttacatgagatctgccattgactattttgaagtcacaagagctaggccttctttaacagctacccttttgatcacaacttggactaagttgtctttccacaccgccgattttggctggggagaacctctttgttctggccctgtgaccctgccagagaaagaagttatcttgttcttgtcacatggtcaagaaaggaaaagcgtaaatgttcttctgggtttgcctagttctgctatggtaatttttgaagcattaatgatgatgcag

SEQ ID NO: 46364 - DNA, 366 bp, Glycine max
  Peptide Sequence Number=SeqID_138049
atggaagtggaagaggtaacctcgtacacaggatcagctgcaacgggtatagcaggatttgtggaagcaatgccttccaagattgttttgatgatgccaaagaatcaagagtcaaacaagtttcaagaatcaggatcaagattcaagaataatcaagatcaagattcaagattcaagaataatcaagatcaagattcaagattcaagtcaagagaagacttaattaagataagtattaaaagagtaaaaatcttttaccaaagagttttactctctggtaatcgattgccagaaggcagtaatcgattaccagtagccaacattcttttcaaaactaatttacaaagctgtaatcgattaccataa

SEQ ID NO: 46365 - DNA, 843 bp, Glycine max
  Peptide Sequence Number=SeqID_138050
atggttcaggaaactgcactaaaacatgtctccagctttggggcaagtcagaacaattttggagctactcaggaaatggaacttcgcaaactcatttgggttgttaatcgtatattcaggttcaagtacagagatatagcaaatggaaactgctctaaaccatatattcagctgtgggggaagtcagaacgattttggagctactcaggaaatggaccttcgcaatctcgatcatttgggttgttattcgttttcaggtttcccatctccagggaagaaatagatcatcagaagatagaaaatctcactgatgccactgatgagagttttcgatttggtgtgactccagggaggaacgacatggatgttaaccaatatgttaacaatgtgaaatacatcacatggatcttagagagtgtgccaagagaagtattagaagattataaaatgacaagcatgactttagagtttcggtgtgaatgtactcaatcagatttgttggaatcaatgagtagtccatccgtgattggtgcctctaataatgactctgttaacacaaaacctgacctgcaatatatatacacctgcttcgtctacaagacactaaagccgagttggtccaagccagaacagaatggcatcttaagcaaaacacaagtgatgcaaggttatgaattgaaaactgtggatgctttggatgggcaaagaaatgtggaagaaagaaagggaactgtacaaacttttgcgctcttcctttgcttgttaagcatgcacagtcatggaaattttggaaaaacttgtgagacccacgtgaaaagatttccacgcaaaaacgaacagtaa

SEQ ID NO: 46366 - DNA, 744 bp, Glycine max
  Peptide Sequence Number=SeqID_138051
atggctgaagcaactcgacccaaaactagaatggaacacatagaagaagccatagccaagctagcctccaaccaactccatgtcaccaccaaactaggtgaactcattcaccgcattactgtgttggaagcccgtcagcaccactcacccacacctccatcttcttcctctgcgaaaacattcctaacacatattccaatatcgactttgtcgctgacttcgccgctacctccactattgaagccaacttcgccaccacaccccgcactcatgccgaaacaccccgcacccttatcggttccgtttcccatgcatgttcctcaccttgtcactaacagcaagcaccaagtggcctacgcatcgtcctccgtcttcaaccagctcgatcacgcctgtgccgttgcttcccttgacaacctcttaagtattgttgttcattatggtcgtgaagcggctccgcatgacaagcttttggaacatagagacatgacactatttgagaggggagttgcgccctatgggtctgccatggttgcatgcgagcgccaaccagttgcttttgcattagggataactgctgacccaaaggagcctcgccgatacagaccttgggatcctggaggccctcggcggactcataacaccttgaggacaaggtctcctgatcctcgaaatctaggatcatataagacaattttcaaaaatgtcccaaacaacctaggaaatggcaaactagtagcataa

SEQ ID NO: 46367 - DNA, 420 bp, Glycine max
  Peptide Sequence Number=SeqID_138052
atggttcataaggtcaagttggaaaacggtctaatcaggctttctgttatcgcaaattcaatgatcagaatcttctatagtttggtcttgtttgagaaaagagtgaatctcatatgctatgatgaagttgaggatgatgtgttggaacaccgtgacggagaaggggttgccgatgaggatgaagttaaggatgatgcgttgaaacattgcaacagagaagtggttgtcgacaaaaaagaacttaaagatgatgtgctgaagcactacatcgaagaagtgtctgtcgatggggaggataaagttgaagacgacacactcaaatccaatgctaagaagtttttagaacctttgttggtggtgtgtggtttggagaagaatcgagaggatgaaggagacgaaaaaaaaaaaagagtaagatga

SEQ ID NO: 46368 - DNA, 267 bp, Glycine max
  Peptide Sequence Number=SeqID_138053
atggagaaacaccaagtgatgctccctacttcatctacatcatctactcctttttcatcagattttaaagttgattatatttctactgttcatgttgagaatgaggttttaagaacccaaaggatggccatatcagagcagaaagaaagtgataaagagtttattaagcaacacagatatgtatttcaaacaaagagtcaggttgatgttctggacgatgggataccagtggagaaaatatatgaaaaagatagtgaaaaacaataa

SEQ ID NO: 46369 - DNA, 1020 bp, Glycine max
  Peptide Sequence Number=SeqID_138054
atgtttctgatctgtaaatcagtggtgtgggtggtgatgctggcattgcttgagattagtcagggggctagtgcacagccatcctgcatggtggccgttggccagggctgcgaagcatggtggaatgctagatccaattgcaaggcagctgagcgacaaccatgccgaaacggactgtcaggagttatgaagattctgaacttgcttggaattttgattgcttgcaatttggaaatgccacagtcacaaccaactgtcgttaggattattgggcctccaattggaggaggtgcaattgatttgtcccttcttcggtcatatagagaccattgtgttaggcatgtctggattcgtcaggaacgaccagaggtgaagcttgtgagcctcgatgcccaggatacgtcttccttccacttacctattggagaaatgactatcactttggattataagtcttgcctactgcacttgcctatgacaagaaggcccattgattatgtctcctcagtctttgataaagaggaggtgaagatcctcctgatgtgttatctaggcagtccgacaaagacagaggcttttgcaacggcaaagacaggtgccagagtgagcttgacgtgtacgatatttgccaacaagtcctcgactcgcatccatgtctcttacctccagtaccttgacaacttggatggtttccacgaagttggaggattatgttgtggagaactcgatagccacaagatgaaaaccgttgagaaatgtaggattggtgtgaaaccttatcatccaaagagggtgttgaggattttccatccctatgtcattccgtcaaaggagggacaatcactaggtggtcctgtacatttagtgtccatcagagtacagccacaacctgggcatccactgacaaactatgtactagcgttagaagctatgcagggcttgttggaccttagagctgtgccagaaggcacaagtcatcatcaactcataaaacaagctttggaattggatgcagcttag

SEQ ID NO: 46370 - DNA, 351 bp, Glycine max
  Peptide Sequence Number=SeqID_138055
atgtacactctctatgctttcaacaatacggtgaatatcatagcaagaaaaggaattggaactctgggaacaatggtaactaggcttttaatccaagcaatagcaattagaactctaacaaatcctcttggagtgtcgggaatgaaagcaagaattctaattggagttccagggatcctagaaataaagattctaaccggggaaagaaaagtaaaaattataattttggatctgatgatgctaatcaaaacaccacttggagaagctataacaattggaacacaacaaatgcctcaagcgatgatggtgctaggaactggagaagtggttactagggcagaggtggcttag

SEQ ID NO: 46371 - DNA, 486 bp, Glycine max
  Peptide Sequence Number=SeqID_138056
atggaagaagaacaatctgtgaacggcacgatgtctgggtccaaaacgacgcaggagttggcgatggaagggcaggagtacttggaagaaaccatagagaacgctttccagatcctctcttccatgaacgacgagctctgcaaccccgttttatggtctacctctccctccacctcccccaatgccgacgccacttccgacaactccaaccaccacgccgacgccagtgccgcctctgccgccgccggaggcgccctcgaagaggcccgcgcccgatacaagaaggccgtcaccgcgcttcgcaccattctcactgccattcctacctcccagaaggaaaaaacatttgatgccggttcagctgctagccctgcagatgaagctgaaatcgataagttggaggagcgagcctcatctctaagaagggctcagagtttgttggaattcagaaacacttccagaccaaatacaggcacccttctctaa

SEQ ID NO: 46372 - DNA, 66 bp, Glycine max
  Peptide Sequence Number=SeqID_138057
atggaggagacaaagacggggcagcaaaacaaggtgccgcagtatgtttggttggtgccgcaataa

SEQ ID NO: 46373 - DNA, 159 bp, Glycine max
  Peptide Sequence Number=SeqID_138058
atggatcaatttgacacaaaagaacaatcaaaatttgacatgattaagaatcactatctttttctttctccaaccgccactgcatccgatgctgtttccctcatcatcttgacggcaattttgctggttcctcaccaaaagttcaagacttcaaggtaa

SEQ ID NO: 46374 - DNA, 462 bp, Glycine max
  Peptide Sequence Number=SeqID_138059
atgagaaaggatggtcactcatgcaacaatgagggaggctaccgtgcgaaagtgaaagatattttgtgcggtatgaaagtcattttcaccgctcaattaaaattggtagttgagataccgtggaagtgtccacatcagatcaaatatttgttttttctttttgccacccgccactacaacttccgcttcaccgtcggctcctactgcctcctttgctcgctcctcgcctcgagtttcatgctcacccgccttatcaacggcatcgttttgacgtcgtcattttcgtttcgtgaacatgggagccgccaccgtgttgctccacgttctctgctcccagttcaagagcttcgattctcgttgcgctttcttactgacccttcttcctttacagtctccaaccacccctatctctctctggcaccacccttgtcgtcaccaccacaaaaccctccactgtcgtag

SEQ ID NO: 46375 - DNA, 930 bp, Glycine max
  Peptide Sequence Number=SeqID_138060
atggctaccattgaaagtagaaggaaatcagtggctttggctctctccaagtacttttcattggatcctagtgttgttccagccgatagttcagacagtgatattaagagtctttacttgaacatcatagcggtttctggacatagggttaatcactctgatgagtgggtagcatttgcagaagccttccccgtggcccttgatgcatgctttgagaatctcaagagattaaatgatgaactgtctggaaaggctgtgcttctgggcaatggattgaacccctctgaagctgatgttatagtgtattcagtggttcattcttccctgatcaacctttcagatacaagcaaggagaaactgccacatgtcttgagatggatggattacatccaggtaacaaaacctgttggtgctgtggaagctgatttaaaatcaaacaagactgagcaaagtataaagaatgtcaacaagtccgaagcagattcaagcaaggataaaaacaaagctgagggaaaggcaacaggaggaaaatcaactggagacaaagaacctaccaaaggcaaggcaaaacctgctgacaaagtggctgagaaagagaatgaagttagcgtcagtttgcttaatattcaagttggattaattcacaaagcgtggaagcatccatctgcagatagtttgctagttgaggagatagatgttggggaggccaaagtgcggcaggttgttagtggtttggcaaagtactacagtcctgatgagttgatgaatcgtcgtgttgtacttataacaaatgtcaaacctggaaaactacgggatgtgatgtctgaaggactggtcttatgtgcttcgaatgaaggtccaaccattgtggagcccttgctccctccagaaggagcaaaaattggtgaacatatttctttttctgggtaa

SEQ ID NO: 46376 - DNA, 1734 bp, Glycine max
  Peptide Sequence Number=SeqID_138061
atgcctatgcctgcagggagtggtggtattgcccatgccttgtttgtctccaaagatcgcagaattcccaagattcgaatccaaacccgtcaacttgagaaccttttggataagaggattattgtggcagttgattcttgggatcgtcagtctcgatatccatcaggccattatgtgcgaactataggggagataggtgatagagatactgaaagcgaggtggttttgatagaaaatgatataaatacacggccattctcttcacaagtgctggcatgcttgccaccattgccatgggtagtctcttctgaagatttgtctaatccaatcaggaaggatttgcgtcatctgcgtgtcttcagtgtggaccctccaggctgcaaggatattgatgatgcactccactgtcacgtccttccaaatggaaactttgaagttggagttcatattgctgatgtgactaattttgtttatcctggcactccccttgatgatgaggctgcacaaaggggtacgtctgtctaccttgttgagcggcggatagacatgcttcccaaacctcttacggaggacatatgttctcttcgttctgatgtggaaaggcttgcattctctgtcatatgggaaatgacacccgaagcagatattattgccacctcatacacaaaaagtgtcataaaatcttctgcggcattgtcttatgttgaagcacaggcaaggatggacgatagtcgattgatggatccgattactgcagatttgaggaatatgaatagtttagctaagaaaatgagattaaggcgtattgagagaggagctttgactcttgcatctgctgaggtcaaatttcaaattgacacggagactcatgatccacttgatattggaatgtaccagatccgggaggccaaccaaatggtggaggagtttatgcttgcagctaatgtttccgttgcacaacaaattcttaaaagttttccattgtgctcattattaaggcgtcatccaacaccaacaagagagatgcttgaacccttactacggactgctgctgcagttggcttgcacttggatgtctcgtcatcaaaagcgttggctgattctcttgaccatgctgtgggtgatgatccatacttcaataagttaatccgtatactggcaactaggtgcatgactcaggcagtttatttctgcagtggggatcttagccctccagaatatcatcattatgggcttgcagctcctttgtatacccatttcacatcacctataagaagatatgcagatgtcattgtgcacaggctacttgctgcttctttagggatatccaagttaccacctgtatttcaagacagtctccagctcactagtattgcagacaggcgggcatctgtagagctacatactctaatttatttcaggaagaggcctacagacacggagggtagaatagtgaaaataagatctaatggattttttgtgtttgttcccaatgagtttgtcacttattgtctgtatggcccttttaccccttacagatatggcatagaaggacctgtatatttgacaaaagcagaaaagggaagtggagaatggtatgtagatgagcaacagcagaagattaaaaagatggatggtagcctttcatacaacgttttgcagacagtccaaattcacatggaggttgtggagcctcagcctaaccggccaaaacttcagcttaccctcatctag

SEQ ID NO: 46377 - DNA, 234 bp, Glycine max
  Peptide Sequence Number=SeqID_138062
atggcaaagcaccttgcagcgatgctgctgctagtgtttcttcttctgacatcgtcaacatcaacatctgctgataataactttgcagcgaccgaaccttccttgaacctcgcgcttcccagcgacaggagggtcgccggagggaaatacggaccaatgatcctgaacatgcttccgaaggggccggttccaccatctggaccaagcaaaggaaccaacaacctcaacaactag

SEQ ID NO: 46378 - DNA, 360 bp, Glycine max
  Peptide Sequence Number=SeqID_138063
atggttgggatgattctatattcctattattgtgctaccgagggtcaacaaaaagcagccgaagctgctgcacaagcatcacaggcaagagaaggtgaatctgagactctaattaatgtggaaaatgcaagtacggttctgaacaaaaggcctcctgtttcaaatagttacagttgtgaattgtttgttcaatacaagcttagcattatgtacattgatagtcaagggtgggtagctggcccaccatgcgacgttgagggagtgacggtgaagaaggaacgacgtagagggagtgaggagaagaaggaacaacgtagagggagtgaggcatggctgtgccattttgttttgcaatgctga

SEQ ID NO: 46379 - DNA, 903 bp, Glycine max
  Peptide Sequence Number=SeqID_138064
atgggtgaggaagcaaaacaagtgagccttcagttttggcattctgctttctcattgatatcagaatcacccaaggcccatgagtctaagccagaggaaaatcaagaagagaagaaagagcctaaaccaccatctccgtgtgtgttgtttcttgacttacattgtaaaggatgcgccaagaaaattaagaaatctattatgaaaatgagaggagtcgagggagtggtgattgatatggctaaaaatgaagtgaccataaagggaacagtggagcctcaagcaatctgcaacatgatttcgaagaaaacaaagaaaagagccaaagttatatctccattgccagaagcagtagaaggagaacctataccttctcaggctagtgaaccggttattgtagaacttaacataagcatgcattgtgaagcttgtgctgcgcagctcaagaggaagatactcaaaatgagaggagttgaaacagcagtgacagagcttagcacagggaaggctattgtgacggggaccatggatgcaaacaagctagtggactatgtttatagacgcaccaaaaaacaggtcaaaatagtttcccagcctgaacctgaagctgaaccagaaaagaaagaagaaaataaagaattagagaaacctgcagcagaagaggcaaaacctgatgaagaagagaaagaaggtggcaaagacgagaatgagaataaagaagagaaaggtgtggaagaagtgggtggtgatgagaatggagtagtggtgcttaacattgatgatgatgaaagcatgaagaggatgatgtaccactattactattaccaaccactctgtgtgattgaaggaatcccaccccctcagctcttcagtgatgaaaatcccaatgcatgctgcatttcataa

SEQ ID NO: 46380 - DNA, 342 bp, Glycine max
  Peptide Sequence Number=SeqID_138065
atggtaccaattaccaaatggcattgtcaaatgagaatggtccaaaaattaaggaaaatccctgatgtgtatgagtatgatctaggtcatttgagcggaccaagtatgggcatcgtcatggtggatttgatccagttatacaatgataatattgtggatcctaaactggcgtcttatggggtggagaatcccatttatgctgtgattcagctggcacagacaacaatgcgtagtgagcttggtaagattactcttgacaagacctttgaggaaagggacacactcaatgaaaaaagattgtgttatttgctcccccttttcttacctgaggaagcatcttag

SEQ ID NO: 46381 - DNA, 1323 bp, Glycine max
  Peptide Sequence Number=SeqID_138066
atgggctctaacgcgtattttgcttacaccgtcgtgggcttccacggctccggcaacgtctcctaccaaagcgccctcgccgcagtcttcatcgaaggaacaatcttcctcctcgtctcggcaatcgggcttcgcgccaagctcgccaaactcgtccccaagcccgtgagaataagctcctcggccggaatcgggtttttcttagccttcatcgggcttcaaaacaaccaaggtatcgggctcatcgggtacagcccatccaccttagtcaccctcggcgcctgtccaagctcctcacgtgcctccctctcacccgtcttaacggcggctaacggcaccgttagtttactacccggcgggagcgtctcgggtgatatcctctgcctgaaagacaggatggaaagcccaaccctctggctgggcctcgtgggcttcgttataatcgcgtactgtctggcgaagaacatcaaaggcgcgatgatatacggcatcgttttcgtcacggttgtgtcgtggttccgtggcaccaaagtgacggcgtttccgaacacggacgcgggtaactccgcgcacgagtacttgaagaaggtggtggatgttcacacgataaaaaccactgcaggggcactgagcttcaagaacattggaaaagggtatttttgggaggccgtggtgactttcttgtacgttgacattctcgacacgacaggaacgttgtactccatggcgcgtttcgcgggcttcaccgacgagaagggggacttcgagggacagtacttcgccttcatgtcggacgccacgtcgatcgtggtgggctccttgctcggaacctcgccggtgacagcgtttatcgagtcgtcaacggggatcagggagggtgggagaacggggatcacggcgttgacggtggcggcgtatttctttttagcgtttttcttcacgccgttgctggcgtcgataccggcgtgggcggtggggccgccgttgattctggtgggggttttgatgatgagatcggtggtggagattgattgggaggacatgagagaagcgataccggcgttcgtgacgctcattctgatgccgttgacgtattcgattgcttatgggcttattggtgggattgggacatacattgtgttgaacctttgggattggggatgggagggtttggggcactttgggcttgggaagaaaacaactacagcagcagcaatggcttcggatgaggattcccatcatcatcatggggtcaatgggatactacaaaatcaacattctccacaaaatccaactgctaaagcactacaactagagccttag

SEQ ID NO: 46382 - DNA, 690 bp, Glycine max
  Peptide Sequence Number=SeqID_138067
atgaggcctgctaagtttcttcatgcttactatagggagagatttgatgagatagggaagaagatcaagagggaaggagatgtttcatctcaaatgggaagaagacacatgttaggccctccaggaaccctaaatactatcaccccttgtgcggcatgtaagttgttgagaagaagatgtgcccaagaatgtcccttttctccatatttctctccccatgagccccaaaaatttgcttctgtccacaaagtttttggtgccagcaacgtctcaaagatgctcatggaagtaccagagtgtcaaagagctgatgcagcaaatagtctagtatatgaggctaatgtgaggctaagagatcctgtgtatggatgcatgggtgcaatttctgctttgcaacagcaagttcaatctttacaagctgaacttaatgcagtgagaggtgaaatacttaaatacaaactcagggaagctaacatgataccctcctctcatgttgcaatgctcccttcatctggggctgtttcaattgctgctccaccgccgccaccaccaccaccaccacctcttcctcctccttctcttcctcttcctcttcctctaacttcttcccctccttccatgtacatccaacaaagggatcccaccacttataccacaatttcaagtgataatatctcctattttgtctaa

SEQ ID NO: 46383 - DNA, 1158 bp, Glycine max
  Peptide Sequence Number=SeqID_138068
atggccaatataaaaaaacacagggcatcaagacactgccatgtcacctttgtagttacacatttcaatgatccgagaatatcaagtgcagatcttagggatcttcttcttcagtctatatctgtcctggtgcaataccgggagtatttggctacctttgagagcaatgaggccgccacccaaagaatgccgaaagctttattatcagcttttgataacagatcttggattccagtgatgaacatactcctacgattatgcaagggttctggttttgttggatcaatttctcaccataaaggtttttcccccttgacacttgatggaatgcagcggttgctaagagaagcttgcataagtgatgaagggttgttttcatcttttctaaaccgtctgttcaatacactcagctggaccatgactgaattttcagtttctgttcgagaaatgcaagaaaagtaccaggtaatagagtttcagcaaaggaaatgctgtgtcatatttgatctttcatgtaatcttacaaggattctagagttctgtactcatgagattcctcaagcattcctgtctggaccggacacaaacctccgaaggttaaccgagttggttgtatttatcttaaatcacattacttctgcagccgatgccgaattctttgacttgtcccttagacggcataaccaacctccagaaaaagtaaacagaggcatgatattggcacctctagtagggattatcttaaatttattggatgctacaaattcagcagaatatcgagaaaacaatgatcttttagatgtttttgcaagcatggactgtccagatactgttcagtatggattccagtatcttttggattataactgggatggatcttttcggggggaagcttatgtggcaaaatatgagcaactagagaattttctaagtctccttacttgccgcactgtgttacatcatgataaagtggatagtgtgggagatacagatcttgatgatggcttgtgctgcatatgttatgcatgtgaagcaaatgctcaaattgcaccttgttcacacaggtcttgttatggctgcattaccaggcaccttttgaactgccaaagatgtttcttttgcaacgcaacagtgacagatgttagcaaaattggttag

SEQ ID NO: 46384 - DNA, 3224 bp, Glycine max
  Peptide Sequence Number=SeqID_138069
atgggttcggtggactgttatccgtctcgtgtggacgatgcggccgtggtgtctctagattcgctgccgttagggttccgattccgacctaccgacgaggaactcgtcaattactacctgcgacagaagatcaacggtaatggtcgcgaggtttgggttatccgagaaattgatgtctgcaaatgggagccttgggacatgcccggtttgtcggtggtacagactaaggatccggagtggttcttcttctgtccacaggaccgaaagtatccaaatgggcatcgattgaacagagcgacgaataatgggtattggaaggcgacggggaaggatcgtaaaatcaagtctgggacgattttgattggaatgaagaagactttggtgttctacactggtcgagcacccaaggggaataggaccaattgggttatgcatgagtatcgccccactttgaaggagcttgatggtaccaatcctggacagaatccatatgtcctttgtcgcttgtttaagaaacatgatgagagccttgaagtttcacactgtgatgaagcagagccgactgcttccactcctgtggctgcctattactccacagaggaaatacaatctgatctggctgttgttgcaggatcgccgtcacaagttacagaagatgataagcatcagtcaatgatccctgcacactctgaggaagcaatatccaatgttgtaaccccggttgatcgccgtactgatggatatgatgcttgtgatgcacaaaatcaaattgagttaccaactgcggaggagtttcaaccattgaactttgatatatattatgacccaagaagcgagctactggatggcaaattattctcccctgtacttgcacatattcaaccagaatttcattatcaagcaaacatcgaatcagatggtcgatatgggcttcaatatggtacaaatgagacaaacatgtcagactttttgaattcagttgttaactgggatcaagtaccctttgaggatcccaattgtcaacagcagagctaccccttgtttaatgttaaggataacatattaaacagcgacttagattctgaacttgccaatatgacatgtatgcaagctggttatgcagagggggcaattgacggaaggattcctttgttgataacttcagaattttgcagcaccactggcatccccgttgactgtgttggtgacgagcagaaaagcaatgttgggttatttcaaaacaattcccagagagcttttactgatgttaatatgggtcaagtatacaatgtagttgatgattatgagcaacaaagaatctgtagtgcagttgctagtggcaatactggaatcataaggaggcatcgtgaggtacgaaatgaacagctaagcataaactcaacacaaggtactgcacagaggagaattcgtttgtcaatggctacacatggctcaaataagacggtgaaaagtgaaagttgtgcacaagaagagctttatgcaaaaccagtcattgctgtgggggagaaaggttcagaaaatcatgcttctgatgaaagtgctactcttactaatgatgggaatgaactgcagaagacacccgagtcaaccggcaaaagaaagatttctcaacaagttacaaaagcaggctccaccttggggttgaaagaccttttcttgctcagaaggtgtggagagatgagtgcatatttgataacagccattcatctgttacttgtgttcctgtcatcatccacttccctttcgaccgtgttcggctccgaggaggaacaattctatgccaaagaaattctcggagcagcacagaaggagaaggaatggttagtttcagtaaggagaaagattcacgaacacccagaacttgctttccaagaatacgaaaccagttctcttatacgcagtgaactcgacaagcttggcatatcttacacatacccagttgccaaaaccggcatagtggctcatcttggctctggttctcgccccatcattgctattcgtgctgacattgatgcactccccatgcaggagcttgttgagtgggaacacaagagcaaaattgagggcagaatgcatgcatgtggacatgatgctcacaccaccatgctacttggggctgcaaagttgctcaaccagcgccaagataatcttcagctcatttgggaaaaacatggaggtggtgttgaagtgaagtctgccatgatggagttatttgttgatccaaataaattggggtcaattccatctactaaggtatatgtacaagatgttgctcaatatgggttattctcatctggttctgaagttatagctgtgcctcttaagcatatgtctgttctgactttaataccaccagttgctggattagatggcatgctacagatcataagttcattgaaaggaactgtaagacttctattccaacctggtgaggagggagctagaggtgccttacagatgataaatgaaggagtgcttcaagatgtagaagcaatttttgcattacatatcgatactacaacacctactggagccatagcatctattccaggtgcattgacagcagctggatgcatgtttgaggcaaaaattgtaggagtaggtggtcatgctgcatcaccccacaagaatgtagatccagtgctggctacatcatttgcaattttggcactgcaacagcttgtttcaagagaaagtgatcctcttcacaatcaagtgctatcagttacttttgttgaaggtgggactgcattaaacgtgattccatcctatgtaaaatttggaggcacacttaggagcctgacaaatgaaggcatgtaccatttcagacagcgattaaaggaggcagctgtgcacagatgtaatgcttatgttgatttcaaagaagagtacttcaccccatatcctgctgttgtcaatgacaataatctgcatctgcatgtcgaaagagtaggccaaattctgcttggtccagacaatgtccatgcagccaagaagacggcggaagggagacgcacgatgatgaaggagtcaaagagcatgtccattgtgaaagagaagtgtgacgtgatggtggttttggtgtggcgtggaggttcatggatcatagtgatgattgatgagtgtgatgatgatgggtggtggagtgcgatggccatggaggtttgggaggtggcagctagagttttcttgggagaggaagg

SEQ ID NO: 46385 - DNA, 1828 bp, Glycine max
  Peptide Sequence Number=SeqID_138070
tgggataaaagaaaacggggtgtccttgtctccttggtcacaaacgccgacgactaccggcgagtattttcccggcaagaacatcgacgtcgacgacatcaacatgacgtcaacttcaatcactaccttttccatctactcccaatcccaaccaaagttcctcaatttgcttcaacacccactcattcacacccgcaccaaacgcacatcaatttcgtttcagccaccgatagttcgcgccacccttttctctacattcacttcttcccacaccccttccacaccctcctcaaatttcccatctggaagggctttatccaagttcctctcagaaaaggttgcatttttcctcattgggtcgtttctcttatcgggttgcttcagcaaaagatctgccttcgcagaagcagctccttccgtgggttctggcgcagtgttggagcagaatatgaatcccactgaagagaaaaacgaggaagagaaaagtgaggaagaggtggaggaaatgtgggagagcattttggagaaggatccgaaaaatgttgaggctctgaaggtggttttgtatgggaagattaggaaagggaagtcgaaggaggctgtgaagtttgtggaggatttgattgctgcggagccgaatgaggttgagtggaggctcttgctggcactttgttatgagactatggggcaattgagcaaggctaaaaaattgttcagggaaatcttgaagaagaggcctcttctagttagagctttgcatggtttggctatggcgatgcacaaaaatcatgaaggccctgctgtatttgaaatgctaaataatgctcaagagttagcttctcgtgaaaatagagttactgaggagagaaatataagaatcttaattgcacaaatgcatgttgtccagggtaatttggaggagggcttaaaaagatttcaagaattgattgatcaaaatcctcgagattttaggccttatatttgccagaccacattcccagcaatgcaaaacattcagaaggccatagacaaggctggtcttggagacacagtgaagtcatcagatggagattttcgcagagacattcgtgacgccataaaacaaatactgagtttgattctcgaaaggaactctccatttcttgtcaacatataccctttccttagtctcaaccagaacacctattttcctgaagaatttgcattctttgatggtcaaggcagaataattcaagacaaagatgcacaatacagcaatgtaatagtggttggtgaaattggatggccaactgatggtaacaaaaatgctaacaacaacaatgcaaaaaggttctaccaagggatactcaagaaaatggcacacaagaaaggaactcctcttcaccccggagcgatggatatttatctgttttctctaactgatgagaacttgaagagcattgagcctggcaactttgagcgtcattgggaaatttttcgctacgacggaaggccaaagtttcccattgatttttctggccagggacaggacaaatggccagtggcagccaaaggtgtcgtgtaccaagaacgatttggttgttcttgtgaaaaattggaccttgctggcaatgcttcatttgctttcaaccagtattttcagacaagggaccaaagtgttgaggcgtgtgatttcaatggaatggcaactattgtgaaacaggatccatccaagggaagttgcttgttccctatagaaattcagagcagtggtgaaatgctcagagcaatgtgtacaattggaagcctttttattggattgccattgtttttcataacatttacgtag

SEQ ID NO: 46386 - DNA, 126 bp, Glycine max
  Peptide Sequence Number=SeqID_138071
atgcttgcacttgatttggatgctattttttatcagccagaaatgcttggagagcccattgcaactctgcgtttgatgcactatgaaggctatttccaagtcaggcctcaaaaattgtatcgatga

SEQ ID NO: 46387 - DNA, 1422 bp, Glycine max
  Peptide Sequence Number=SeqID_138072
atggttcatatggttcttggtatggaaactttagggtgccacctgaaaacccattcctgccaagcactagaaaatgtggagatctatgaaccttccttagacttaaagttgggtgaaggaatgttcctgttctctcctcggcggcaaacgtggcaatggtataaattgcttaagggagaaaatcttattggaaaacatttcaaccatcctccggatggtccatatggttcttggtatggaaactttagggtgccacttgaaaactcattcccagccaaaactaaaccagattccttaaaaatgagttccaaaggctcatctgatgatgacattgttgggtctgaggatgcgagtgtggatgacattggtactgcaaactatgaatctggaaattttagagcaacggacaaatgtgtgaatccaactagaaaggaggttgatgatgtttgtcacagcccatatgcttttcaagttgatgactctctggttgataaaaaaactggtggaagtgatgaaacatataggaaaggtccaacattctttggctggatcagaagccggtggcaattttggaaaggcaatgcaaaatctggtgattcaactgctcatcagaacaaggtggttaatcgttttgaggattccaactcatctgaactagtagaccagacagtccagactgttagtgattttgaagataagtcatcagaactggaccagaatgctatttgttctggaaagcctgagttgttttctagcagttccttttggaatgacatggaatcttttattttcaccctcagaggatcacttattgtttcccagtcaaaaaacagggaggatatggcacataaattacagaaggatggggccccagtttttagatctctgcctgaaaaagatatccttcaattgttggagttattaatatcagagaaaaagtggttggaggaaagccccacccaaacatttccttttcagctaactcaaccagttcacaagaactcattgatgggccaatctcatggtgcaaatggcttgagatctctctttctgagcagagaatcacagtcctcaacgcaaaaatcatctgaacataatgtggagaaacacaatcaaagtattccttgtactagagtttctgcgaccactactgagacgaaatatacagagaggtatggctatcatcttgatttacagaagcttggttaccaaaagttggcaaccttactacagataatgccggaagttaaagtagagtccaattatatttatgcttctgattatgatcctatagtctcaggcaattctctggttgatatttttaattcatccactgagtcaacccagggtaccgtttccaaagagaagccgagatttcaaaagaactattcatttgctgctgaaccagtctttccaagctag

SEQ ID NO: 46388 - DNA, 255 bp, Glycine max
  Peptide Sequence Number=SeqID_138073
atggcttcttcacaaaacaagcgcattctatttgtggctttcgtcatcctctgcctcttctcctccccaactatagctgcacgaacattgaaagaaaaaagtaacctaactagcggggatgtcaacacagttcaacataataaggaagcgattgctaaggtatttaagcccaaagatgaggatgttaacgttggtggtgatgtgttttccatggattacactccagcttcgaggaaaccaccgattcacaattaa

SEQ ID NO: 46389 - DNA, 2460 bp, Glycine max
  Peptide Sequence Number=SeqID_138074
atgtacgtggtaaagagggacgggcggcaagaggcggttcacttcgacaaaataaccgcgcgcctcaagaagcttagttatggcctcagcgcagatcactgcgacgccgttttggtctcccagaaagtctgcgccggcgtctacaaaggcgtcaccaccagccaactcgacgagttggccgccgaaaccgccgccgccatgaccaccaaccatcccgactacgcttgcgttagttccctcaaatttctattccatttgatgaaattgtgtgtcttggatggatggattattgattgccgtttcgaatctgcacaagaacaccaagaaatccttctccgagaccgttgttttgtgaggcttaaacttgaaattgtggtggattcaggatcaagatcatgtactatcattttaaatgctgctcgtctagacagtgagataatctatgacagagactttgactatgattattttggattcaaaacccttgagaggtcttacctcttgaaggttcaagggaaggttgtggaaaggcctcaacacatgttgatgagggttgctgttgggattcacaaggatgacatagattctgccatcaaaacataccacatgatgtctcaacgatggtttactcatgcatctccgacacttttcaatgctggaacacctaggcctcaactgagtagttgcttccttgtgtgtatgaaagatgatagtatagaggggatatacgaaactttgaaggagtgtgctatcatcagcaaatcagctggaggaattggtgtctccattcatgacattcgtgctacaggcagttatattcgtgggacaaatgggacgtccaatggcattgttccaatgttgcgtgtgttcaatgatactgcccgctatgttgatcaggggggaggcaagaggaaaggtgcatttgctgtgtacttggagccatggcatgctgatatgtttgaattcttggatttaaggaaaaatcatgggaaggaagagcatcgtgctcgagatctgttttatgctctttgggtgcctgatctctttatggaaagagttcagagcaatggccaatggtctttgttttgtcccagtgaagcaccaggtttggctgattgttggggtgagaaatttgaggagctttatcatcgatatgaaagagaaggaaaagcaaagaaggttgtccaggcacagaacctctggtttgaaattctgaagtcacagatagaaactggaaccccttacatgctttttaaggatacttgcaataggaaaagcaaccaacagaatttgggtacaattaaatcatcaaacttgtgtactgagataattgagtattcaagtccaactgaaactgctgtgtgcaatctggcatcaattgcactaccacgatatgtaagagaaaagggtgtcccgatggagtctcatccatccaagcttgttggaagcacaggctctggaaatcggtattttgactttgataaactagcagagattactgcactggtcacaacaaacctgaacaaagtaattgatgttaattactacccagttgaaaatgcaaaacggtcaaacttacggcacagaccaattggtataggagtacagggtcttgctgatactttcatactacttggcatggcatttgattcaccagaggctcagcagttaaaccaggagatatttgagactatatactatcatgctctaaaaacttcatgtgatttggctgcaaaagaaggtccctatgagacatatagtggtagtcctttaagcaagggaattcttcagccagacatgtggggtgtgactccctctaatcgttgggattgggatgcacttcgggagatgatatcaagtaatggtgcaagaaattcacttctcgtggcccctatgccaactgcatccactagccagattcttggaaataatgagtgttttgaaccatatacttcaaatatctacagtcgtagagttttaagtggtgaatttgttgttgtgaacaagcatcttcttcatgacttgactgaaatgggactgtggtctcctacattaaagaataagattatctatgaagatggctctgttcagaaaattccagaaatgcctgctgtactgaagagtatatacaaaactgtttgggagattaaacaaaggacattggtagatatggctgctgatcgaggatgctacatagatcagagccaaagtttaaatattcacatggatcaacccaactttggaaagctgacttccttgcatttctatgcatggtccaagggtctaaagactggaatgtattatcttcgatcgcgagctgcagccgatgctattaagttcaccgttgacacctctgctctcaaagaaaaatccaatgtagagtatgatgataatacaaaaatggcacagatggtgtgctctttaacaaaccgtgaagagtgcttagcttgtgggagttga

SEQ ID NO: 46390 - DNA, 2637 bp, Glycine max
  Peptide Sequence Number=SeqID_138075
atggatctaagactaacagctttgagcgagaagttagttgaaacttttaacaaggccactggtgctacatgctcccctgaagatctgagttatttaggaaaattttctcaacattttgatgccactaatatagagcattctttatgcaagtttatagaacttacccaaaagagccaggatgttggtcccctgagcaaagaaacaaccttgcactcatgtgatgtgaccaaagatgatgcaaacaaggccgtcaaaaccctgcagattgcaaaaccattaccttcagatacaccagttaagtatggtgtttcaccagcaaaagcggcccaagttgagagacacagttcaacagaaagtgaggaatcttctaaatctagtgatgaggatcaaagatctgccgagagaagtcgttctctagtaagatctgcaacacccagaaggtcagcatccccaatgcgaagggttcaaataggaaaagctggaccccgcagagccgctgcattaactatcaagagcctcaattattttcctggcagagagaggccaatatcgtttagagatgctgctgaaaatgactttgaaggggaagtatttgaactgcccaataaaaagtcagaaattgatgtcaagaggataactgtacaagatgccatcagtctttttgaaagcaaacagcgggatcaaactacagatgttcagaagaggaagtcattagtagatgtttctgttagtacaaataaatctgtattgagaagatggagtgccggtatgggggaaacctctgttcaagaccaggcagaacatgttcctgaagatcctgttccagtgacttctaatgatgtggtacatgctgaggctcctacaaattcagaagtaggagtggtgtctgattttattaccgaaagtcacaataataatgataacactgatcccgacgtaaaaccagaaagacaggaaaatataggttcttttgctgcagataatccagatgaaaccaacccaacagtgaaaggggaaactaacaaaaagttagcagcatcagcagagtggaatcaacgaaagcaagaagagttcaaccaaattcttaaaaaaatggtcgaaagcaaacctgttttatttgggaagtccaagcccagcagaaaccagaatatttcatttgagcagagaggagggtcttatgataattataaggaaaaacgtgatgcaaaacttcgaggagcaaaggctggaaaacaagtagaaaaagaagcacaatttcaacaaatgcagcaactactcgataagaggaaagttgaaatgcccaaaagtgtgagtgcaagtaaaaaaagttctccaaggatgccccaaaattctcttagaaaatcaactccacctgcaaattccacaaaggaaacctctaaacctttaactacgaaaaaaatatcatctagaacatcacccatgcctgctacacgtaagtcttggtcagcaacaccttcaccaagggcagctgggacatcccctgccaaagtgcgtggtggaatttcatcagctaacaccaccccaacacgtcgtaagccagtgtcaacaacatctgttccccaaccaacctcccaaagggaaaaatctatgccctggaacagaaatgagaaagaaactcagaccaataatgccaggagcctcaaaagcatggatgagaagcggcagccagctgtcccgaacaagaacaaggcaatcaaagcaaaagtgacgaaagcttctgaagaagcctctgttccttcaaagactaacattggtaacaagggaaccaagaaaagcagtgtggtgccattggaatcgaaaccatttctacgcaagggttctcgaatggggcatggaactgctgatcttaacaagaaaaaaggtcctcctaagatggacaaatctcagagagagagtgcagatcttattgaagatcaagaaagtgagttggttgtcaatgcttctgacttggtcagtcagcattcagatggggacacagtgacacctattcatcagaatgctgctacagaaccagacccacagatacataaccaactgcaatgcagtgagacagaaaacttagaccaaaatcctacagatggtgaggtcttaacatacacagaagagtcttccttaaatataaggaatgaagaatcaaccatatcaccttctgcctgggtggagacagaagaggatctggaaatgcccaagccgtgtgaggatgacacatttcagtctgtatctctagccaatgctgccccagtgggatcagctagtcctcgtgttcgtcattctctgtcacagatgctgcaagaagaaagtagtgaacctgacacatgtgagtggggaaatgctgagaatcctcctgccatgatataccaaaaagatgcacccaaaggttttaaaagactcttgaaatttgctcggaagagcaagggcgatgcaggttccactggctggtctagcccttatatggggcacatcttggttaagcttatgaaaatgaactatagcacccttaggaacgaggagcttaacagggaccgcagagatgatggcaagggttcttacaagatgcaagacgggcgtgatttaggtgctggttcaaccacaagaggtcagtcatttactccatga

SEQ ID NO: 46391 - DNA, 2136 bp, Glycine max
  Peptide Sequence Number=SeqID_138076
atggaacatgtgcactatcacttggtaatgaaggaggaggaacaacaacaacaacaactgcaagataatgctgctttgaaaggaaggcaatccctgcaacatgggaaggttcatagtagtattgtcactgctgtgccaccttcctttctttcattggaaaaacaacctcttcttcagaaggaggaattatttcatactcaaaaagaacagaaagaacaacctactcagaaagttgaagaaacaagcaatgttgttgctgaaaatgacaataacttgaacggtgaaagtgaaacagctgggcttggaagcatagatgagtttgtagaaaatgcagtgaatggagaggctaaaagaagcgctaccataaatgttgatgcatcgcagaataagaatagtgtttactttgacaaacaacaaggcaatgatattgatggtgcaaactctattcttccaaaaaatcttggggagggagactttgatgcacgggttgaaaattctgacattcaatgtaatccatgcaatgaagtcaacaatcaatgcatggaaactgttgatgaaaaagaacctttacttaattcatctgaaatactggctgcaactgtagacaattgtggtgatgaaaacagtgcaaaagtatatcctaacttgggagaagaaatagaccagcaactaaaagactacgatgttgaggcagtgttggcaaaacaagagacacatgacttgttttgtcctaattgcaaatcttgcattactaaaagggttatcctccggaagagaaaaaggagtactattcctattcctaatttagacaccaaagcaaagcgtgacaagtcagccactgaggtggttaatggttccatagacgtaaccaatcaaggtgatgagacaattgcaacacctgatgttggtagagtagagacacctgctgataattatgaacctgaaagagaaccagaagtgttcagatgtttatcatgcttcagcttctttattcctatgagaaatggaatcaaactgttccccagttttggtggtacccgtgagcctgaaacttcacaaaaacctttggtcacaccttcatccaatgtggaagatccttcaatcgtagtagcggcttccaatgcaaattggttcttcaatctgtttacttcaatcaagggaagaaaagatagtgcgcaagttgatgcttcaattgaagattctagaacagatcctgcttcaattgaagattctagagttgataatccagaaagtccacttgctaatacagctataagtcagagtgtgaatctgtcagcagatattaagcctggacatggaggtgtaaattcttcaattccctcaatacttaagtcggtaataaagattgaatcatggatagaaaaaagcaagaaatccaatgtggcattgcagaatgagccattggttgatcagaatgattcctgggatttttcagcaaaggaacagcttctgactgaaaatgttaaaaccgatgtgggagacaaaaatcgtgattcagtggttgggataaagacagatactgttgcagatatatccaagcgtgatagtgttttattaacaactgttgctaccactgaaaatgtgagaaccgatttgggagagaaaaatcgtgatccagtggaggtgataaagacagctaaccatcatgtgcaatccatctactcacttctcccaagtggagctggaaaatcctctgttttggcccttttactaagattttatgatccacaggcaggaaaggtattaattgatgggaaagacatacagaaatataatctaagatggttaaggacacacataggactggtacaacaagagccactgctttttaattgctccattagagacaatatttgctatggcaataatggggcttctgaaagtgaaatagtggaggttgctaaagaagcaaacatacatgaatttgtaagtgatctaccactgtcagctttccggaggacaaaagcaaagaatagccattgccagaacattactatagaagcctgcaatagtgaatgctttaaaagcaatacaactgaaggaagacagtggcttgtaagagaaaagaatgaaggcgttaaggagcaaggttcttacataatttctggattctaa

SEQ ID NO: 46392 - DNA, 1086 bp, Glycine max
  Peptide Sequence Number=SeqID_138077
atggaggcactgttgtgcagaaaactgggtgatccaacggtatctttggaagacaacaatagcccaatagttctgtcaaagaatcacccaattccccaactcgattctcccactgcagtaagagtgagaatcaaagccacaagcttgaacttcgccaactacttgcagatactgggcaagtaccaagagaaaccctctttgcccttcatcccgggctccgacttttccggtttcgtcgacgctgttggccccaaagtttccaacttccgagtcggagacgccgtttgctccttcgccgccctcggctccttcgctcagttcatcgtcgttgaccagtcccagttgtttcaagtgccccaaggttgtgatcttgttgctgctggagcacttgctgtggcgtttggcacttctcacgtggcacttgttcatagggcccaattgagctccggtcaggtgttgttggttttgggtgcagctggaggtgtgggacttgctgctgtgcaaattggaaaagcatgtggggccattgtcattgctgttgctaggggagctgaaaaggtgcagctcttgaaatctcttggggttgatcatgtggtggacttgggtaatgaaaatgttactcagagtatcaaacagttccttcaggctagaaggcttaagggaattgatgtcctgtatgatccagttggaggcaagctcactaaagaatctttgcggcttctgaaatggggagctcacattctcataattgggtttgcgagtggagaaattcctgtcatccctgctaacatagctcttgttaagaattggacagtgcatgggctttactggggtagctataaaatacaccgcccaggtgttctcgaagattcactcaaggagctactgtcttggttggcaagaggcttgatttccatccatatttctcattcttaccccttgtcagaggtaatcaggttcaacagtgaattcagtttaacttgccacatggagtggcaatggttgttatctgtccatcactattgtggtttgggcgctggtttaatgctactctttcaaactgcagttgttgtgttgctcatttaa

SEQ ID NO: 46393 - DNA, 321 bp, Glycine max
  Peptide Sequence Number=SeqID_138078
atgaaggaccaaactccttccttgttgactgatttggttcaattggtaatggaaaggacatctttcaaactttcagttggaaaccaacatcccttttttgctcacaggactaaggctaagttaaacattccacatatcattcaagcaaacaccaacgctgaaaactgcaaaggtcaaaaagggaggcaaatggaaatgctgcaaaccctagagaaggtactgaggaagaaagaccaagactttatccgtgtgcttcacttagctcaagagcgtacaattcaggcaaaggccttgaagtcggagtgtgttaaggtttcttag

SEQ ID NO: 46394 - DNA, 1407 bp, Glycine max
  Peptide Sequence Number=SeqID_138079
atgggagcgtccacttcggcggagccgagagtgtcggcggagcagaaagaggcggaggccgtcacagcctccaccggagctctccccctgcttcagaaagccttctccaagctcgctaatcccgagaccaacgccgttcccttagaaatctccagtttcggtcgcgaaggtcgaagttattccggaagcaacgtgccagattcgtttccggtgttgttagatcacttagcctcatccctagttgatcaatttttcgtgcctgacaaagagggaataatttgggttgaattcgtgaggggttacaacaagtgctgtgctagggtgtccgcgtcggtttctttgaatatgctcatgagagtgttcgctgctatttcacaaagtgcgaacgtgcctttgcatttggagtttgaatcaggggatgatgattgcaaggtaaacgggcacgttcttcctagcaacgtgtttctgcttctcgccctgtgttgggttatgtcgtggggtggttctagaaagttgaaaggggaagggaatttgagcttacctgatctgaatcatttggtgttgtcggtgatcgcatcgtgtggtgaggttgagggtggtttgaatgtgtgggactgtgatatctcgagcttggaggttcagcttcctgcagggaagtttgtgacgtgggttatgagcaccgtgccatgcctcccggattgcttgaggcagtattttcatgctagattgctaatagcagcatctgatggggtaatttgtgtgtttatgatcaatggattcagtgatcatcgtggttacaaaggtcctttgttaattttgatagctgcaagttcaggagatgctcacgagggaaattccattgataggaaatgggttataggtgccttaacagatcaaggtcttgaaaataaagatatcttctatggaaactctggatgtttatattctattgacccagtgtttcatgtgtttccaccaactggtaaggaaaagaattttgtttatagccacttgcatcctactggtaaagtataccaaccgcatccaaagccggttggagttgcatttggaggaactccaggaaatgagagaatatttattgatgaagattttgcaaaagtgactgttcgccatcatgctattgacaaaacttaccggagtggatctctctttccagatcagggtttccttcctgtcgagggtctgatttctgaagttgaagtttggggacttggtgggaaagtagcaaaggaagtgcagaactcttacaagaagagagaagagcttttcactgagcaaagaagaaaagttgacttgaagacatttgcgagttgggaggattcacctgagaaaatgatgatggacatgatgtctgatccaaatgctgtacgaaaggaagaccgctga

SEQ ID NO: 46395 - DNA, 2325 bp, Glycine max
  Peptide Sequence Number=SeqID_138080
atgacacagagagagagaataggtggggattactacattacagtacattacataacagcaaagcatgaagatgttgtagagtgggtcggtgctcgtgttgaatttcggggtggtagcttgggattcaagacgggtatagtgtttcaactccaaaagcttttggcttctttttgtgtatcttctcgtattgggatcctggtttcgagagagtttccaacatgccaacaagagttgtcattggctgtttcagttgagttggtgagaggttcctcgtacttggtccctcgagtgaaactcggtcccttgatttttgggggtgtgctcgctatgctgatctctgatgaaggagatagtgatttgttctttgactcagtggattgtttctcaccaacccgagagtctcttttgacaaaacaagagtttggctatgagatttgggtgaatgagcctgtgagtgtgatggaaagaagggaaaagtttttgcaggggttgggattgggtgatggatcatcttccaaggtttgttctcaagagaataatatgatgagttctgatgattcatcagtgagattgggactagagaggatcagggatagtggggcagcttcaaatgcttgtagttgtattttgcctgatgatcaagtttctgagttggttctctcgggcagcgaagccacttctgaggcacaagccttgtttgatgaacataagggatgccccaaagatgaatcatgttttgaagggaaggtttatgaggtttcttgtacagatcaagaggttagacatagaaaagtcgaggttccagaaaagtgtcttggttttgatatgggtgaaaaggagaagaaaaactggtggaagcactttataagcagcaagaaaggaggtggaggtaaattcagatcaaaattgaattcaacgacaaataaaactcgaagaataaatgtaaggcagaataagaagaggtggatggagttcagtgcactgtatattggacaagagattagagctcacgaaggcctaatttggactatgaaatttagtcccaatggccaatatctagctagtggaggagaagatggtgtcatacgcatatggcgtgtaaaaacactgaatacatctagtatttgcttgaatgcagaagacagtgcagctagcaaagtgaaacatgacttctctagttctcagaagaaacactcaagccaatcatccttcatcgttcttccaaataagattttcaaaatcgaggaatcaccgttgcatgaattttatggtcatgcaagtgatgtcttggatttggcttggtccagttcagatactctcctttcatcttcttcggataaaactgttcgcttgtggaaaattggttgtagtcaatgtctaagtgttttctatcacaaagactatgtgacttgtattcaattcaatcccgttgatgaaaattacttcatcagtggttccatagatggcaaagttcgaatatgggggatacatgaagaacgagttgttgactgggcagacataagagatgtgataagtgctataagttaccgaccagatgcaaaagggtttgtagtcggttccctcacaggcacttgccgtttttatgttgcctcaggcaaatatttccagcttgagacgaagattcgtgtcaatggaaagaagagaacatctggcaacaagattacaggcattcagaaaaaccatcagagagttatgattacatctgacgattccaaagttagaatattggaaggcattgaacttgttcagacatataaaggcctttcaagatccggaagccagatgtctggttcatttacctctggtggagaacatataatttcagttggaggggactctcgggtgtatatttggaacttcaatgactcgggaaatgcctcttccaaacagacaaaatccaattattcctgtgagcactttggctctgagggggttactattgcaataccttggtctggcatgagtgcagaagaacgaagtggctcttccaatgattttacccactattcttcacaacaccaactagaggcctctcatggtgttagggagtcggaacgattttctttcggaagttggttctcgattgatggttcatgccgcggttcagtcacatggcccgaggagaagcttccaagttgggatctacctcttgtagaagttgaatttgatcaccagaagctatgtaccaaagatccttcccatgaaaaacatgtatcagaaacatggggactatccattgtggcagctggttgtgatggaaccatcaagacattccacaactttggacttcccattaggctttag

SEQ ID NO: 46396 - DNA, 642 bp, Glycine max
  Peptide Sequence Number=SeqID_138081
atggggttggagtcaacgacacctcgcctcaaaaccccgccgccgaaaaaagaggttcagctccagggcccgcggccgccgcctctcaaagtgagcaaagattcgcacaagatcaagaagccgccgccgcacccggcgcaccaccaccataaccacccccacgcgccgccggagcagaacctacaacagcgggaaccggtgataatctactccgtctcccccaaagtcatccacgtcacccccggcgacttcatggacgtggtccagcgcctcaccggagcttcctccggcgagtacccgccggcgggtcgcggcgatgtgtcgccggcggcaaggctggcctcgatcgagaaaacgagcccgtcggagagagaaagggttttgcactacaaagacgacgacatcgcgtggatgttggaggagggagtggaagtaggtcaatttccggggatactgacgccagagccgggaaccttgccgccgattccggcggaggtgttttctccgccaatttccggggaggacttttcgccgtcatattggtcggcgagcagcttcttggcgagtccgtcggggtttctttccgtcgccgtggcgtcgccgcagccgtcgccgaacctcttcagtctcttcgacttgtaa

SEQ ID NO: 46397 - DNA, 801 bp, Glycine max
  Peptide Sequence Number=SeqID_138082
atgggttcacatgtgtatgttcttctgagttctgataacctggccaacacaaatcatgaaagatcctattcgtctcagaacaaatatattttccaagaagctggcctacctctctggctgcgcccatatgaagtgttatgtacttcttcttacactgctcttattgaaacaattccagatacggcttctgtacattctatcaagagtcgatatcccaacatctcaagtttacgtgaatttttcattgccaaataccaagaaaattctccgagttttaaacttgcccagaggaacttcgttgaaagtatggccggatattccctggtttgctaccttctgcaggtgaaggataggcataatgggaacctcttaatggatgaagaaggccatattatacatattgattttggcttcatgctttctaattcacctggtggtgttaattttgaaagtgcacctttcaaattaacccgagagcttcttgaggtcatggattcggatgctgagggcattccaagcgagttctttgattatttcaaggttttatgcattcaaggcttccttacttgccgtaaacatgctgagcgtattattcttcttgttgagatgttgcaggactctggattcccctgcttcaaaggtggtccacggacaatacagaaccttagaaagcgcttccatctcaatttaacagaagagcaatgtgtatctttggtgctttccctcattagcagtagcctggatgcatggcggacacggcagtatgattattaccagagggttttgaatgggatattgtga

SEQ ID NO: 46398 - DNA, 672 bp, Glycine max
  Peptide Sequence Number=SeqID_138083
atggatgaagcagttaaggagcagttaaggataagtttggtgtctggcatgactatggagctggattatgtaaagacacacttatttaactctaaaggagctctcaataactctatgtggaagcttctggatatgactccagaaacttctgatcatgttgatgcatcagaaaaatctgcgagctttaatctttttcttgaagaaacccctcagccttgtgcacaaactggtgtgcaaactaaatcacctgtcaaacagttcactgagactaaaacactgaaagcattgcttcttaataatggcaaagacttgcccatctcgttatttggaagagcaaggttcactctccaagatagtggcttttcaataggaggatgtaatacattgcctgttaatgtcctttgccaaacagtttcaaatgatgcacgacaagaattcttgcaagatgctgaagtgaaggagaggtcaccagaaaaaagaatgatttacattgagtggagaagaatcagcaatctgaggttcaggaggacacgagttcatgagagtgccttttatctaaatattggatcttcaggcttgagtggaagtgtgcgaaagttgtacaggaaggtggaagggaagaatatgcaggattgtgtaagagttgtcaaatctgtttcaatactgttatag

SEQ ID NO: 46399 - DNA, 249 bp, Glycine max
  Peptide Sequence Number=SeqID_138084
atggcttcactttttgtgcttacggttgaatttattcatgttggggttatcaaagctgttaggaactctgtggatacctctgaagaagttacagcattatgggtcacccatcgtttggaagaactagagtatgcagatggtgccatctacatggaggatgggaaagttgtcatgcatggagatgccgctagcattaggagtttcattgaaaccaggcagtctgcccatataacccagatttcttcttaa

SEQ ID NO: 46400 - DNA, 1488 bp, Glycine max
  Peptide Sequence Number=SeqID_138085
atgccagggtttcggtttcaacccactgacgttgagctgattgagtattttctgaagaggaaggttcggggtaagaaattcccttccgaaataattgctgaacttgacttgtacaagtttgctccgtgggacctcccagatatgtctttgctcaagaatggggatttgaattggtacttcttttgccctcggggaaagaagtattcgactggtgggaggttgaatcgggccacggaggctgggtattggaagactactgggaaggatagagcaattgaacacaataatagagttgtggggatgataaaaacactggtttttcacactggtagagcccctaagggagatcgaactgattgggttatgcatgaatttagacttgatgacaaggtgctggctgatgaaggcgtattgcagaaaggcattttgcaggcaagcaactttgtggaagtatatgtgagtgttgtagggtttgtgactgtgaggatggtgtaccaaaaggagggtcctggtcctaggaatggtgcacaatatggtaaaccatatgaggagaaagagtgggaaacagatgaggaaattgattctgtacaatctgcccctgttgctgctgtttgtgcacctgttcctatacaacctagtgaaagccatatttcagttgctaattacatccatccctctacaagtggatgtgctggattgacctctgtatcatgtgtatcagaattgatgccatcttgctcgacacatccttcagcacctagcaatccagttggcactgtatcatgtgtatcagaattgattccctcttgctcggaaccacatcatttgccatcaaacaatcaagttggctctgtttcatgtgtttcagaattcatgccctcttgctcggcacatccttcagcaccaaacagtcaagttggctctgtttcacgtgtttcagaattcatgccatcttgctcggcacatccttcagcaccaaactgtcaagttggctctgtgtcatctgcatcagaattgatgccctcattctcagaccatccttcagcaccaagcaatcaagttggctctgtatcttgtgtaccagaattgatgacctcttgctcagcacatccttcagctccaaataatcaagttgacaatgacattctatctttgcttgattgtttctttgaagatgatgacacattggctgtgaaagaaaacaacagaattgagaacattgatgatcctgatcaggcaaacaatgccgatggtgcactgtgttcagatccaaatgctatttttgaggagttaggagaccttaacagcttggttggattgggtgaaggcagtttttcctgtggccagaaaaatgaatatactacaagcgaaatgctttatactgttgatatattcgggtcttgtgaccatgacttcttggagttgcttgacctagagacaccgcagctctggctgaataaacatggaagtggtagccaagataagtaa

SEQ ID NO: 46401 - DNA, 201 bp, Glycine max
  Peptide Sequence Number=SeqID_138086
atggcctatgacatgactatggcaatgacaatgagatgcataaaccttgattcaatgacaaaggcacaaagatcttcaaaggaatcagatgtgaaacagaggaggagactactcttgccaacacctgagtccccaatcatcaacaacttaaacaaatattcgaattcctgggttgaactcgaatccatcgcaataaactga

SEQ ID NO: 46402 - DNA, 315 bp, Glycine max
  Peptide Sequence Number=SeqID_138087
atggaatgtggaaatgctcatttccactgcagagccagaaattcaagtcacatcaataatcatagagaagaggggactcgccagtgggactggcgagttggacacgtggcgacgcctgatggactcgcgagttactgtccacgtggcaggccttcaatccttgtgtacccagaacaaattattcaaccatttagcataattttggcaggatcacaacttagatcttgtagttttttcatcaaaaacaatcatcaccttcccaataactttcctatctttgatggcagaaaaggcgaggtaggcctgcaaagataa

SEQ ID NO: 46403 - DNA, 411 bp, Glycine max
  Peptide Sequence Number=SeqID_138088
atgtctggaaaggcgaagaggagagacgacgacgatgcttccgacgccgactccgaaggccacgcgccgcccatgaagtccctcaagaaggattccgacgacgatcccgactctgttaccatttgcgaaatttcgaagaacaggagggttgccgtgaggaactggaaaggcagcattatggttgacattcgcgagttttacgtcaaagatggcaagcaattgcctggcaggaaaggttggaatagtaagggttttaggtcagatcttttcaatgctatgaatgttattttgctgattgtgttgaaagagctgcagtttctactcccttgttggcttgttgctaggttaggcactattgataaggttctcacatcattgaaggttgagggatacgcacgttttctgtactag

SEQ ID NO: 46404 - DNA, 1317 bp, Glycine max
  Peptide Sequence Number=SeqID_138089
atggaattggaagccaccgccgctacttccccaccttctcgcgttctcctcatctccgcagctgggaatgttgtgtgttcgtggggtcgcggagaggacggacagttaggccatggtgacaccgatgataggcccttacccacgcagctcagtgcattggatgcccaacacattgattctattgcctgtggagctgatcatacccttgcgtattccgaatcacgcaatgaactctatagttggggatggggtgattttggaaggttgggtcatggcaattctagtgatttgctcattcctcagcctattatagcattgcaaggtctaaggataaagcaaattgcctgtggggatagccactgtttggcagttaccatggaaggcgaggttcagagttgggggaggaatcaaaatggtcaacttggacttggcaacacagaggattctcttgtgccacaaaagattcaagcgtttaaggtacccgtttcaaagacattcatcaagggagttcctatcaaaatggttgctgcaggtgcagaacacagtgtagctattactgaaaatggagaactgtatggatggggttggggccgatatggaaatttggggttgggagatagaaatgatcgctggaatcctgagaaagtttcttctgttgattgtgacaagatggtcatggttgcttgtggttggcggcatacaatttctgtttcatcttctggtggcatatacacatacgggtggagcaaatatggccagctaggacatggaaattttgaggattctcttgtgcctcagaagcttcaagccttgagtgataagttaatctctcaggtatcaggtggttggaggcatagtatggcactcacgtctactggactactatttggatggggttggaataaggttggagtcggtgacaatcttgatcactgctctcctgtgcaagtgaagttcccccaagatcagagagtagttcagatctcatgtgggtggaggcacacaattgctgtaactgaaaaggaaaatgtattttcttggggaagaggcacaaatgggcaacttgggcatggggataccattgaccggaattctccaaagattattgaggcattgagtgtggatggatctgctgggccgcacatagaatcctcaaacactgatctattgtcaggtgggaaaagtggcgtctccttatctgagagatatgcagttgtgccggacgaaactgtctcaggacaaactgctagttcaagcagtggagataggcttgaaattagtgtcccagaaagtgatgtcaaacggctccgtgtttga

SEQ ID NO: 46405 - DNA, 135 bp, Glycine max
  Peptide Sequence Number=SeqID_138090
atggcgttacttggacaaactgaactgcttgaggatcctgctatcactagtgctatagatgaagagactgaatttaatgcattggtggaggaagaagctgcgctccttgattcactgtggtttgtgtggtcttga

SEQ ID NO: 46406 - DNA, 207 bp, Glycine max
  Peptide Sequence Number=SeqID_138091
atggagaagtgggtggctttggtgttgctgttggtgttttggaaaataagggaaggttttggcgttaaagctgaggaggtgacatacgatggaaggtctctcattattgatggccaaagaaaaattctgttctccggtttaattcattatcctcgcagcactcctcagtgtttgaaagattggttcttgtgtctgaacaatgcataa

SEQ ID NO: 46407 - DNA, 2469 bp, Glycine max
  Peptide Sequence Number=SeqID_138092
atgaaactgtgtttacttttggtgttgttgttggtcacattcacagtggccttatctgggaatgtcagctacgacggtcgctcgcttctcattgatggccaacgcaagcttcttatctctgcttccattcattacccacgcagcgttcccgcgatgtggcctggtctcgttcaaacagccaaggaaggaggggtggatgtgattgaaacctatgttttttggaatggccatgagctttctccaggcaactattactttggaggaaggtttgatctagtcaagtttgcgaagactgttcagcaggctgggatgtacttgattcttcgaataggcccatttgttgctgcagaatggaattttggtggtgtaccggtatggctgcattatgttccaggcacggtattccggacttacaatcagccttttatgatagaaaatgaatatgggtactatgaaaatttttataaggaggatggtaagaaatatgccttgtgggctgcaaagatggctgtttctcaaaatacaggtgtcccttggataatgtgccaacaatgggatgctccagatcctgtgattgatacatgcaattcattctactgtgaccaatttacacctacttctccaaacaggcccaaaatttggactgagaactggcctggatggtttaaaacttttgggggaagagatcctcacaggccagcagaagatgttgcattttctgttgctcgtttcttccagaaaggaacaaattttgggcgtacagcaggtggtccattcattactacaagttatgactatgatgccccagtagatgagtatgggttacctagacttccaaaatggggacatcttaaggaacttcacagagctatcaagttatgtgagcacgtattgcttaatggtaaatcagttaatatctcccttggtccttctgtggagaattttcatgactggctgtttgtagttcagttcaaggaagtaaattttagctttgtaatagtgtcaactgttggagggcgagtcctggctgcgtacaacatccctcccccataccttcgcatagcgaagagcctctggacaatggggtacgaagctgatgtctatactgactcatcaggagcatgtgcggcctttatttctaatgttgatgataaaaatgataagacagtggaatttcgaaatgcatcatatcacttgccagcttggtcagttagcattcttcctgattgcaagaatgtagtattcaacacagctaaggttacttcccagacaaatgtagttgcaatgattcccgagagtttgcagcaatcagataaaggtgtaaattctcttaaatgggacatagtgaaggagaagccaggaatctgggggaaggcagactttgtcaaaagtggttttgttgatctcatcaatactaccaaagataccactgactacctgtggcatacaacaagtatatttgtaagtgagaatgaagagttcttaaagaagggaagcaaaccagtccttctaattgaatccacaggtcatgctctccatgcttttgtgaaccaagaatatcaagcaggaccattttatgacttcataggggcaggactaactagtgtgaagatcaagggactgaaaaatgggacaatagacttgtcttcttatgcctggacttacaagattggagtgcaaggagaatatctaaggttataccagggaaatgggttgaataaagtgaactggacatctacttcagaaccacaaaaaatgcagccattgacatggtacaagtatcttataaaattcttggccttgcaggcaattgtggatgctccgcctggggatgaaccagttggattggatatgttacatatgggaaagggtctagcctggttaaatggagaagaaataggaagatattggcctaggaaaagtgaattcaagagtgaagactgtgtgaaagaatgcgattacagaggcaaatttaatcctgacaaatgtgacactggttgtggagaacctacacagagatggtaccatgttccacgatcttggttcaagccatctggaaatattcttgttctttttgaggagaaaggtggagatccagaaaagattaagtttgtgagacggaaagtatctggagcttgtgcccttgttgctgaggattacccctctgttggactcctttcccagggtgaagataaaatacagaataacaaaaacgttccttttgcccatttgacatgccccagcaacactcgtatatctgctgtgaagtttgctagctttggaaccccctctgggtcatgtggatcttacctcaagggagattgccatgatcccaattctagcacaattgttgagaaggcatgcctaaacaaaaacgactgtgtcataaaattaactgaagagaatttcaaaaccaacttgtgtcctggtttatcaaggaaacttgcagtggaagcagtctgtagttga

SEQ ID NO: 46408 - DNA, 1791 bp, Glycine max
  Peptide Sequence Number=SeqID_138093
atggaattcttgaatggtaagggtgtggtttacacgcccgtgaaggatgtggacttaggcccctatagcaccgagttctacctccaagccaatgtcaaagctccccgcatgactggacttttggtcaagattttcactcatttgttggagtgtccaatacttggaaccttgctactgttcatactgaaaggaaacaatcttattcaccggctcatcacaaatgcagagttcaaagaatcgcctctctttgttcccctacatgattttgaaggcttaaaagaaaaagaagtcaaatgcttagattcttctttatctccaccagagaaagttcaacttgctctagattgcttgcctaaatcttcagaaaaaacactagatggaacaaattcttcattctgtcgctggacaataatggattatgccaaagcttaccgctctggggacataacaccaagcttggttgcagaacgatttattgctgctattgatgaatccacaaaacccccactccaaatggggttctttattcactatagtgctgatgatatattaaaacaagcaactgaatcaactcttcgatatcagagaggggaacctatctccctgctagacggagttcctgttgctatcaaggatgagatagattgtttgccatatcccacaacaggaggtacgacatggctgcacaaagaaaggccttgtagcgatgatgcctgctgcgttaagcgtctaagattatgtggcgccatacttgttgggaaaaccaatatgcatgaactagggtctggaaccagtgggataaatccacattatgggcctgctagaaacccatatgataccaataagattgcaggaggttcttctagtggatctgcttctctcgtgtctgctggactgtgtcctgttgcccttggtgttgatgggggaggatctgtaaggatgccagctgctctttgtggtgttgttggtctaaaaccaacttttgaacgtatacctaatgaaggttatgcagctatcagtggtgagattccatatcataaaaccttcagtgtatcgaccaagataaatcttccacggctgagcttgacaaagtccatatctgacatcaagttagcaaaatacgggaagtggtttgatgattgcagtgatgatgtcagaatatgctgcaccaaaactttgcacatgcttcaggatcattacagttggaagatcatagatgtgaccataccagagatagaagcaatgcgcctggcacattatattacaatcggatctgagtgttccactgcacttgattcttttaaagaaaagaattttgcagaattaggatgggatgtaagggtagcacaaagcatttatggtgctttcagcggcttggagtatcttaaagctcagaaaatgaggaatcgccaattgcaatttcacaagaaaatatttgctgaggcagatgtcattgtctcaccaacaacgggtgtgactgcatatcaaattcaagatgatgccctgcagaccggtgaacttgactacgtgaatggagctgcacttgttcgttattccatagcaggaaactttcttggacttcctgctgtcactgttccggttggattcgatagattgggtttgcctattgggcttcagtttattggaaggccttggtctgaggccacactaatccatttggcatttgcaatgcaggctatctgcatgtcagagtacagaaagcccgagctttactatgatctgctgagaaggaagaatagtagcaatggcatgtcgtttgacgctaaatag

SEQ ID NO: 46409 - DNA, 1623 bp, Glycine max
  Peptide Sequence Number=SeqID_138094
atggacaggaggagttggctatggcgcaggaagtcgtctgagaaaaatccgggtgaaattgagagttcaggctcaatgtcgtctcattctgaaagattttccgatgatctggtatatcccacccaaactactccgtctccagaaggtacgtgtgaggctgcaccaaatgatgaagttaatgatgtgaagactctgacagaaagattatctgctgctcttttaaactctagtgccaaagaagatttggcaaagcagcatgctaaagttgcggaagaagctgtctcaggctgggagaaggctgaaaatgaattattgattcttaaacaacaactcgacactgcaaaacagaaaaactcagttcttgaagaccaagttagtcatcttaatgaggcactcaaggagtgtatgagggatcttcaacaagctaaagaagaacaagagcaaaagattcatgaggctctaacaaataactcttacggcttggaatccaaaaaacccgatcatgagtggaaagttgttgatgctgctaaagcagatgatgctgcttcatcagttcatttggaacttcagcagaggcttggggataaggagaaagagaattcaagtcttaaaatagagctacagtctcaacttgaggaattaaagttcaggaccatagaaagggatttgagtactcaggctgctgaagcagcaagcaagcaacatttggagagtataaagaaggtggctaagctagaagctgagtgccgtagactgaaagctatggctcgcaaaacattatctgctaatgatcacaggtctgtagctgcctcttcagtttatgtagagtcttttactgacagcatgtcagatattggagagaggcaattggtagttgaaagtgatatgcaaaaattaggaggttgggatgtgagtgaaggtgagccaaaccaccatgattcatggccatcggctttaatcaaggaacttgatcaatttaacaatgaaaacaccgctggaaaaaatagtatggtcttttcaaccgagatcaatctgatggatgatttccttgagatggaaaggcttgttgcactgccagatactgaaagtgtaagcagttttcctgtggaacgtactgcatctgaccaactcaatgttggctgtggaacaaagaatgctgaagtggaagctatcgttcaaaagaatgctgcactggagaagaaactagagaaaatggaggcagagaaacttgagctagagatggatctaaccgagtgccaaaagcagcttgaagcatcactgagtaggataaaggaagtggagctggaggtagtagagctccaaactaagttggctcttgcaaacaaatcaaacgaagaagcatacgagaaactaaaagcaactcaagaaaagaaagagatagatgagtcaaaactcagagttgctcacactgaagcagaagaattggtttcaaaaatttgttcattagaggaagagattgagaaagagcgagctttgtccgctgagaatttggccaagtgtggaaagttggaggatgagctcttgaggataaagaatgaagctcaactccaaaaggacactgagattctttatggagaaggtgctaatagtgagttaaagcag

SEQ ID NO: 46410 - DNA, 2163 bp, Glycine max
  Peptide Sequence Number=SeqID_138095
atgatcgcctccacctccacttccaccaatgttgtacctcaccctctgcgctttctgtccaaaccaacctcacattccactacgaggtttctgtctctcacactccactctcggggcatcgctgttgcactttcctcgtccagtagaaccacccccttgaagcccacgtgccacttcaacagcaaagatggaagctttgagctgcatgaggatgaggatgagcgtgatgtgcattgtgaggtccaagtgatttcgtggagggagcgcaaagttaacgcccaaatcacggttgatgctgacactgagtccgtttggaatgctctcactgattatgagcatcttgctgacttcatcccaaatcttgtgtggagtgggagaattccttgtccgtacccaggaaggatatggttagagcaaaggggattccaaagggcaatgtattggcatatagaagctcgtgttgtgttggatcttcgagaagtcatcaattcagcatgggatcgagaacttcacttttccatggttgatggggactttaagaagttcgatggtaaatggtccgtaaaatctggaacaaggtcatcaactgctattttatcttatgaagttgatgtgataccaaggttcaatttcccagctatttttttggaaaggattatcagatccgatcttcctgtgaaccttcgagctttggcatacagagctgaaaggaactttgtgggatatcagaaacttccagtgtcagaaaaccacttgcgcaaaacttatgcggccattaacgggtcatctgttaaaaagataaatggtgcttcgtctgaaagttttaaaaagataaatggtgctttgtgtggaagtgataagttgcctcctgcagagaacaaaaaagaaattgccacctcagtttctggttccatgctcacatcttccagtgaggtgagaagcaactggggtgtatttggaaaagtttgcaggcttgacagacctcggatggtggatgaagttcatctccgcagatttgatggacttctggaaaatggaggtgttcatcgctgtgttgttgcaagcataacagttaaagctcctgttcgtgaagtatggaatattctaactgcctacgagactcttcctgagatagttccaaatttagcaatcagtaaggtggtatcacgagataatagtaaagttcgcattcttcaggaagggtgtaagggtcttctttatatggtgcttcatgctcgtgtagtgctggacttgtgtgaatatttagaacaggagatcagttttgaacaagttgaaggggactttgattcattccggggaaaatggatttttgagcaactaggaaatcatcacacactgctaaagtactctgtggagtcaaaaatgcgcaaagatactttcctttccgaagccataatggaggaggtcatttatgaagatctcccatcaaacttgtctgcaataagagactatattgagaacatgaatgcatcaaaatcttctgaagtttgtgagcagaatacgaattcagggcaacaaattgtttcatcaggctctcaaaaagatgacaactctggttcaactgaggaagttcctcattgcgacgttcgatgttcatctcagcaaagatctaaagtgccaggcttacagaggaatattaaagtactagaatctgaactactgaaattcattgcagaacatggacaggaaggatttatgccaatgaggaagcaactccgtttgcatggaagagtggatattgagaaggctataactcgcatgggtggattcagaaagattgcaaccatattgaacctttctttggcttacaaacaccggaaacctaagggttactgggacaatcttgaaaatttgcaggaagagataagtcggtttcaaaggagctggggcatagacccttcatttatgcccagtagaaagtcatttgaacgtgcagggcgatatgatattgcacgtgcactggaaaagtggggtggactacacgaggtttctcgccttctgtcgctcaagttcagttcaatgattctccaccaggccattcagtattcacctcgtccttctcttggtttctttaacatgcactttgtttgtcctgatgaattattattccattccaacttccctggtggggaggggaaatga

SEQ ID NO: 46411 - DNA, 192 bp, Glycine max
  Peptide Sequence Number=SeqID_138096
atgggagatggtacaatttggcataaagaaggtacagtgaataaatttgaacggaatcgtccctattatatactttataccaatggaatatttgtgatgcaatgtccagaggcattggaaccacgggatgtgaccgaccatcggaccacccactccaccaccttgtacaacttaatatttattctgctttag

SEQ ID NO: 46412 - DNA, 663 bp, Glycine max
  Peptide Sequence Number=SeqID_138097
atgaaaatctcacttttttttcctttgtttttctgctctttcctcatggttgctgcctgggtcttgcagctaactatagcagatatcacagatgagatggagaaaacattacattggttgtcccccatggccactaacacatccaaagcacatcatggctttggttgggtaggggagtgggcaaacacaggctctgaggtaaggaagaccggtgtaatgcggattgagacattccatcatgcagacaaagacaaagtggaatattatattcttgaacttctgttatggcttcatcgcttggccatcagaagtaaggctgtcagtgatgctggcaaagtaaggcctgccatcaagtcccctgttggcgccgctttgcaaaagacaaatgagcaaatatcattgttaacaattgatgagcaaaacatgctgcaggatgtaaataagaaaatacctattagacggatcagtaaaagcttggattttgattgtttaaatattagattcagggagaactgcagattgaccaagagtagaagtcattcatcatgtaaaagcaaggagataacttttaataggattttctccaagcttccagtcattgattttgatattgacaaagaaagagcattgaacgtgatcgacagattggatgtggtcagataa

SEQ ID NO: 46413 - DNA, 315 bp, Glycine max
  Peptide Sequence Number=SeqID_138098
atgccgctcccgacgatgtccttcagcatgacctcgttgcgcgtggcggtgtgctgtcgcgtgaacctcacggaggtggatcgcttcacggttgtggcggtgaaggaggaggacaagggggaggggcggttgtgcgcgcagctggagagcgagcgaaagcgaaacactggtgacgtggcgggcggtgccatggggtggtggtggtcggaggaggaggaggttgaagtgggttggtcggagattcgagctggaacgggttttgtgcggtgttgggagccacaaaaggaattcatggatagggttaggttaggttag

SEQ ID NO: 46414 - DNA, 246 bp, Glycine max
  Peptide Sequence Number=SeqID_138099
atggaggaagcgcaaatttgggctaagaaggtggagctgccagcgttcatggggacagacccaattggttggattgctagggctgaaaaattcttgagccaaaacaacccagatttagattgggcgtcattttccacagctttgatcaaaaggtttagagatcgctatggtaaccatgtctttgaaagattgagtatcttgaagcaagaaaagaaaactgagatggaaacccacatcaaaaaatga

SEQ ID NO: 46415 - DNA, 2148 bp, Glycine max
  Peptide Sequence Number=SeqID_138100
atgcaagagacgctcctcactctctccgaacaccaacaagacgacaacaacaaagacatcgagctgctcgtggttcctccgccgccgtgccgccgccctccgcggatggcgcggcgcgtgtcccccggcgcggtggaaaaagccctccccaacggcgacatctacagcggaagcctctccggcaacgtcccgcacggcaccggaaaatacctctggtcggatgggtgcatgtacgagggcgactggaagaaaggcaaagcgtgcggcaagggccgcttctcgtggccctccggcgcgacctacgagggcgagttcgccgccgggagaatgcacggccgcggcaccttcgtcggcgtcgacggcgacacctaccgcggcgcgtggctctccgaccgcaagcacggcttcggcgagaaacgctacgccaacggcgacgtctacgaagggttctggaggtgcaacctgcaggagggggaagggaggtacacgtggcgcaacggaaacaactacgtcggagagtggaagggtggcgccatctccggcaaaggcgtgttggtgtggaagaacgggaaccgttacgaagggtgctgggagaacggggttccgaaggggagaggggtgtttacgtggcgcgatggaagcacttcctctgggaattgggggaaggagttcgtgaatgagaaacgcgtgtcggtggatgtctgtagtaatcacaacaataataagagtgtgagttttcccaggatttgtatttgggagcttgatggtgaagctggggatattacttgtgatattgtggaggcttctatgatttatggtggtggtggaggagtgtgtgagagtgatgtacagttgcagaagagtccttgtggttctgttgatggggatgttaagaaaccgggtcatactgtttctaaaggccataagaattatgatttgatgcttaatcttcaactgggtattagatactctgttgggaagcacgcttcggttttgcgagatcttaggccgggggattttgatcccaaggagaagttctggactaggtttcctccagaagggtctaagtttacacctccacatcaatctgtggatttcaggtggaaagattactgccctgtggtgttcagacatctaagggaattgtttgggatagatcctgcggattacatgcttgctatttgcggcaatgacacacttagggagatgtcttctcctggcaaaagtggaagcttcttttacctcactcaagacgactggttcattatcaaaaccttgaagaagtcggaagtcaaggtgctcatcaggatgcttccaagttactatcaacatgtgagtcagtacaagaattcgctggtgacaaaattcctgggggttcattgtgtcaaacctattggaggtcagaagtatcggatccataagcggtttgacctcaaaggttcttctcatggtcgtacaactgataaaccccgggaggaaattgacgagactaccactcttaaagaccttgatctttgttttgtcttccgcctggaacattcttggtttcaagagcttaaatggcaacttgatagagactgtgaattcctggaagcagagggaataatggattacagttttttgattggccttcattttcgtgatgatagctcagttgatgaagtaaagagtttaccagacgagttgtgttcaggcaagagagacatgcaaaatgatgacatacaggatatgaagtggatacccatagaccgttcgattatcagcttgagctgttatgtgaattccaacccttcatttcttgatgatggaccattccaagtgattcttgatattccaggggatcctctaattcgtctgggaacaaacatgcctgccagagcagagagagtgtgtaaagctggattggatccgcacactggtactggaagtagcaattctaccccttcagagagtggtggtgaggtctctgatgtaatcctttactttggtataattgacattctccaagattatgatataagcaaaaagctagagcatgcatacaagtcactgcaagtggatccctcctccatctcagccgttgatcccaagctatactccaaaaggtttagggatttcatacacagaatctttgtggaggacaaatga

SEQ ID NO: 46416 - DNA, 3264 bp, Glycine max
  Peptide Sequence Number=SeqID_138101
atgaacactccaattcatgccccttcatcatcaccatcttcttcttcttcctcctacatgcttcgtcctccttcatgcctctctcatccttctcgtaacatcaagtgtcctatgttgttaccacaggcaatttgtacctctcaaaagaagtactggtgcttcagagctcatgtggaggcttcttttaacactaatcccttgaaaaattacacatcagtcagttgctctacatggtggtctgaagcacaatccttagtttcttacaaaacacacaacaaacagttgttcactgtaggatctttagcaacttcaacagctcaagatgtttctgatacaactcttattggtggtgataagattggcgtgttactgttaaaccttggaggtccagagactctagaagatgtgcagccttttttgtttaacctttttgccgacccggccgaggagttgaaaaaatctctttgggaaaagaatgtccctgctaaagtgtatgttggcatgcgttactggcatcctttcactgaagaagctattgagcagggatggaattacaaagcttgttattcttccactctatccacaattttcaatatcaacgagtggctcaagcctacgtctactggagagtatattccggatgagtatctagtcaacatgcagcacacagtaataccctcatggtataaacgtgaaggatacataaaggccatggcaaatttaattgaaaaagagctgaagagttttgactgccccgaggaggtcatgatattctttagtgcacatggggtgcctcttgcttatgtggaagaggctggtgatccatacaaggctgagatggaagaatgtgtggatttgatcatggaagaacttgagacacgaaagataactaatgcttgcacccttgcttatcagagtagagttggaccagtggaatggttaagaccctatacagacgagacaatagttgaacttggaaaaaagggagtgaaaagtctgctcgctgttccaattagcttcgtcagtgagcatattgaaactctagaagaaattgatgttgaatacaaagagttggctctagaatctggtatagaaaagtggggccgtgttcctgctctaggatgcgaacctaccttcatttctgatttggcagatgccgttattgagagtctcccatatgttggtgccatgacagcttcagaccttgaagctcaacaatccctcgttccactgggcagtgtagaagagttattggcagcatatgattcacaacgcagggagttgccaccaccagttatagtgtgggaatggggttggacaaaaagtgctgaaacttggaatggaagagtagctatgcttgctgtgggggtggaattgccactggatgaggaacctccccattctgtttcggccgtggaggtggagatcgggtatggcgggatcacaactggtagagaacgagtatcaacttctcgagatggtgactctattgagagtggtcgtattagtggacggttttgtctctctccaagaaaacccaagcgagggatgtcggtttccgtaatcggcaaggaattagacatacagagattaaagacagggaaggcaccttcggaccaactgttcaggctcctcttcctcctctgcttcttcatggtcaaatcgagtggtggtcattgtagctctgccagcaagaaggagaaaggaagcgcctgttatgtatgtgagtcagagtgcaaaccaaatgtgaaggaatgcgaagaagctaacgccgttgtttcgaaagaacaattctcgggagctcgcacgcttctggttcggcttcaagcgtgcgagctgtcatcgtcatcttcttctcctcctcgtgactcccgatacgttagggtttcggtgtggtgggatttgaggagctgcccggtgcctgatgacgtggaccctttgaaggttgcgccggcaatcaggcaggccgtgagggccaacgggatcaaaggtccaattgccatcaacgctttcgggaatcttagctccctccccgagcaccacctggacacactggcttcaagcggcattcaaatcacccactttcctcaaggttttgctggcttattacaccggataagcttgaataattacaatatcttgctcgctgtctcaacgaatgctcctgttctctccacggaagcaactataacgtggcaatggtataaattgcttaagggagaaaatcttattggaaaacatttcaaccatcctccggatgatccatatggttcttggtatggaaactttagggtgccccttgaaaacccattcccagccaaaactaaaccagattccttaaaaatgagttctaaaggctcatctgatgatgacattgttgggtctgaggatgcgagtcgtaaaagtcaggaaagatacacaacttcaatgaatcgctctgctggaaatgatcagacaacagtggatgacattggtactgcaaactatgaatctggaaattttagagcaagggacaaatgtgtgaatccaactagaaaggaggttgatgatgtttgtcacagcccatatgcttttcaagttgatgactgtctggttgataaaaaaactggtggaagtgatgaaacatataggaaaggtccaacattctttggctggatcagaagctggtggcaattttggaaaggcaatgcaaaatctggtgattcaactgctcatcagaacaaggtggttaatcattttgaggattctaactcatctgaactggtagaccagacagtccagactgttagtgattttgaagataagtcatcagaactggaccagaatgctatttgttctggaaagcctgagttgttttctagcagttccgtttgggatgacatggaatcttttattttcacccgcagaggatcagttattgtttacgagtcaaaaaacagatatgatatgttaaaagattgtgagaaacttgtaagggagatattgagggaacacccagatggttttagaatcagttcttttccaagattttttgttgttaggtatggctatcatcttgatttagaggagcttgttcccaccaaagatggtagcacggaatctccatgggaggaattcggtcccgtttctgtccacaattccaaccagagtaatctggagtcagaattaagtcagaaagccatggaactgcttgcatcaaagtgtcctgattatgatcctatagtctcaggcaattctctggttgacaaggaattgcagttttaa

SEQ ID NO: 46417 - DNA, 78 bp, Glycine max
  Peptide Sequence Number=SeqID_138102
atggaacgtgttgttgttgttgttgtctcctgcggcggcggtggtgtggcaagggatcgaacattctcgatccggtaa

SEQ ID NO: 46418 - DNA, 1857 bp, Glycine max
  Peptide Sequence Number=SeqID_138103
atgagtttgaaaagaggaggtgggagacctgtaactgtggctaacaatgatatgtccaaagggaaaagcatatctgaacctcagccaaaagttgagcagttgactcagggtattgctgatactaagctaaactcagaacaagatgatggtgagtgggaggtatatgcaaggaaatccaagaacaaggctggaagcagtgctgcaaaaccatggggccccccggtccataattctaatcctagggcatgggggaatgctgaaatggttcaaaagccaggcatccggagtcatggtggagttggaagatcttctggaaatccctggcagacaccaaatgctaactttaggagaccagctggcagaggaaatggaaggcctcaattaggaacaagtggatatgaaagcaactatgtgactccaaatcctgtaattcggcctccactcgagcatggctggaactggcaatccagacctggtgcaatgcagtccaatgtaagggatgaaatttcaccagaggaccttcaaaagaattatggtgttgatgatgatggggaggaggaggaatctgatgatttggaagatactgatgatgatctgatgagtgatgacgatgattctgatgctagtcaaaagagtcatgagacacgtaagaaaagcaaatggtataagaagttctttgagattttggatggcttgactgttgaacagataaacgaaccagaaagacagtggcattgtccagcttgccaaggtggtcctggagctattgattggtacagaggactgcagcccttggtgacacatgccaaaacaaagggatcaaaaagggtgaagattcacagggagcttgctatacttttggatgaggaattacgcagaaggggtacttcagtaattccagctggggaagtatttggaaagtggaaaggtttgaaagaagaagaaaaggaccatgagatagtttggcctccaatggttgtcattcagaatacaaagcttgaacaggatgaaaatgataagtggataggtatgggtaaccaagaacttcttgattattttagcacatatgctgctgcaaaagcacggcactcttatggcccacagggtcatcgtgggatgagtgttttgatatttgaagcctcagctagtggctatctagaggcagagcgtctccacaagcattttgcagagcaaggaactgataaagatgcttggttcaatcgccctattttatatctacctggggggaatcgccagctctatggatacatggctacaaaagaagatctggactttttcaacaggcattcccaaggttccatttcctctttcttggacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagagatgtatatgcaagaacaattcttcaaagaccagatcaaaatcattcatgattcaagggatgcaaaggaagaagattttgagaagatgcaacaggaagagcgtgagaaggtgaagcagtcaagtagtactggtcatgtgaatgctgaggaatatagactcaaggtggaagagtatctgaaatttgttgaggtccaagataaagaaatggagaactttgttgctgaaaaggagaaactgttgcatgctcatggcatgggttatgctgcaatgaagcggaggcattgggaggaagaagttcagtatgagcagaagtttgatgaggaactcgccaacctcatggaaaagtactccccgttggagaagttcaatggtatctaa

SEQ ID NO: 46419 - DNA, 423 bp, Glycine max
  Peptide Sequence Number=SeqID_138104
atggatttggaaagtataaacaagttgttggaggaaggagcccaaagcgagagtccatctcattctctctccactttctattatatcttcatcttcttcttaactcatgatttgtctatttttccatcgaagaatggtgggaattcgttgcacggtggtgccaccgctacgctggtggctttagtcggcgcagccgcgattctctctgccggacattcatccgattcgggagtttccgtcgagatcaacgtctcctacttcggtgctgtctacgctcatgaggagattgagatagatgctcgggttctacgtgtaggaaaggctgttgcagttgtgagcgtggagttcagaaagaagaaaactggcaaagtttttgctcagtggcgtcacaccaagtatcttcccattaccagtaaaatctga

SEQ ID NO: 46420 - DNA, 1617 bp, Glycine max
  Peptide Sequence Number=SeqID_138105
atggatctgtggggtgctcatcatcgacttttgttcattggtcggcatgaggaagatggaactcctgatacttctatgggagaggaatcaaacgatgaagaagaaaaaataattaaaactgaacccgtctttgtgcctgaaattaagaaaaggaaacgccttagccttagtcagcttaaagaggtgaaagaggagtcacatgggaagcaaagcagtagcaagcctaagagaaagaagcatgatagtagggatagatggtcagctgagaggtatcaattggctgagcaaaacatgtgggaggtactaaaggctgaaggggcgtcatttgaaaacccaataacccgacctgcactaagattggctgcccgcaaacacattggagatactggacttttagatcacttactgaagcacattgatggtaaagtggcacctggagggactgagagattccgaagatggttcaacaccaatggaatcatggagtattggttggagagtgctgacttggacaaggtgcgccaggaggcaggggtgcaggaccctttctggataccgccatctgcatatagggcagccggtgccccttcccaaaatattgattcttctgatgaattgaaacagcttaaaatagaactgacacaaatgaagaaagatatgcatgagctcattgccaagaaggaagagaaaagtgatattaacatgatggagcacttcatggtgttttgtgttgagttgctatggcaggagacacacaaggaatttgtgaagtggaaatttatgactgaccatcgccttactgaaatcatgacttctttgaaggatgttcagggaaagtatggtgaattgatgatttggaaaactacagttgcgcaacaacttatggaaataactaataaattgaatgatcttcaagcatctagggaatgcaccacttatagtcctccttcagaaaggtggaaagattggatagaaagcaccaacctagacaatattcaggaagatgcatttgctacttggattgggaatccagagctacttaatgttccacaagaggttatacttgaagatcccaacacgaccatgccaacacagccacccagtgaagaactgactaacaagaagagcgatgtgctggagttagtacctgtaaaactagaagatcaaccaaatgtaacccctgattcttctacaactgttaattcgaagtcagaccttgacaactcattgattatgtttcaggagatgtttatggatttatacaaatggaaagagaaaatggaacagcagctgatggaggtatcgaatactgtatatgaatttctacaatatcgttcagcatatcttgtgggtgtcttaccattgttagtttcaaaatatgctattttgttatgtccttgctctctcctgtcgttatgccgaagtgaagtggaaagtggaacaataaaaaagcatttggagaaagaaaaatgcaaagaaattagttcaagcatttgcaccaggaatcagtcgaagcaaaggggaaatgcagcgttgatagaaatccaaattgaaggtgggaactgccaaactctccaccatgttcctactcactgccaaactctccaccttcactaa

SEQ ID NO: 46421 - DNA, 159 bp, Glycine max
  Peptide Sequence Number=SeqID_138106
atggagcatacgcgttcaatgggatgctacaaggtgattcttgattgcagcgtcgagaacaaggcgttctacgagaaacgtggcttccagcagaaatctgttcagatggctgtgttttgcttgaacagtgtaagaattgggacaacttgtataatttga

SEQ ID NO: 46422 - DNA, 327 bp, Glycine max
  Peptide Sequence Number=SeqID_138107
atggtgcaacgacggagaaggaggagcgagcaagtggcgacgacgacgacgactggcggtgttcgtctgatgtttgaaggagcgaatctgaggtgcgcaagtcttcaatggagcctcgaagtgaagaaaatcctaagtggccaagttcctaagtttcaaaacgcaaggccacgtgttgcatccttttttgtttcaagtacaaagctcagattgcatgatgtgtacagaaaagtgtttgaggcaaatctaatgggtgtgtggccactgtctgtcactactcttgttgcgaggttgaatagcagtcttaaggcatgtaaccgagtataa

SEQ ID NO: 46423 - DNA, 180 bp, Glycine max
  Peptide Sequence Number=SeqID_138108
atgaaagaagctccagattctattgtgaaggttgaagtcatacaacattcaaatttctccaagtatgagaaacttatgcaaaagttgtggtcaatgacgacgactagagtactagttgaaggaggtggaggaatgggaagcggcgatttggatgatatagggtgtctcttcgaaatctag

SEQ ID NO: 46424 - DNA, 945 bp, Glycine max
  Peptide Sequence Number=SeqID_138109
atggggcacaaagaaaaatcaaaggaccgaaaagaaaagagattgcaacagatttctcttttgagaaccattccttattctgatcaccagaggtggtggtccaaggaaactgttgctgtggttacaggtggaaacagaggaattgggtttgagatatgtaggcaacttgctggtcatggagtgactgttgtactgacttcaagagatgaaagtgttggtgttgaatcagctaagttcttgcaagaaggtggcctcacagaggtggcttgtaatcaacttgacatattggatccttcatccatcaaccaatttgctcactggttgaaggaaaattatggtggtttagacattctggtaaataacgctggtgttaatttcaatcaagggtccgaaaacaatgttgaaaatgctcgcaacgttattgatacaaattattatggcaccaagagcatgattgaagctatgattccattgatgaagccatccgctgctggtgctcgtattgtaaatgtgagctcacgtttaggtcgattaaatgggaaacgaaatagagtagaaaatgatgctttgagggagcaactaagtgacgatgaatcccttacagaggagcttattgatggaatgatatctaattttctacaacaagtagaagatggaagttggagatcagaagggtggcctcatagtttcactgattactcggtgtcaaaacttgcggttaatgcctatacaaggtttttggcaaggaagttttctgaaaggccagagggtgaaaagatttacattaattgttattgccctggttgggtgaaaactgctctaacaggttattcaggaagtgtcacaattgagcaaggggctgatactgccgtgtggattgcccttgttcctgatcaagcaattactgggaaattttttgcagaaagaagggagattaacttttaa

SEQ ID NO: 46425 - DNA, 228 bp, Glycine max
  Peptide Sequence Number=SeqID_138110
atgttgttcacactcataaacagtattttgaccacatcgaatggatacactggtcacgtgatgacatttgaggttggtgcagtgcttgaggatgcaaattggcaggctccagtgtattgttttgatgagaatgagaaggaaaagaatatccccattttgggatctgctgttcgtggtggttctcttgggagtttgatgagagagatacccactggggaaactatgtaa

SEQ ID NO: 46426 - DNA, 789 bp, Glycine max
  Peptide Sequence Number=SeqID_138111
atggagggaagatcaatatcacattcttctgaaagagaagaggaatatggtttgttcccaatatattctgaaaggtcccagcaagacatgtcagccatggtttctgctctcacacaagtcattggtggctccaatagtgattctcttcatatgcatgaaggccttttaacttcctcacacaacaacacctcaacccagaatactaacgaacaatcccaagtacaacaacaagaacaagggagtgtaagaagaagacactacagaggagtgaggcagcgtccatggggaaagtgggctgcagagattcgcgatccaaagaaagcagcgagggtatggcttggaacattcgaaactgctgaagctgcagctcttgcttatgatgaagctgcactcagattcaaaggaagcaaagcaaagctcaatttccctgaaagggttcaaggcacagctagcgaatttggttacctcacaaatcagcacatgtcatcaagcagcactaattctaaccctgttgctccacacttgactactcaagaaacttattcaccaagtcactttcaatatgcacagcaacaattcatgagtggtgagagtaacagcttcagtaaccaagatatgcttcgtttctatgggggagacaacatgtttgtttcttctcagcaatctgcatcttcgtcttcttctactgcactgtctcagcagcagcaagaagagttgctgaaattttcgatgcaatttggaggttcttctcattctaatcattctgggaattggaggggtggacattga

SEQ ID NO: 46427 - DNA, 897 bp, Glycine max
  Peptide Sequence Number=SeqID_138112
atgcagcttctaagggtactaccgaaaggaaagcttagtgcaggtgtaaaccatggagtaaactactacaacaacctcatcaatgagctcatggctaatggtctgcaaccgtatgtgatcgttttccattgcgacgttccccaagccttaaaggatgagtatggtggttttttaagtcctcacaatgtagatgattttagggactatgctaaactttgcttcaaggaatttggcaatagagtgaaacattggattactttgaatgaaccgaggagtgtgaccaacaataatgttcataggattatcccttcatgggctttatgccatcttattattcttgctgatcctctttttcttttcctcctcacttcggaagggcaggatgaatatgaaaatgacgggtttatagtggatgaggacgaagaggaggatgaagaagaagatagaacagaatctgatgataagccacagaagaaaaagaagagcaaggaaaagagagcaaaaagtttaaggagggataccgaggaagagccctttgggctgtctgatgaggaggagtttgttgggagtggtaaagttgggcgaactactgaggagaagcttaaacacagtttatttggtgatgatgaaggtatgctcagtgcatctcaaaagggtttaatagggattaccttgaattctgactggtatgtgccggtttctaaagagaaatctgatcaagatgttgcatgtaggggccttgacttcatgtttggatgggttaccaacttgaggaaggacattatcgaaggtcacacaggcaagaacttcattgaggagaacagttggaagtatgcattgttggatgagcgacagcgtgaaaaaaaattgatttcctttgttagggaaaaaaactga

SEQ ID NO: 46428 - DNA, 2859 bp, Glycine max
  Peptide Sequence Number=SeqID_138113
atggagaacactgctttgtgtgtactatggtttatactactcttgttggggtgtgtcatttcctcagaatctaagtatataaggtacaacacaacatcgaccattgttcctgggaaactcaacgttcacttggtccctcacactcacgatgatgttggatggttgaagaccattgaccagtactatgttggttccaacaactcaattcagggggcgtgcgttcaaaacgtgctcgattccctggtacctgcattgctggcagacaagaatcgcaagttcatatatgttgagcaggcatttttccagcgatggtggagggaacaaagtgatgctgtccagaacatagtcaaggaactggtcaacactggtcaattggagttcataaatggtggtttttgtatgcatgatgaggctgctacccattacattgacatgattgatcagacaactcttggacatcaatttatcaaagaagaatttggagtgactccgagaatagggtggcagattgatccgtttggacattctgctgtgcaggcctacttgttgggggcagaggttggatttgactctctattctttgcacggattgattaccaagacagagctaagagaaaagatgaaaaaactcttgaagttgtgtggcggggctccaagagccttggttcatcagcacagatattttctggtgcgttccctgagaattatgaacctcccagtaatttctactatgaagtaaatgacgattctcccattgttcaggatgatgtcagtttatttgattacaatgtccctgaaagagtaaatgagtttgtggcagctgcaatatcacaggatggccgtgttcatgccttatactcgactccatcaatatatactgatgcaaaacatgctgccaatgaggcctggccaataaagaccgatgacttctttccgtatgcagatcgtgtaaatgcctactggactgggtattttacaagcaggccagcaatcaaaggttatgtcagattgatgagtggctactacttggcagcgaggcagttggaatattttaaagggaagagtgccttaggtcccaacactgactctttggctgaagctttggctattgctcaacaccatgacgcagtatctggtacagaaaagcagcatgttgctaatgattatgctaaacgactttcaataggttacacagaggctgagaaagttgttgcagtatcacttgcttgcttgacagagggagcaaccaaaacaggttgtaagaacccacagactaaatttcaacaggcaagtagtgattgtccacttctgaacataagttactgtcctgcatcagaagttgattcctcaaatgggaaaaacttggtaattgttgtttacaatcctctaggatggaaaagagaggatatcataaggattcctgttgtcaatgaaaatgttgttcgggattctagtgggaaaaagatccaatcccagctggtgccgatacttgatgattttcttggtttaagaaactaccacactgtggcatacttgggagtgtctccaactgtaaaacccaaatactggcttgctttttcagcagctgttcctccactcggttttagcacttactatgtatcctatgccaaaaaagaagctactatttcagatagagatacagcttaccaatcatggaataagagtgatacaattacagtgggcctaaaaaacttgaaactagtttattctgtgaaggaagggaaacttactaaatatatcaacagcagaagcaaggtcaaagaacctctagagcaggcatataaattttacactgggtatggaaatgatggaacagaaactgctcaggcttctggagcatatatttttcgccctgatggttcaccttctcccatcaaatccaacgggaagtctcctctcacagtttttcggggaccaattgtgcatgaagtgcatcagaagatcagtccatggatataccaggttggacctatacccattgatgatggagatggcaaagaaatcgcaactgaaatcaaaacaaatctagcaagcaacaaaaccttctatactgattccaatggacgtgatttcattgaacgtgttcgagactatagaaaagactggcacttggaagtaaatcaacctgtagctggaaattattaccctatcaaccttgggatttacctgaaagataaaagcaaagagttttctatattggtagatagagctgtggggggctccagcatcatagatgggcaattggagctaatggttcataggaggttacttcaggatgattcccgaggtgttgcagaggcactgaatgaaacagtttgcatccatgataagtgcaccgggttaactgtgctagggaagtactatttcagaattgatcctgtaggagagggtgccagatggcgtcgatcatttggtcaggagatatactcacccttgcttttagccttcacagagagtgaaggtcactggggagattctcatgtcacaaccttctcaggaatagattcctcatacaacttaccagataacgttgccatagtaactctccaggatctgggtgatggaaaagttctccttcggctggcacacttatacgagattgacgaggacaagtatctttcggttaaggcaactgtagaacttaaaaaggtgtttcccaacaagcagataaacaaaataactgaagtgagcttatcagcaaaccaagaaagagatgaaatggagaggaagagattggtttggcaagttaaagggtcacctccagaacctaaggtgtatggagtcaagttcattgccaataaaagtgcattgcttctcccctttactcttgacatctaa

SEQ ID NO: 46429 - DNA, 2178 bp, Glycine max
  Peptide Sequence Number=SeqID_138114
atggtgggtgagagtgctgacagtgttactgctactgttggctcaggaagtagtggtaataagatgccaactttggaggagtatggtaccaatttgaccaagctagcagaagagggaaagttggatcctgttgtgggaaggcagccgcaaattgaacgcgtgactcaaattttaggtcgtcgaaccaaaaataatccttgtcttattggagaacctggtgttgggaagacagcaattgctgaaggtcttgctcagcggattgctaatggtgatgtacctgaaaccatagagggaaaaaaggtcataacccttgacatgggtctgcttgttgccggaactaaatatcgtggtgagtttgaggagaggttgaagaaactgatggaagaaatcaaacaaagtgatgagataatactttttatcgatgaagtgcacactttgattggagcaggagcagcggaaggggcaattgatgctgctaacatactaaagccagctcttgcaagaggtgaactacaggtagtactctcccctgacatgttcaaaatggattttctgcttgctgattctgaccttgaagtcaatataatatgtaaagagggagaaagaatgagtctgtgtattggagccacaacattagacgagtataggaagcacattgaaaaagatcctgctttggagagacgattccagccagttaaagtgccagagccaactgtagatgaaaccatacaaatactgaagggacttagagagcgatatgaaattcaccacaagctccgctatactgatgaggctcttgtagctgctgcacagctgtcgtaccagtatatcagtgatcgatttttgcccgacaaagctatagatttgattgatgaagctggttcacgagtccggcttcaacatgcacagttacctgaagaagcaagagaacttgacaaggaggtcaggcagattattaaggagaaagaagaagccgttcgcaaccaagattttgaaaaggctggagagctacgagatagagagatggatcttaaggcacagatctcaactcttgtagagaaaggcaaggagatgagcaaggcagagagtgaggcaggggatgcaagtcctgttgtgactgaagctgacatacagcatattgtctcatcttggactggtattcctgttgagaaagtctcaacagatgaatcagatcgcctcctcaagatggaagagactttacataagcgggtcattggtcaggatgaagcagttaaagccattagtcgggccatccgtcgagctcgggttggattaaagaaccctaatcgtcctattgccagcttcatcttttctggtccaactggtgtggggaagtctgagttggccaaagcattggctgcatactacttcggctccgaagaagctatgatccggcttgacatgagtgaattcatggaaaggcacactgtctccaaacttattggttcacctcctggatatgttggttacactgaaggtggtcaattgaccgaggcagttcggcgtcgtccttacactgttgtattatttgatgagattgagaaagcccatcctgatgtgttcaacatgatgcttcagatcctggaagatggaagactaacagacagtaagggcagaacggtggatttcaagaacacacttcttataatgacatcaaatgttggaagcagtgtgattgagaaaggaggccgcaaaattggatttgatctggattatgatgagaaggatagcagttataacagaatcaagagcctggtaaccgaggagctaaaacaatacttcaggccagaatttttgaataggttggatgaaatgatagtcttcaggcagctcacaaaactggaggtgaaggagattgctgacataatgctcaaagaggtgtttgaaagactgaaggtgaaagatattgaacttcaagtgacagaaagatttagggacagagtggtggaggaaggttataaccctagttatggagctagacctctgagaagagccataatgcgacttttggaggacagcatggctgagaagatgcttgccagagagatcaaggagggcgactctgttatagtggatgttgattctgacggtaatgtgattgtgctcaatggtagcagcggagcccccgagtccttgccagaggcacttcctgtataa

SEQ ID NO: 46430 - DNA, 327 bp, Glycine max
  Peptide Sequence Number=SeqID_138115
atggattggggaatattgcttgaaaaagatagagctggaaaacacattagtcttcgaaggttcaaagcaagttccgactttcttaaaaccaagagtcggaagcttcagaaccaatggtggagactcaacaggggaatagagaaaaaagaacaacagaaacgaaatcggaggaaaacaagcaccatggtgttagtgggtgcacctagattgtaccagagaggagtagatttgacaaaatgtgaaaagattaacaaagatggccgaagaaggtggtggcacgtggtagctctgatggcgctggagaaaagtgggcttgatcgacgatga

SEQ ID NO: 46431 - DNA, 387 bp, Glycine max
  Peptide Sequence Number=SeqID_138116
atggtagttcagcctaagaataccccacattgtatgtacattgaacgtgccaatactcaagtgcacaacgttggtggcattgtcgtacttgacgaaacagttgtcgagctgcaacacgccgtcgcaggaggtgaagtagaggttgccgagatgggtgaccgcatgcgacaagcagtgagagcaccggtcattggtgaggtcgccgcgacactagaagaggccgtagatgtcgtcagaggaagcggggaaggtgaagttgttgtggttggcaaaggagatggagttgacgagggaggtgaggagcgtgttgacggtgttttcgtaggtaaaacccagcgtgaacttgggctgggagcagatttacacgagaatgataggggttcttag

SEQ ID NO: 46432 - DNA, 678 bp, Glycine max
  Peptide Sequence Number=SeqID_138117
atgagtgaaaatttgatgggaaaagtcaacgctttgggggagcgtctgaaaattggtggggttgaggaggattcaaggcatgctgataaactcgttggggaagctacctctgaggcccttcatgagcctgaatgggctggaattcttcatatctgtgacttcataaatgctgatcaacttaacaccgccgaattggtacgtgtaattaagaaacgggtcgtggccaagagtcctcctagagttcagtacctggcttttgttttgcttgaatcattggtcaagaattgtgacaaggctttcttggaggcatggggagagtcaaccattgagcttcgctatctgcctgtgtatgcagaaacttacaagagtttgaaatcaaggggtattggattccctagccgtgacaacgaaagcttggctcccgtgtttactcctcgttctgctactgcttcagctgatgctgatgtcagtcttgcacatcttatgcagcatgatgatattcatgtgcaaagttttacgtctgaacaaataaaggaaacttttgatgtcgccagaaatagcattgagcttctttctgtcttcttcaacgcagcaggatgtgttaaagagtcgtcaatccctgatgtccatagaatcgttgagactgggataatgaagcagtgcttttctaggccttga

SEQ ID NO: 46433 - DNA, 204 bp, Glycine max
  Peptide Sequence Number=SeqID_138118
atggggatgggtagtgcatcttccattaaacccatgtggaagatggtgacaagtgtacgtgaggatgatgtgaaagaatgccataactctcatcacaattatgcatgccacaatattcacaactgcaaagagaatggaccacgctttagttttccttcattaggaagcgatattttttcacggttttgtatggatgctttttaa

SEQ ID NO: 46434 - DNA, 1599 bp, Glycine max
  Peptide Sequence Number=SeqID_138119
atgggtagtagcgaggatccgaacaacaaaggcgattttccatacgagtccccggcatcgcaaccctttctatcgaaaccctcgtcgtcttcttcggcagtggaagaagaatcggagaccttcctttcctcatcctctttccttctcttcctcctctccaccttcgcctttggcatcttctccatcatccatcgaaacaacaactacccctctctctcctccttcaccttcgaccccaccacctcctcctgcgtcctaaacccttcttctaattcttcctcctccgtctccacgtggctctccctccttcaaacaacatcttcatcgccttcttcgaaattggtgaaggctctcatatggaccctcgtcatcaccttcgtcctcagcgtccccttgtgttgggctctgcttctcttactcaagcattacaccaaacagattgtctacgcttctattccattctttatcgccatccctattttcctcaacgtgtattggttcgtggcctgcaccctcggcgcgtcttgcagcaacgcgttccccctcgcgtaccgggttctcgtgatggtgttcgtgttcttggtgattgggatcattgtgtggatcttggtggttaattggcatcgcgtggagctcaccgtgagcataatcggggttgcttcccacgcgctttcgaggaacatggctttgttcggggtcctcccttgtttgaccgttgggctggtgctgtatttcgtgccaatcgtggttttcatggtgtttgcgaggtttaatgggaagattgtggtgaagaatttgaagcctggatatgcttgtgaatggaaggaggattcttgggtgccagcttattatgctctggctattctcaccacgctgtggtctgcggcagctatggttgaagctcaagtttatgtcatcagtgggactattgctaattggtatttctccaaggaacatcaaactcctaggcgcagtattcgaactcctctcagaaatgcttttggtccttcttctggcacgatatgtttgtcgggattgcttgtctgtgttgttcgaatggtgcgctctgcagttgatagtgcaagacaagaggatactcctgggatagtgaaccttgtgttgcagtgctgtgtaaatgccttactgacggcagttgattttcttaacaagtttaccataaactttgctgcaataactggtgaagcctactgctcttctgcaaggatgacatatgaacttctaagacgcaatcttctctctgctgtttttgtggagaccatctcatctcgcatcctggctggaattgtctttgttttttctgcatcatacacaatagtggcctgtgttatcttaaaagctggtaccaatcttgggtctgattcatattttgtggctgcgatggcatgggtgctactgatagtagtgctgggttacctcgtgcatgtgctagacaatgtaattgacacagtttacatctgctatgcgatagaccgggatagaggagaggtttgtaaacaagatatccatgaagtttacgttcaattacccattagtagaagtctcagacagtctgttactacaagaactctaggtgtgtaa

SEQ ID NO: 46435 - DNA, 411 bp, Glycine max
  Peptide Sequence Number=SeqID_138120
atgactcagtctcccccaaagtttaaaccttcaaattactcattcacttcacttcacttctcgtccaaaatcacgtcgcaccgctcacttttccccacaccgcatcatcgccacccagtcacgtcactcctcgccatcggtcgcctcagagtggactgccgggacccgtgggaacggggacggaaaaaaattcccagcggcagggtttggggatggggaccagggggtagctgggggcggagacggggagccaggaagtactccccgccagggaccaacgaggagatcgacgatttgtacaatgccagggacgtggtgatgaagaggatggtgaaggacgagtacttcaacatggatgataaaaagtgggatgacattgttgaggacgggatcaagcacagtagggtttag

SEQ ID NO: 46436 - DNA, 2286 bp, Glycine max
  Peptide Sequence Number=SeqID_138121
atgctggcagtggtggtggagcaggttcatattgtgtatatgggtgacagaatgagccagagtgagcaacagttagttgaagactctcaccttgacatactattacgtattctcggaagcaaagttgctgctaggaggtccatcctgtatagctataagcatggcttttctggattcgctgcagttttaagtcagcctcaagctaagctcattgcagatttcccaggggttgtccgtgtgattcctaataaaattcttagtcttcacacaacaagaagttgggacttcttgcacgtaaagcaagatatagtaaccggtgctctttctaggggtcaatctggaagaggcaccatcatcggcatcatggacactggtatttggcctgagtcagagagctttagagatgagcacatggacaatcctcctctacattggcgtggtatatgccaggaaggtgaaagctttgaccactcccattgcaacagtaaaattattggtgcacgttggtatattaaaggatatgaagctgaaattggcaaactaaatacaagtgatggggtagagtacttatctcctagagatgcatcaggccatggcactcacacttcatctactgcagccggcgttgcagtagaaaatgcaagctttatgggactagctaaaggattggcaagaggtggtgctccatcagcttggttagccatctacaagatttgttggtctactggaggatgcagctctgctgacattcttgcggcatttgatgacgcgatatttgatggggttgacattctttcagcatctcttggctctgatcctccacttcctacttatgttgaggacgcactagccattggttctttccatgctgtagccaaaggaatttctgtggtatgctctggtggcaattctggtccatatccccaaactgtcataaacactgctccttggcttgttaccgttgctgccagtaccattgatagagaattttcatctaggattatcttgggaaacaatcaaactctacagggtcagagtttatatacagggaaagatttgagcaagttttatcctattgtgtttggagaagacatagcagcttcagattctgatgaagaaagtgcaaggagctgcaattctgggagcctgaattcaaccttagcaaaaggaaaagcaattctgtgtttccagtctcggtcacagaggtcagccacagttgctataagaacagtaacagaagctggaggcgctggtctcatatttgctcagtttccaactaaagatgttgatacatcgtggagtaaaccctgtgtccaagttgactttattacgggaacaactattctatcatacatggaagcaactaggaatcctgtaataaagtttagcaagacaaaaacagttgtggggcgacagttatcacctgaagtggcattcttctcgtcgcggggaccaagttctctgtctccttcggtgttgaagcctgacattgctgctcctggggttaatattctggcggcttggtcacctgcttcctctgcccgtttggtatctgatgctgaaaatgaagatgagacagagttacatccccttaacttcaacattgaatcaggaacttccatggcatgcccccacataactggtattgttgcacttataaagactatccatccaacttggagcccggcagcaattaagtctgcccttgtcacaacagcttctctgaaaaatgaatacaaggaatatatttgggccgagggagcaccacataaacaagctgacccatttgactacggtggtggtcatgttgatcctaacaaagtcacagatcctggtcttgtatatgacatgaaaaactcagactacattcgtttcctctgttctatgggctacaacaacaccgccataagcatattgacagggtttcctaccaaatgccataaatcacacaagttcctcttaaacatgaacctgccttctattaccattccagagctaaagcaacccctcacggtatcaagaacagtcactaatgttggtccagttaaatcaaactacactgctcgtgttgttgctccaattggaatatcagttatagttgagccatcaaccttagcatttagttccaaaagaaagaaaatgaaattcaaggtaactttttcttccaagctacgagttcaaagcagattctcatttggatacctgttatgggaagatgggttgcatgaagtcagaatacccttggcagttcgctctgcagtacatgaattttgtggacaaatataa

SEQ ID NO: 46437 - DNA, 1485 bp, Glycine max
  Peptide Sequence Number=SeqID_138122
atggctttgaaactctcgtcactatctcttcactcctctctccgccaccagcaccctaattcgtcgcattcaaaccatcgcattccccttcgtttctttgcaccttcccttcctcccacttcgtgtctctccggcgcagcctcagtctccacatttcatcgcactctcttcgccgtaaccgttcgcgcatttcaaagccaagacgaaagcaaaagcagtgatgtttttgaagaagaagaaaaagacgaagaaatatcgaggcagggtgagaaaaaggaactcgcgaagcaaagcatatggagtcagataaaggaaattgtgatgtttacaggaccagcaacgggtctttggatttgtggaccgcttatgagtctcatcgatactgcagttattggtcagagaagctcaattgagcttgctgctttaggtcctgctacagttgtttgcgactacatgagctacgtgttcatgtttctatcaattgctacttccaatatggttgctactgcccttgccaagcaggacaaagaagaagtacagcatcacatatctgtcttgctttttattgggttatcttgtggcgttgggatgcttttgttctcaaggctatttggtgcatcactaataactgctttcactgggccaaagaatgcacacgtagtacctgcagctagcaattatgtgaagacgaagattcgaggcttggcatggcctgctttacttgttggatgggttgctcagagtgcaagtcttggtatgaaagattccttgggacccttgaaagctttggctgctgctacagttataaatttcgctggttgtatacttttgtgcacctatttaggctatggaattgtaggggctgcgtgggctacaatggttgcccaagttgttgccgcttacatgatgattcaaaatctaaacatgaagggatataatgcacttgccttctccattcctacagggaaggaaattctgatgatacttgggcttgctgctcctgtttttttgacactgatgtcaaaggttgtctcaatatggggtgaacctctctcccaaactgctcaatcatttatgcctgaattgatatatggagtaaataggagtttgtcaaaggcccgattgcttctaaagtctcttgtgacaattggagctatgcttggattattgttagggattgttggaacatcagtaccttggttatttccctatgtttttactcctgatcggatggtgattcaggagatgcataaggtgctgattccatactttatagcgctggctataacaccccctactcacagcctcgagggaacgttgctggctttgagtagtagattcggtttgctaggctgctggttttccctcgcattatttcaatgggctcggttttcaattgccctccggcgccttctttctcccaagggcattttatactcggaagatacagatcagtataagctgcgaaagctaaggactgcctaa

SEQ ID NO: 46438 - DNA, 1104 bp, Glycine max
  Peptide Sequence Number=SeqID_138123
atgggaagtttgggagcgattctgaagaatccagatgacttttaccctctgctgaagctgaaaatggcggcgagaaacgccgagaagcagatcccgccggagccacattgggcgttctgctacacaatgctccacaaggtttctcgaagtttcgccctcgtcattcagcaactcggcaccgagcttcgcaacgccgtttgcatattttatttggttctgcgagctctcgacaccgttgaggatgatactagcatagaaacagatgtcaaggtgccaatactgatagcctttcaccgtcatatttatgatcgtgattggcacttttcatgtggcacaaaggagtacaaagttctaatggaccagtttcatcatgtttcaactgcttttctggaacttgggaagaactaccaggaagcaattgaggacattaccaaaagaatgggtgctggaatggccaaatttatttgcaaggaggtagaaacaattgatgactatgatgaatattgtcactatgtggcgggacttgttgggctgggtttatcaaagcttttccatgcgtctggttcagaagatctggctccagatgacctttccaattcaatgggcttgtttctacaggatttgaaatatgaggagaactctgttaaggcagtgcaatgcttaaatgacatggtcactaatgctctgatgcatgctgaagattgcttaacatacatggctgctttacgtgacccgcctatatttcgcttttgtgctataccccagataatggcaattggaacacttgcattatgctacaataacattgaggtcttcagaggtgtagttaaaatgaggcgaggtttaactgccaaagtgattgaccgaactacgactatggctgatgtctatggtgctttctttgattttgcttctatgttggagtccaaggttgacaaaaatgatcccaatgcaactaaagcattgagcaggctggaagctatacagaaaacttgcagagaatctggtctcttgagtaaaaggaaatcttacattgtgaaggatgaaagtggatatggctcaaccatgcaactagccatgccttcttgcctttccgaacattga

SEQ ID NO: 46439 - DNA, 267 bp, Glycine max
  Peptide Sequence Number=SeqID_138124
atggtaacaatgataactggggagattgcaaactttgttgcttatatctatgctccggcagttctggttactccccttggtgcactaagtattattgtcaggaacggcttcggaagatgggggtattggggtgtgtatcctgcattgtgggatcaattgttattgtcatccatgcaccacaagagcaaactccgagttctgtccaagaaatatgggatctggccactcaaccaggttggattttatcctgttttaatttacccttga

SEQ ID NO: 46440 - DNA, 1149 bp, Glycine max
  Peptide Sequence Number=SeqID_138125
gctcgtaagaggaaggtattagtccaagcagttgatgaagaaggaaatcctttaccaaacgcaaccatatcttttgtacagaagaggccagggtttccatttggaagttccatgagcagtagcatcctaaacaataagttatatcaggattggttcacctctagattcactgtcaccacatttggaaatgaaatgaagtggtacagcaccgaaaacgtgcaaggcaaggaagactactcggtcgcggatgccatgttgcagtttgcaaagcaacacaacattgctgttcgcggccacaacatattttgggatgatcctcatttccaacctagttgggttccttcactctccccaccccagcttaactctgcagtggaaaagagggtgagatctgttgtgtcaagatataggggccaacttattgcttgggatgttgtgaatgaaaatctgcacttctcattctttgaagataaacttggacaagccttttcaggtaggatcttcaatgaggctcataatattgatggacaaacaactttgttcctgaatgaatataacaccattgaggatagtagagatggtgtttcaagccccgcaaaatatattcagaagcttaagcaaattcaaagttatcctgggaatgcaggattgccaattggaattgggcttgaggctcatttccccgctcagggtattaactttccttatttgagagcttccattgataatcttgctgctactcgtttgccaatttggattacagaactagatgttgcaagccagcctaagcagtcacagtacttcgagcttgctcttagagagttacatggccacccaatggttaggggtcttgtgatgtggacaggcccgtcgccagaaggttgctataggatttgcttggtagataacaatttcaggaacttgcctgcagggaaagttgtggacaaactcctttctgaatggaggttaagcaaattatcaggaatgacagatcaaaatggattctttgaggccaatctttttcatggagactatgaaattgaagtcagtcaccctgttatgaagaattacaccttcacacaacgcctacaagtgactccaacagatgactccaaggaaacaaaacaatttgtacaactttctatgtag

SEQ ID NO: 46441 - DNA, 543 bp, Glycine max
  Peptide Sequence Number=SeqID_138126
atgcaggaaaataaagctgatggaactttcaatttggccaaaatatggttgttgtggcttgccactgcagaccacaatttagaaccctattttaagagaaagcgaagaaaatcagaagaacacaatctggggaaaaaggtcaataatagaaagaacgagtattctaaagtcatgcttcttcaggataagccagtggaattagcttcaaagacgaatttacattcagctctgccctcaagcatggctacatatcctcgcatgtcacaccatatggaccaaagtcaacagatacaatatgatggtatttgtagccctttgaagcaactcatggagcagaatgctcaagctttcaatcaaatcactgccaatttgtctacttacaagttgcaggataatatcgacctcttctgccacacaaggcacaatattaataccattcttaataatatgagtgagatgcctggcattatgagccaaatgccgccactgcaagttaccattaacgaggatcttgcaagtagtattctgcctaatagaacatag

SEQ ID NO: 46442 - DNA, 375 bp, Glycine max
  Peptide Sequence Number=SeqID_138127
atgaatgcttgtgttgagggaaataaacgccagttaccaccatggatgatgcagaaggttggtgcctctgccactgccacccatgtgagtgactctgttgaaactaattcctctaccaaaaaaggagacatcattaaagctaatgcaaccaagaaagatactcacaagagtgaaccttcaaacttaagagccaagtgtgaagttaagggaagaaaaaaattagaccaacaagaaggaaaggttactcaaaagaagagaaaaggtgataagtctaaggatagagataagagatcttctatacaacaacaacaacaacaacaacaacgccttatcccactaggtggggtcggctacatggatcaacttccgccataa

SEQ ID NO: 46443 - DNA, 979 bp, Glycine max
  Peptide Sequence Number=SeqID_138128
gcgacaggatcctgacccatttttaatccgcctttacaaagcttttgatctcgtttcgcttttgattttgccccctaaaaatggtcacataaaccagataatgacgccggagaagcagatattgctggggcttttgcttgcgaagcatgtttcattagaatcagatgcaaacacgagcacaaacacaacaacctctctcacggtggaggatcggaccttgttggtaaaagaggcggtggcacaaggattgaagggggagaggagaattgaagaagaagaagaagaaaggcgaaggagagcattcgaaggcataaacataaagaaattgaagataatgcgaaccctttgcgacgtatgcgagagcgccgctgccattctcttctgcgccgctgatgaggccgctctctgctccgcttgtgaccacaagctacagatccatatgtgtaacaaacttgctagtaggcatgttcgagttggccttgctgaccccactgatgttccacgctgtgacatatgtgaaaatgcacctgctttcttttactgtgagatagatggtagttcgctgtgtctgcaatgtgatatgattgtgcatgttggtggtaaaagaacccatggaagatatcttctattgaggcaaagagctcagtttccaggtgataaacctgcccaaatggaagaactagagctgcaacctatggatcaaaatgaatcgagaagggatgaaagtcagtcactcaagctaaaaacaagagatagtcagcagaatcacagtgtctcaccttttccaaggcaagaaaataatattgatggtcatggaaaaatggataaaaagttaattgatcttaataccaggccactgcggttaaatggatcagcaccaaacaaccaggaacaatgcatggatattttaagaggcaataatcatgaatctgccagtgtgccaccagtagaatccttcaaacaagagtctgagaagtaa

SEQ ID NO: 46444 - DNA, 1986 bp, Glycine max
  Peptide Sequence Number=SeqID_138129
atgattctccaacacgcttctcccatctctcacttccacttctctccactctcctctctctgccccggtaacagtaacaccccattccccttctccagaagaaggcgaaagcgcttattcgccaattccggctcccgcaaattccgcagaaaatgcaccgtccgcttctgcgccgttccctcctccgacaacaaccacccaaactggaacgccgatttcgccaattccgcgcgcagaaccgccacaaccttcgttctcaaacgaatttccaacaacaacaacaacaacaacaacaacaacaacaacgataacgatgttatcgttaccgaattacaagcaccaccgccatcggttcaattaggttcaaacttcaccggtttcagcgaggatcctatcgtggataagctgaggacgcagctaggggtgatacacccgattccctcccctccgattaaccgcaacgtcatcggcctgttcgtcttcttcttcttcgtcggcgtcgtgttcgacaagctgtggacttggcggcggcggcggagcaagaacaacagcggcggcggcgaggacgggcttggcgtgtggccgcaggtgccaacgagcttctcgctgcttctggagaaggatttgcagaggaaggagtcggtggagtgggtgaacatggtgttggggaagctgtggaaggtgtatagaggaggaattgagaactggatcatagggctgcttcagcctgtcattgataatctcaagaagcctgattacgtgcagagggttgaaattaagcagttctcgttaggggatgaacccttgtctgttagaaacgttgagcgcaggacttctcgcagagtcaacgatttgcagtaccagataggccttaggtatacaggtggtgctcgcatgctgttaatgctttctctgaaatttggcatcattccaattgttgtacccgttggtgttcgagattttgacattgatggtgaactttgggtaaaattaaggttaataccaacagagccttgggtgggagctgtttcatgggcttttgtttcactcccaaagatcaagtttgaattgtctctattccgtctgttcaatttaatgggtcaaaggtttttgactaaacttctcactgaagatttacctaaactatttgtacgcccaaagaaaatagttttagatttccaaaagggaaaagctgttggtccagttgctgttggtgttaaatctggagaaacgcaagaaggaaacaaggattctgtgggtgaactatctgttactctggtggatgctcgaaagctttcttatattttttacggcaagacagatccttatgttattcttagccttggaaatcaagttatacgcagcaaaaagaacagtcaaactactgtaattggaccccctggaatgccaatttggaatcaggattttcatatgcttgtttccaaccctagaaagcagaagttattcatccaagtaaaggacgttctaggatttgcagatttgactattggtacaggagaggttgatttaggatctctcaaagacactgttccaacagacagaattgtggttttacaaggaggttggggatttttaggaaagcgctcttctggggagatattacttcggctaacatataaagcatatgtggaggatgaggaagatgataaaactgaggtgtatgccatttatactgacgtttctgatgatgagttgtctgattcagaagtaaatggtactaatgagaaggatgaaagagattctgcgtatgaaacagataaggagtcatttatggatgttttggcagcattaattgttagcgaagaatttcaggggatagtagcatctgaaacagggtttagcaaagttttggatagtggctcaaatgctggacctagagtgtcaaaatctcaagttcccaatgttgaaccaattccttctagttctgataattccgaaggttttggaggtatcattatcttatga

SEQ ID NO: 46445 - DNA, 126 bp, Glycine max
  Peptide Sequence Number=SeqID_138130
atggtgggagagaagaaaaaagaaatcccggtctccgacaacaaccgcgtcccctcctcgccctcctccgatctgagctccatttgcggcggcgagatctcaacggtggttcttcacctcggataa

SEQ ID NO: 46446 - DNA, 243 bp, Glycine max
  Peptide Sequence Number=SeqID_138131
atgggagggaggatgtttgagctaattgggctgactgaggagatgggtgagctaattgggtcggctgaggtgatggttgacttgtctaggctgacacatttgtttgaggagtggcttgattgtgaagatgatggatcacgtgaggagaaagtccatcatttaggaaatcataagtggaggaagttggagtgtgcaactttgagaatgagaattgattttcatcaaataatacgtggcacctaa

SEQ ID NO: 46447 - DNA, 2811 bp, Glycine max
  Peptide Sequence Number=SeqID_138132
atgattcagaacgctgatatgagactcgaatcagggacttgtaatgtgtgctcagctgcttgttcatcttgcatgcatcctaaccgagctctcatggggtcaaaggctgaagaattctctgatgaaaactgtcgcttaggggaggttaatcagtattgtgatgagagtgatagatcttctcttgggagcagagcttgtgaaaggttgaagcatggtgtcagtgaaaccagtcacaagcctagtgtttcttccactcatgattctctatctgaaaatgctgagaacagtcaagccttatcagagaagtatcaggattccaagtgtttagaaagtcttgatgatagcacttcttgtattagtaggaccagtaatgctaatttagcgagcagttgccatcagataaatacagacagaataaatatatcttgtagttcaacttcagttagtcacttagtggcagaaggatctggaaatgggccaactgttgacatatctagtttgtcagaatgttgtatggaaaatgttgattcatcattgaccaaagagagagtacctattattgttcctggtgaaaaatctctggcagataaggaaaacctaaataatggtacagccaaggtttcaattgaaatatgtccaaagtcagaagaagatactgaaaataatgttgatgttgcggaagatgatgatcataaatattcagcccatgatggattgcatgagaaggttgaggagctgattaaatcatctggaagggctgaacctcaatcagaagatgagagtgatgaatcagatgttgttgagcatgatatatatgcatgcatactctcaattattttgaggcctgtggtaaaagtatgtgacatctgtggagatgctggtcgtgaggatctacttgccatatgtagtaggtgcagtgatggtgcagagcacacctattgcatgcgggaaatgcttgagaaggtccctgaaggggactggttatgtgaagaatgcaagtgtgcagaggagactgcaaatcgaaagctagatattgaagaaaaaaaaaatcacaaagttagttcaacttcacaaatttctggcaaaagaccttctcaaagcatggaaatagctacagcagcaaaaaggcaagctcttgaatcaagcacgggatcaccaaaggcatcaagccctaagagaatagtcccactgtcgcgggaatcttcattcaagagcatggataaagaaaagatgaaatctggtcaacagaagatccccatgcataaccacctcggtggcgatgacacagaacttgcccgttctctatcagctggccctcggagtcaaaatgcaaggagtacattgctgaagtctaattcattcaacaacaattccaagccaagagtcaaacttgttgatgaagttgttccccaaaagcagaaaggggttgttgaacatatttctaagaatatggagacacctgctgggatgataagcaaatcaatgtcattcaaattgtcgaatttgggtcgttcaaatgctgttgaatcaaaagtgaaaatgatctcttctaagcctggaacgacacaggatttgaaagcatcaagacatgcaaaagattctgcttcatttgacaggaaatttctgtctaagattgatcgacctgtcatttgttcaaccatggttagttctgttgtttccacatcaaagggtgatccgaagcttacaccacatggcgaaactgctaaaccttctacagttaacaacaatagagagtttaaggtcaaccaagatggaaaattatattcattatcgaagtctatgaataatactagcagtaaaagtccagaacctcaagttagttcagatagaacatcaacaagtgtcgatgaaactcaacaggataagctgcctcgatcacaggatacagctaatcaggttgacaaagccaaagatagttccattgatcatgtgatgtcaggtgttactaatgcttcaaaaagctcattctgtcgtaaatgtaaagattttggccatgctacagaatgttgtacagttagtggtacgcaggaatttggtgccgaatcatcagtcattgccacaagtagttcaaaagaggagatgcatgagggaaatagattgaaagctgcaatccaggcagctttgcttagaaggcctgaaatacacaagaggaaagaagctccggatcaaactaatgagtttcctacatcaagcactggtttgaaacgcgaagtcacttctcaaaagcaagtgttggtttccagtacattgaagaatagtatatctgctgaagaaagcaatatgaagcaggaaatcattgtgaattctacagttgaaacctccaaatgtccatctgccaatgatctgaagcaagttaaattttgtcgaactgatttttgctctcagctgagaaagtcagattctgttggtcccacttctggaaagcctgtagtgagagacttgcccaataatgccatggaaatatcaagtattctttcaaagatgtcagtcattccagaatatgagtacatctggcagggtgtctttaaagtgcatagaaatggaatgcctcctgacttgtatactgggattcaagcacatttatctgcatgtgcttcccctaaggttcatgaggtagtgaagaaatttttacctgaagtttcactaaatgaagtttctcgattgagcatatggccttcacaatttcatcaaggtggtgctaaggaagataatattgctctttacttctttgccaaagacattgaaaggcaaggatatgaatatcactcttttattgacagtaggctttga

SEQ ID NO: 46448 - DNA, 1686 bp, Glycine max
  Peptide Sequence Number=SeqID_138133
atggctccgttcagcggcgatgagacggcaccgtttttcggcttccttggagccgcagctgccctcgtcttctcctgtatgggagctgcctatggcacagcgaagagtggcgttggcgtggcttcgatgggtgtgatgagaccagagctggtgatgaagtctattgtccctgttgttatggctggagttttgggtatttatggccttattattgctgttattatcagtactggcattaatcccaaggccaaatcttattacctctttgatggttatgcacatctctcctctggtcttgcctgtgggctggctggcctctctgctggcatggctattggtattgttggtgatgctggtgttagagccaatgcacagcagccaaagctttttgttggaatgattcttattctcatttttgctgaagctcttgctctctatggtctcattgttggtattatcctgtcttcacgtgctgcaaaagactttcctggaatcaagatagcagaagagccggaatggaaagatagcattcagggctcaacgggggttgtgaatttggctggactgcccataagtacccgatggtctcctgaggttgtagaattgataaacagtgcaccagacgatattcgacctaaagtttttgttagtgctacagctgttggttattatggcaccagtgagacacaagtctttgatgaacaaagtccatcaggaaaggattacttggctgagcataagcataagccacacatcaccaaggtgtacacccataaatacccaaggggtgcaatccacccaacagttacaacccacccaaagggtataaaccacccaatagttacgattcacccaaagggtgcaaggggacatgacccttgggaacagtcacaaccaaccattatgatccgcccaaggggtgcaagggaatgggaatcgacagccctaaaggtaaacggaggtgttagagtggctctaattcgcattggtgttgttcttggtaaagatggtggagcattagctaaaatgatacctatgttcaagttgtttgctggtggacctctaggctctggaacacaatggttctcctggattcatttggaagacattgtcaatttaatatatgaaacgctgtcaaatccatcttacaaaggtgttatcaatggaactgcaccaaatcctgtgcgattggcagaattgtgtgatcagctgggacatgccttgggtcgtccctcatggctaccagtaccagactttgcgctcaaggctgtccttggagaaggtgctactgtggttttagaagggcagaaagtgcttcctactcaagctaagaaggagcagcgtgtagtgaaaaatccacgcagcaactgcgacaccagcgaaaagaaagaaagcacccccaatggtaatagccttatagagggacaaaaaagtactcgaaatgaccccactggtgaccctattcacgctgagcccccaacctcagcgggaaaatctcggatctataaacccaatatgaagaaatatgctctcagcggaaagaaaattcctcacgtaggacaataccgcaccgatgctgagcccagccgcccacgtcagcgtggtccgcgaatggtcctccactgtgaggctcaggcccagagtcaaaagcgagagtctaagcccactaacgctggaaaggaataa

SEQ ID NO: 46449 - DNA, 1131 bp, Glycine max
  Peptide Sequence Number=SeqID_138134
atgagagatatttgtaggaacttccagcgaggcagctgtcaatatggagaaaggtgtagatatttacatgttcagcaacagcgaaaacctaatgttaatgggtttggaggtcagagcagttcttatcaacagcaaaatacaaatccctttggatttggctctggctcacaacaacagcagcagcagaagggtaatccttttggttttggcaagcagaacagctcccagttaaatggtgggcctcattctgagcataaacccaaccaatacaagccttttgaaaacaaatggaatcgacagtcatccaaaccccagcagaacggtgtgaaatctgaaaacaactccaaacaaacagatcatatatgcacagatcctgagaactgtaagcgccagattgcagtagattttgagcaagagaaacctctttggatacttacatgctacagtcattgcaaaggtgctccttgtgacattgttggtgatattagctatgaagaattgcgggcatcagcttatgaggatgctaagcgtgggatgaacttgcaatcaatagttgagaaagagagaaatatactaaattccaagttggttgagtttcagaaactactttctgaaccttaccaaataccaataagttcttctcttggcagtccaacaccccaatctattgtagccaatgccaatgcaaatccgttttcaacatctcaaagtaatggtcctttgtcagtctcaagctttagccaactgagtactccattgaacatgggttttgaaaggccatctgcaccactaacaaacactctgacgaagcctggtttctttggaagtggaggaaactctttggcatccaacaacgcagcaaatctaaacagcagtgctgtctttggtgttcaaagcggcccatattctacaccagtggatttgaacatgtttccaggttcaactcagcaaacattgactgccttcaataactctgatcccactacaatgtttcaaacaacaccagatgtccagttgtcaaatatgtcccaagtggagaaagtgtcagtagatccaagtatttggttaaaagagaaatggaatccgggagagattccagaagaagctcctcctgatacatttgtacggtag

SEQ ID NO: 46450 - DNA, 1491 bp, Glycine max
  Peptide Sequence Number=SeqID_138135
atgtctctgtctcttcttcgtatctactcttccccccaccttctttcctcctctctcttctttccaaccccacctctctcttctttccttcccaaattaccaaatgccccccgcactccccacattgttttatgccaccgtagggacgcctcctcagcttcgaagcagcgagtcccagaagatacagaatacgaacaacccatgaggaccagttacgacgacgacgaagaagaagaagaggaatttcttggctccttagttttgcctgaaagatgggatgtactgggtctcggtcaagccatggtagatttctctggcatggttgatgataatttcctcaagaatttgggattagagaagggaacacggaaagtagtaaatcatgaggaaagaggtagagttttgcaggctatggatgggtgcagctataaagctgcagctggaggatctctttctaataccttagtggccctcgcaaggcttgctagtcgctcccaaaaagttcccgctataaatgtcgcaatgaccggtagtgtagggagtgatctattggggggcttctacagggagaaattacgccgagcaaatgtgcaatttctttctgcaccaatgaaggatgggacaactggaacagttatagtcctcacaactccagatgcccagcgcacaatgcttgcatatcaggttcagtacactacaaatgtcatctttcagcaggatattttaggcattttgaagtttcttttacctttattggctaattctatgagctctataaatagtgtagatgctaacatttctgtactccggtttcagggcacatcttcaactgttaactatgatgcatccttggctagtgcagtttccaagaccaacatacttgttgtcgaaggatatctatttgaacttcctgatacgattaaagcaataaccaaagcatgtgagaaagcacggacaaatggtgccttggttgcaataacagcttcagatgtctcctgcattgagagacactttgatgatttctggtgtcagatcacacacatggaaattattgggaattgtgtggatttagtctttgcaaatggtgatgaggccagagctctttgtaattttgaagcaaaggaaagtgctgcttcagctgcaaggtatctgagccactttgttcctctagcatccgttacagatggtcctacaggctcttacataggtgtaaaaggagaagctgtatatatccctccttctccatgtgttccagttgatacttgtggtgctggggatgcatatgcatctggcatactctatggtcttttaagaggcatatcagatttgagaagcataggctcattagccgctaaggttgctgccactgttgttggacaacagggaactcggcttagaatttcagatgcagtcaaattggctgaatcttttgaatttcaacttgattcctcctcctctgttggcactgatcataatatttccagcgtctaa

SEQ ID NO: 46451 - DNA, 1202 bp, Glycine max
  Peptide Sequence Number=SeqID_138136
atgcactttaattttatagatgattattatagagatggtaaaaaaggggtggttactgagattgaggaattgacgaaaaggaaaggaaagggggagatgtacctgaagaaaccgctatggagtgaaacagggaaagacgatggtggaagtgcaaagacagaagaagaggatcatggtgatggtgcagtgagtgaggtcgtgaagtcactgcagcaacagagagtgtatagagaagtcactcttgcactcagaactggcctcagagacgcgcgtgccgagttctcctttctccgtgttcgcgctctccgttccattctcaagttcctgcgttccgttgcggagtccggttcaaccatcgacctctttaaccaaacccaatccattccccaactccaaggtctcttctgttctcttttgcattctgttaaatatgtgtttgttcattgttcattgctatttgcagtggttccggtcttgtttcatcactcgctcaaagaaagtggggatgatgattacaatgagaagaagatcaagttgacgagtccatccactgatgctgaagttgcgctcgctcttagagtcttggaagggtgttgtttgcttcaccctcagagtacggctctcgcccatcaacacaacgctattcaggttttaatgaatatattatccactcgtggagtgcttgagcaaggtgcatgcttagatgctctaatctcattgatggtggattcatcatccaatcaaatggatgtactgattgatgttcctcttgatgcttatcagatagatttcgagaaatgtagtggtatcatggaagttgctgaccttctaagagacaaacaactggatgaaaatctcagcccaagcatgttactcaaaactgccaaactacctcacaaggataaagagatgactattggactattggttacagtcttacagaacatttatgacacctactggaatgtgatggaaagggccttgttaaaatgtggagagtttttgctgctgctcattggacatgtcaatggaagagatgcacctcctttggcaactatacatgaagatacaaggcgtcttctaggggagaaatcagcctctttgatatgggctgctagtcagttcggctcaacactagatccagagcagagactaacagctcttcagatccaggctcgcagggtccttgaatcattggactt

SEQ ID NO: 46452 - DNA, 577 bp, Glycine max
  Peptide Sequence Number=SeqID_138137
gccaccccctgatcttcgaggagggtcaactgtgcgagcacagccaaaagataaggcagggagacaagtgtggatcacgcgcaccaacatgaccactcttacccagatatggatggcgttgctacttagcaagattctgccaagcgaccacaactccgatctccccctgctgaagtggatcgcaccaacaagacacccagtggacccggagaagtccaacagggccctagggtttccaactctgattgcaggcctctgtcagttctatgaagtgctcgttgcccccagcaaggtcatcaggccccctattaacaaggccttcatcgagaagtactgcacccccaggctggcacagggcgaggctccacaacagcctggggatggccagcagcaggcaacagacgcactgccaccacttctagagtactgggcccgtgatcgacaagtcgtcatcacacatctggctcaagatgttaaagatgcgctactaggaggcagcctaggcgacgcggggctcacaggtgcgtcttccaagagaggaaggcagatggagtcgccaccaatgtttattcgataa

SEQ ID NO: 46453 - DNA, 603 bp, Glycine max
  Peptide Sequence Number=SeqID_138138
atggccccaaggaagcttgcttcaaagagatccaggaaggataaagcggctgaaggaaccagtttcgctcccgaatatgatagtcatcgttttaggagcgctgagcaccagcagcgcttcgaggccatcaagggatggtcatttctccgggagcgacgcgtccagctcagggacgacgagtataccgacttccaggaggagatagttcgccggcggtgggcatcgctggttacccccatggccaagttcgacccagacatagtcctcgagttttgtgccaatgcttggcctacagtggagggttggatcccattcgatgcggatgctctcagccagttcctgggatatcctttagtgctggaggagggccaggagtgcgagtatggccagaggaggaaccaagccgatgggtttgatgaggaggccattgcccaattgctgtgtataccggggcaggattttgcccggactgctgcggggagacgggtgcggatcatgcgcaccaacatgactactctgacccagatatggatgacgttgctgctcagcaacatccagcccagcgaccataattccgacctccccctgccgaagtgtcagctg

SEQ ID NO: 46454 - DNA, 286 bp, Glycine max
  Peptide Sequence Number=SeqID_138139
ggtcgactctagaggatccccgaaggtcggtgttgaggaggttaaagatgcaaatgctcccattcttgtacccactgacgaggaagctgtgggactagcaaaacttgcagataggccggatcatgaggtcgatgatcccctatatctgatgacattgattatcccacaaatatttttgaagccgctgcaggcatctgacttagacaagtatgcgattagggaattccgatgtgtatggattcctcgagccacagttcatccagagatctggacaatcgcagtttga

SEQ ID NO: 46455 - DNA, 434 bp, Glycine max
  Peptide Sequence Number=SeqID_138140
gtgccaatgctgggagaatcggagcaactggggcaaagaagaaggagggagatacccatgccgtcacttcggcgcccgcatgggtcaagctcccgcaggcctctcatggtacacatcagtacgcgcaacatcatgctagcttctcagctcacgccgggaatttctccaatgcagcacccgcgcagcctagagcgcccgcccccatccagaggggggcccccctaagctccggctccaaccacgactcgcccggccggcagtgcccactttggttccagttccaacacgatgagaacctttcccccgaagccaattccagaattcaccccactcccaatgacgtacgaagacctcttgccgtccctcatcgccaaccaaatggctgtgataactcccgggaagatctaccaatcccctttcccaaagtggtatga

SEQ ID NO: 46456 - DNA, 165 bp, Glycine max
  Peptide Sequence Number=SeqID_138141
atgagggttcatatcatttggtatcagagctctgaaattcatgatgcaatcctccctaggaagggaccagtcactaaagccatgagcaagaggctccaaggggattgggctagagttgctgaagaaggccctagggttctcatgagcctcagggtagatttctga

SEQ ID NO: 46457 - DNA, 258 bp, Glycine max
  Peptide Sequence Number=SeqID_138142
gcgaccaaccacagggggcaggtgcagatacatgagtgtctctaccagctcagcattagttatcagagccagggttacactccttttgcatgccctactccagatcagttcaaggctgaggttgcatggcccggagattggcctgaggcccaggcaggggaggcgcccgcagaggctcccagcgacgcggaggaggcccgcatggataaagagatgacagatttactcggtttcttgggagggagtggagccacgtga

SEQ ID NO: 46458 - DNA, 657 bp, Glycine max
  Peptide Sequence Number=SeqID_138143
ggtggacccttgggtactagcaccctctccttcagaggactgcacgtcctcaccttcagagggctgcatgccctcgcgttcggagggctacacgccctcgcctttaaaggactacatgtcctcgccattagaggactgcacgtcctcgccttcagaggattgcacgtccttgcctccagagggcttcacgtcctcaccttcagagggttacacaccctcatcttcagaggactatatgtcttccccttgagaggactacacgtcctcgccttcggagggcaacacgccctcgcctttagagggcaacacgtcctcgccttcggagggcagcacactccctcacctttagagggctacgcggcgccaactgtgcgaatacaaccagagagggaggctatcacgcagctactatgcataccggggcaagatttcacccgtgccgctgcaaagggacgagtgcgaatcatgcgcaccaacatgaccactcttacacagatatggatgacgttgctacttagcaacattccgtccagcgaccgcaataccgatctccccctgcggaaggatcgtgcccacaaggcacctagtggacccgaagcagtccgacagggccctggggctttcagctctggttacgggcttgtgtcagtcctatag

SEQ ID NO: 46459 - DNA, 294 bp, Glycine max
  Peptide Sequence Number=SeqID_138144
atggtgcaagtgtgcacaattaaatttcgaacagcatatccaaatttcatgaaaatccaatggctacaatgcgaagggttttactctaagctcagatgtaatattgaaatacccaacggtgaaaatgctcagaattgggttgcgaacatggtgctcaaatttcacgacgatccaacggtgaatgagcccaagatcgtcgtttttctaagacaggtttggtggactgcaggaaaaagaaagggttttgagaggagaaagggaaaaacaaaaatgaggccaaaaagagccacctga

SEQ ID NO: 46460 - DNA, 497 bp, Glycine max
  Peptide Sequence Number=SeqID_138145
atgactaggggcaatcctgttgatttacaaccctttgatcctaaaatagatagaaaatttcatagattagttaggcatagtgtgcatcttgttcattctgtgcattttgagcattctgagcattctgttgagggtgattctgaatattctgattttgagcatttcactactaattttcatactaagaacatggttcaacctccacctcgtgagaggactcttagggagatggttgcacctgattttacttatgaaagcttgtgcattcaatatcctgatgagggtgttccatatgttctcaagactggactaatacatttgctgcccaagtttcatggtcttgcaggtgaagatcctcataagcatcttaaggagttccatattttttgttacaccatgaagccccctgatgtccaggaagatcatatctttctaaaggcttttccttattctttggagggagtggcaaaacataggttgtactaccttgctcccag

SEQ ID NO: 46461 - DNA, 357 bp, Glycine max
  Peptide Sequence Number=SeqID_138146
atggaagcccgagaaattgtttccttcttggatacaacgtttgggcagcatggcacccaacgcatgttttttaagaaggcgacacggaccctccgtcggtttgctaaagtgaggggatcaaagacgaaacccacggggatgtacatatccccagtggagtcgccaactgtcgcaacctacccttcggcgggagggcgacgcgtgactcgcgggatgcgtgttccacgaaaggaatacgcgcagagtcgccaccaacgtttatttgaggaaaacgtcggaaaaaccggaaaagacgcgatctacgaacttttaagtgacaggttcgggagttgtatttacgcgcggggaaggtattag

SEQ ID NO: 46462 - DNA, 519 bp, Glycine max
  Peptide Sequence Number=SeqID_138147
atgaagggcaccgtgcatgagcctcaagcgaacctaggggcagatcaaaagctctcacccgtcgatggtggacccttgggtactagtaccctcaccttcaaaggactacacgtcctcgccttcagaggactgcacatcctcaccttcagaggactacatgtcctcgccttcagagggcagcacgtcctcacctttagaggactacacgtcctcgccataagaggactatacatcctcacctttagaaggctacacgccctcaccttcagagggctgcacgccctcgccgtcagaggactacacgtccttgcctttagagggattcacgtcctcctcttcagaggactacacgccctcgccttcagaggactacacatcctcgccattagagggctgcacgccctcaccttcagaggactacacgtccttgccattagagggctgcacgccttcacctttagaggactacacgtccttgccatcagagggctgcacgccctcacctttagaggactacac

SEQ ID NO: 46463 - DNA, 447 bp, Glycine max
  Peptide Sequence Number=SeqID_138148
atgactgtcactctgctcttgaagggtggaccttgggtactagttaccctcaccgttgagaggactacacgtcctcgccttgagaggactacgcgtcctcaccatcagagggctgcacgccctcacctcgagaggactacatgtcctcgccttgagagggctacacgccctcaccttggaggactagacgtcctcgccttgagaggactacacgtcctcaccatcagagggctgcacgccctcacctcgagaggactacatgtcctcgccttgagagggctacacgccctcaccttgggtactagttaccctcaccgtcagaggactacacgtcctcgccttgagaggactacacatcctcaccatcagagggctgcacgccctcacctccagaggactacatgtcctcgccttgaaagggctacacgccctcaccttgggtactag

SEQ ID NO: 46464 - DNA, 312 bp, Glycine max
  Peptide Sequence Number=SeqID_138149
atgactggtctccctatgatcttacttagtgagagtgacctgacaaaccccttgtgtgaagcaaagcttcatgatgaatcaagattgattcaaagatgttttgatgatatcaaagatgatgacaatggtgatgagaaaaagctcaaaggaaagttgaagaacacttcaagattcaagaggaaagttgatttcaaggatcaagaatcaagattcaaggatcaagcttccaagaatcaagattcaaggatcaagcttccaagaatcaagatcaagattcaagactcaagattcaagaatcaagagaagacttaa

SEQ ID NO: 46465 - DNA, 309 bp, Glycine max
  Peptide Sequence Number=SeqID_138150
atggtgggttacacaccttcaagttttacggatttggtcttcgccagcgaaaggatcaaagtgggtctgaaaagaggcaaatttaatcatcctgcttggacgaatgagaaaactggggcaaatgaaaaggccataaccccagccaaggttcatcaaccgccatttctccgaggatacgactcgaacgcaacatgcgcatatcatggaggagttctgggacattccattgagcactgtataacctcgaagcgtaagttgcaaagtctaattgatgcgggctggctgaaatttgaaaagaaccgcttgtga

SEQ ID NO: 46466 - DNA, 466 bp, Glycine max
  Peptide Sequence Number=SeqID_138151
ggatcgcgcccataagacgcccagtggacccgaagaagtccaacagggccctggggtttctagctctggtcacgggcctctggagtcctacaaggtgcccgtccccccagcgaggtcatgccatcgtgacataggtaagaatcacacccacaaagacactcagtggacccggagaagtccaatagggccctgtggtttccagctctggttacgggcctctgtagtcctacagggtgcccattccccccggcaaggtcacatcatcatagggatcgcgcctgcaagacacccagtggactcgaagaattctatggagtacctgtcacctccagcaagggcatcaggccccctactaatcgagctttcatcaagaagtactgcatccccaggcaggcgtagggagaaacaccacagcagcctgaggatggccagcagcaggcaacagacgcaccgccataacctctag

SEQ ID NO: 46467 - DNA, 120 bp, Glycine max
  Peptide Sequence Number=SeqID_138152
atgacattaggtgttgaattcaatgtggaaagcttaacatgtagagattggaacacatcatcgaaagtatccaaaaggtgcaagaaagaaaaggactacctatataagcatgaagtttag

SEQ ID NO: 46468 - DNA, 408 bp, Glycine max
  Peptide Sequence Number=SeqID_138153
atgctagaggtagtgtctaatccttggaggtttacagtagggaactggttatgtgactcagatctggttagtcctactggaattgaacgggttctaaccgaaaaggaccttctggctgactcatattcagacctagaggcttctatccttgatgaaaaagaatttttcttattgaaggttatctctacctttccggagttatcatgcttaatatgctctatcgttggaacggctcagggaatagacggtgttgccttatccatacccatctttcgggaagagttacttcatcccatttattttcttgggagagacacgactctagatgcacaagtattcatgaccttgtactggatcctatatattaaggctgctgggattgatccttctttcatgtcaaggccatga

SEQ ID NO: 46469 - DNA, 300 bp, Glycine max
  Peptide Sequence Number=SeqID_138154
atgggtcaacttcaacggcaagccttctgcaaagcctacgctagtgccgactgtgaaatagttggaagaaatcctgggatgcccactgggaggaaggaagccatatcttttctttgggttctatccctccacgacaagagttgccaaggtagtgaaaatctcaacacaagagttggaacgtctaaagcaaaacagaaatggagtagtcggagtaccaaggaagtgtttggaggaaagggcaaaggccttggcaaaatcaaggcgaatgggcttctttttttgacatcttggcgcttttga

SEQ ID NO: 46470 - DNA, 420 bp, Glycine max
  Peptide Sequence Number=SeqID_138155
atggtgcagtcgaatactaatcagaaatctggtcgaaggaatactttcgctcctcctggttcagttccggtcgaaaaatggatgcaccagggacttataaggttcaacaaagggattatggaagtaggtggttcgagtggaacgaagcaaattggcccacaggaggccaataggtactcttataggaacaattacaaaggaaagaatcctatgacgaggacccaatggcgcaggttccagcgtcagaagaaattggcccaacagaatctacaaacgggccagtataaagaagtatctaggaggccggtaaaggagagactcctgcctccagtggatgaagacaagatggaggatgaggatctactggattctgagccagatttcgatgtcatctgtgtggtatcctatcttgccatctga

SEQ ID NO: 46471 - DNA, 415 bp, Glycine max
  Peptide Sequence Number=SeqID_138156
ggggagattggcattgcggtcgctgggcagaatgcacgggtgaaatcttgccccggtatgcatagtagctgtgtgatagcctccctctctggttgtgcttgcacagttggccctcctccaatatcagggggtggcccaggaaccgtgtggatgtcgagcacactgaaaatgaggacacgtagccctcaaaaggtgagggcgtgcagccctctcaaggcgaggaggtgcagtcctctggagatgagggcatgcagccctctgctggcaaggacgtgtagtcctttcaaggtgagggcgtgtagccctctgacggtgagggcgtgcaaccctctgatggtgaggacgtgtagtcctctcaaggcgaggacgtgtagtcctctcaaggcgaggacgtgtagtcctctaaacagtgagg

SEQ ID NO: 46472 - DNA, 657 bp, Glycine max
  Peptide Sequence Number=SeqID_138157
atggtcatttctccgggagcgacgcgtccagctcacgggacgacggagtataccgattttccaggagagatagtttgcccggcgggggggcatcactgggtcatccccatggccaagttcgatccagacatagtcctcgaattttatgccaatgcttgggctacagaggagggcgtgcgagatatgagatgctatcggccagctcctgggatacctttagtgctggaagagggccaggagtgcgagtatggccaaaggaggaaccggtccgatgggttcgatgaggaggccatcgcccagttgctatgtataccggggcaggattttgcccggactgctaccgggagacgggtgcggatcatgcgcaccaacatgaccaccctgactcagatctggatgactttgctgctcagcaacatccagcccagcgaccataattccgacctccccctgccgaagtgtcagctggtgtacgccatcctgacgcggatgagcattcacgtggctcagttaatcgctgatgccatctatatatttgcaggtatggcgcctaccaggcaccctctggacccggataagtccaacagggccctgggttttcccgccttgatcacaggactctgccagtcgttcggagtccctgtcgcacctagcaag

SEQ ID NO: 46473 - DNA, 366 bp, Glycine max
  Peptide Sequence Number=SeqID_138158
atgcaatctcagggattcgcactgtctcttgagcctgagattggtccttcagctgctcgtgtcagcacaaaggagagttgtgttgatccctcagggaacgatccagacacgggtgactcagacaaatatgggttgtacatcgaagaaaatcatcaccgcctggttgccctagaaagactttatgagagattcacaaccgttcacaacattcctttgttgcacgatcaagttaaggttggttttgatgaggttagagatgcaaatgctcctattcctgtacccactgaagaggttaagttagtggggcagacacttaacaccttccttgcttggacgacatatcttgtcaagcgtttatcagaacag

SEQ ID NO: 46474 - DNA, 402 bp, Glycine max
  Peptide Sequence Number=SeqID_138159
atgggtgaagtagaggagatacaagagaagatgaaggtcgacatggaggccatgaaagagcgaatggccacgatgatggccctgatgagcatgaggaagataatggaagccaatgtggttacaattgccgctaccagcactgttgctaaggtgaagcccgatgcccccatctggcctcaaccaaatgaatcatccaaccttagatatgccgacttcgagccttggctcggatatgccactgaagggcaaacaattggtggtataccccttgaaaacacttcggaaggccctcagtatcacccccagatacacctcttgcattccacaacaagtaaaaaccctcatgctatggcaaaaatgggaaagctggatcatctagaggaaaggctcagggcgaattga

SEQ ID NO: 46475 - DNA, 273 bp, Glycine max
  Peptide Sequence Number=SeqID_138160
atgcgtttaccggggaaggagagtctgctgatgaaatcccccataaccttaactgagattttggatgttagcatttcgtttctaaatgaacatttagaggaaacactggggagaatgatgcaagctccattggagcttgtaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 46476 - DNA, 78 bp, Glycine max
  Peptide Sequence Number=SeqID_138161
atggcctacatgtcataccctaatttcgtccgggaacctttgctcgatgacgtgcgaccattctttggtccttgtggg

SEQ ID NO: 46477 - DNA, 197 bp, Glycine max
  Peptide Sequence Number=SeqID_138162
ggatcgtgcccgcaagacacctagtcgacccgaagaaggccaatagggtcttggagttgccagctctaaatacgggtctctatcagttcaagggagtgcctgttgcccccagcagggtcatcaggctccctaccaatcgagctttcatcaagaagtgctgcgcccccagacgggcgcagggcgagacaccacagtag

SEQ ID NO: 46478 - DNA, 762 bp, Glycine max
  misc_feature (56)..(56): n is a, c, g, or t
  Peptide Sequence Number=SeqID_138163
atggcacgcagagacaaattatggtcattctgcacccttttgtcatccagaggcgncgggcccgatgacatgcggagacaaaatttggtcattccgcacccctttgccattcagacacggtcgtgtccgatggcacgcagagacaaattatggtcattctgcacccttttgtcatcaagaggcggcgggcccgatgacatgcggagacaaaatttggtcattccgcacccctttgccattcagacacagtcgtgtccgatggcacgcagagacaaattatggtcattctgcacccttttgtcatccagaggcggcggacccgatgacatgcggagacaaaatttggtcattccgcacccctttgccattcagacacagtcgtgtccgatggcacgcagagacaaattatggtcattctgcacccttttgtcatccagaggcggcgagcccgatgacatgcggagacaaaatttggtcattccgcacccctttgccattcagacacagtcgtgtccgatggaacgcagagacaaattatggtcattctgcacccttttgtcatccagaggcggcggacctgatgacatgcggagacaaaatttggtcattccgcacccctttgccattcagacacagtcgtgtccgatggcacgcagagacaaattatggtcattctgcaccctttgtcaatcacggccaataagcccgttgacacgcggagattttcatcatcttccgcacttacaagatctgttattctga

SEQ ID NO: 46479 - DNA, 690 bp, Glycine max
  Peptide Sequence Number=SeqID_138164
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttccaggtgtcttgaatatctggggactgggggatatggaggggatcatactaatttctacgggtaccgagctcgaattcgtaatcatggtcatagctgtttcctgctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccggctttctcccttcgggaagcgtggcgctttctcatagctcacgctgtaggtatctcagttcggtgtaggtcgttcgctccaagctgggctgtgtgcacgaaccccccggttcagcccgaccggtgcgccttatccgggtactatcgtcttgagtccaacccg

SEQ ID NO: 46480 - DNA, 244 bp, Glycine max
  Peptide Sequence Number=SeqID_138165
atggaaattgaagctaccttaagaaggaacaaagccgagaggagaaggaagttgttgcaagataggactgtagcttccattctagaagaaaaagctcaatcttctgactctacatcatttgattcactatcatcaagggaatcaacgatatacttaccagaagcctttttcatggctgatgaacaccagcaaagggttacccttgaagattattcttgtagctcagtgccacaattctttacaa

SEQ ID NO: 46481 - DNA, 369 bp, Glycine max
  Peptide Sequence Number=SeqID_138166
atggcagagccatcgcagaagagaaagggatcatcctccaccgccgctgccgatgcccatcgccgccacggaccatctgaagcatccaccgcacctattcatccatctttatcatctccaagatcatccacattgttttcttccaatgatcagcatctacggtacctctctcaattttcttctaggatcatattagaccctaagtacctagacgtagagttctttaatgatgaaacatttgattgctatcaagtgtttcaaaattctggccttgttgatttcatgtcattaaaactgccacattatcctgaacttgtaaaggtcttctactgcaatttgaaaattcaggatggcattatttcctctgag

SEQ ID NO: 46482 - DNA, 246 bp, Glycine max
  Peptide Sequence Number=SeqID_138167
atggactcaggaaggttccaagttagtgtaccaggtaacagctaccccagtgtagctggggatgatactgagggccctccaaagggttttgtaggggtataccaccaactgcttgcccttcagtggcatatccgaggcaaggctcgaagtcatctagattgtggtggggaatttcatgtgtctcccccacggtttaagagacacgtgcatgatcagtttggggttgttggctctcaatgggtatag

SEQ ID NO: 46483 - DNA, 698 bp, Glycine max
  misc_feature (117)..(117): n is a, c, g, or t
  Peptide Sequence Number=SeqID_138168
aagtccaagctctcaaaagcgagttaggaaaggcaaaacttgccaaggagaagttcaagttggccgctacacacattcggaaggagtgtgccgggttacgggaagagaatgcaatanccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatagcatggttttgaaagaggagttagttgcctgttcaagatccaaaagaagcttgtctcagcgtttgtgcgagacggagaccaacatgctagctatcatcgccaagtaccaagaagagttaggtctagcagcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgtttgttagccaaggccaaagcgatggcagacacctactccgcccccgaagagattcacgggcttctcggctattggaaaaacaccataactaaacgcgccgcaagggatccctatcgcaccagatccaaatctagaacgatgggtgatcaagaggagacgtag

SEQ ID NO: 46484 - DNA, 321 bp, Glycine max
  Peptide Sequence Number=SeqID_138169
atgtttgtcgaagtactggcgatcaaaattgccattccttgggttatggggtttagccaagctcatgcttttacgaaaaggaaaaaacatgatttacggcacccttaccgaacccgtgctagagttagagtaatgggtgaagtagaggaggtgcaagaacagatgaaggccgacacggaggccttgaaaaagcaaatggccacaatgatgggggccatgatgagcataaaggagataatggaggtcaatgtggctgcaatagccgttatcagcaccattgttgaggtggacctgacctcccatatggcctcaaccaaataa

SEQ ID NO: 46485 - DNA, 228 bp, Glycine max
  Peptide Sequence Number=SeqID_138170
atgactattgcagacaatattaagataactctccctaaggccgatagtgctaaaaagtttatggggttagtgggagagtactctcatatagctgataaatctcttgctaggacattaatgagtacactgactaccatgaagtttgatggttcgtgtactatgcaagaacatgtcattgagatgacaaacattgcaacaagacttaagaccttgttcaatttattttga

SEQ ID NO: 46486 - DNA, 228 bp, Glycine max
  Peptide Sequence Number=SeqID_138171
atgcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaaggtccaactacgagctttttaactgcaacaacttaa

SEQ ID NO: 46487 - DNA, 115 bp, Glycine max
  Peptide Sequence Number=SeqID_138172
atgatgcgtactttcatcaagaaagtatacgcggctatcgcaaccggcgacaaagctgctgcgcagaacgcattcaacgaaatgcaaccaatcgtggaccgtcaggctgctaaag

SEQ ID NO: 46488 - DNA, 1253 bp, Glycine max
  Peptide Sequence Number=SeqID_138173
atggatcagaaaggcctgcgtgcgcagtcgctgaaagagatcaaaggcgtgcagtggatcccggactggggccaggcgcgtatcgaagcgatggtcgctaaccgtccggactggtgcatctcgcgtcagcgcacctggggcgtgccgatggcgctgttcgtccacaaagagagcgagcagctgcacccggatacgctggagctgatggagaaagtggcgcagcgcgtcgagcaggacggtattcaggcatggtgggatctcgatccgcgcgatctgatgggcgatgacgccgaccactacgtcaaagtgccggataccctcgacgtctggtttgactccggatcgaccagcttctcggtggtggatgcgcgtccggaatttgacgggcacgcaccggatatgtatctggaaggctcggatcagcatcgcggctggttcatgtcgtcgctgatgatctccacggcgatgaaaggcaaagcgccttaccgtcaggtactgacccacggcttcaccgtcgacggtcagggccgcaaaatgtcgaaatcaatcggcaacaccgtggcaccgcaggatgtgatggacaagctgggcgcggatattctgcgtctgtgggtggcctcaaccgactactccggtgagatggcagtatctgacgaaatcctgaaacgggccgccgacagctatcgccgtatccgtaacactgcgcgcttcctgctggcgaaccttgctggcttcaacccggcgaccgactgcgtcagtccggaagagatggtagtggtggatcgctgggccgtaggccgtgcgctggcggcgcagcaggatattgtgcagtcgtacgagaactacgatttccacgaagtggtgcagcgtctgatgcacttctgctccatcgagatgggctcgttctatctcgacgtgatcaaagatcgtcagtacaccgcgaagggcgacagcctggcgcgtcgcagctgccagaccgcgctgtggcatatcgctgaagcgctggtgcgctggatggcgccgatcatgtcgttcaccgcggatgagatctggggctatctgcctggcgagcgtccacagtacgtgttcaccgaagagtggtatcagggcctgtttggtctggcgcaggatgaagcgctgaacgatgcgtactgggcagaactgctgaaagtgcgcggtgaagtgaacaaggtgatcgagcaggcgcgcagcgacaaacgcatcggcggcgcactcgaagccaccgtcacgct

SEQ ID NO: 46489 - DNA, 124 bp, Glycine max
  Peptide Sequence Number=SeqID_138174
atggctaccctcaacggcgaggtctcgcaggaacagcttgaatactacgagctgcgggcgaaaggcggcaccgggctcattactgtggaaaatatctgcatcgattttcccttcgcctccaatg

SEQ ID NO: 46490 - DNA, 468 bp, Glycine max
  Peptide Sequence Number=SeqID_138175
atgaccatgagccagcaagtaataattttcgataccactctgcgcgacggcgaacaggcattacaggccagcctgagtgttaaagaaaaactgcagatcgccctggcgctggaacggatgggcgtggatgtaatggaagtcggttttccggtctcttcgccgggtgatttcgaatccgtgcagactattgcccggaccatcaaaaacagccgcgtgtgtggtctggcgcgctgtgtcgagaaagatatcgacgcggcttacgaatcgctgcgcgtggccgacgccttccgtattcacacctttatcgccacttcgccgatgcacatcgccactaaactgcgcagcacgctgccggaagtgattgaacgcgcggtgcacatgattaagcgggcgcgcaactataccgatgacgttgagttctcctgcgaagacggtggccgtacgccgattgacgacctgtgccgcatg

SEQ ID NO: 46491 - DNA, 756 bp, Glycine max
  Peptide Sequence Number=SeqID_138176
atgcgctcttacaatccgacgctgcagggccacaaaggccagatcaagcgcgcgctgcagacgctgctggcggcgcacaagccggtaatttacgtcggcggcggggccattacttctggctgcgaggcggaactgctgcagctggcagagcagctgaatattccggtcaccacctcgctgatggggctgggcgcgttcccgggcacgcatcgtcagtgtgtgggcatgctcggtatgcacggcacctatgaagccaacatgaccatgcacaacgccgatctgatctttggtatcggcgtacgctttgacgaccgcaccaccaacaatctggcgaagtattgcccgaatgccaccgtgatgcacattgacgtcgatccgacctcgatctccaaaaccgtcagcgccgatattccgattgtcggcgatgccagacagacgctgacgcagatgctggagctgctggcgcagagcgaggcgaagcaggagctcgatagcctgcgtgactggtggcagagcattgaaggctggcgcagccgcaaatgcctggaatttgaccgtaacagcgacaaaatcaaaccgcaggcggtgatcgaaaccatttgtcgtctgacgcacggcgaagcgtatgtgacctcggacgtcggccagcaccagatgttcgccgcgctttactatcagttcgataaaccgcgtcgctggatcaactccggcggctcggcaccatgggctttggcctgccggcggcactcggcgtga

SEQ ID NO: 46492 - DNA, 2385 bp, Glycine max
  Peptide Sequence Number=SeqID_138177
atgagcggcgcaggcaaaacgctgaagtcaagaaaacaggaagataaggccagctttgtaagctggcgttttgcgttgctgtgcggctgtattcttctggcgctgggcggattgctgtcgcgcgtggcgtggctgcaggtgatcagcccggataagctggtgaaggaaggcgatttacgttcgctgcgcgtgcaggaagtgcctaccgcgcgcggcatgatcagcgatcgcgccggacggccgctggcggtaagcgtgccggttaacgccatctgggccgatcccaaagagctaaccgagcacggcggcgtcaccgttgatagccgctggaaagcgctgtcggatgcgctgtcgatcccgctggatcagctggcggcgcgcgtcaacgccaatccaaaagggcgctttatttacctcgcccgtcaggttaacccggcgattggcgaatacgtgaaaaagctcaagctgcccggtatttacctgcgtcaggagtcgcgccgctactatccggccggccaggtcactgcccacctgatcggcttcaccaacattgacggccagggcattgaaggcatcgagaagagctttgataaatggctgaccggcgagccgggcgaacgtaccgtgcgcaaagaccgctacgggcgggtgattgaagatatctcctcggtcgatagccgcgccgcgcacaacctgacgctgagcatcgacgagcgcctgcaggcgctggtgtaccgcgaactgaacaatgctgttgccttcaacaaagccgaatcgggcactgcggtgctggtggacgtgaacaccggcgaagtgctggcgatggccaacagcccggcttacaaccccaataatctcagcaacacgccgaaagacgtcatgcgtaaccgcgctattaccgacatcttcgagccaggttccaccgtgaagccaatggtggtgatgaccgcactgcagcgcggcgtggtgaaagagaacagcgttctgaatactgtgccgtatcgcgtcaatggtcatgagatcaaagacgtggcgcgctataacgaattaacccttaccggggttctgcagaagtcgagtaacgtcggggtttcgcgcctcgcgttagcgatgccctcctcagcgctggtagaaacttacgcgcgctttggcctgggtaaaccgaccaatttggggctggtcggggaaagtagtggcttataccctcaaaaacaacggtggtctgacatagagagggccaccttctctttcggctacgggctaatggtaacgccgttacagttagcgcgagtctacgcaaccattggcagctacggcatcaaccgcccgctgtcgattaccaaagttgacccgccggtggcgggcgagcgcgttttcccggaagacctggtgaaaaccgtgatgcacatgatggaaagcgtggcgctgccgggtggcggtggcgttaaagccgccatcaagggctatcgcatcgcgatcaaaaccggtaccgcgaaaaaagtcgggccggacggacgctacgtcaataaatacattgcttacaccgcgggcgttgcgcctgccagtcgcccgcgttttgcgctggtggtggtgatcaacgatccccaggccggtaaatattatggtggtgcggtttctgcaccggtgtttggcgccatcatgggcgatcgtaacctgcgcgacttgctggccccgtgggtgcctggcgcgccggcgcgtccactccgtgacatgacactggacagccgcgctgcggctgctggcgatctgtttatcgccgtggcgggtcatcatgctgatggacgtcgatttattccacaggccatcgcccagggtgtggcggcggtcattgccgaggctgaaggcgaagccagcgatggtgatatccgcgagatgcacggcgtcccggttatctatctggctcagctgccgcagcgcctctccgcgctggccgggcgtttctaccagcagccggctgaaaaattaaagctgattggtgtgaccggcactaacggtaaaaccaccaccacgcagctgattgcgcagtgggccaacctgctgggcgaaaccggtgcggtgatgggcacggtgggcaatggcctgtacggtcagctggtgccgagtgaaaacaccaccggttcggcggtggatgtacagcatattctgcacgacctcgtcgggcagggcgccaccgtggccgccatggaagtctcctcgcatggtctggtgcagcatcgcgtggccgcgctgccgtttgccgccgcggtatttaccaatctgagccgcgatcaccttgattatcacggtgacatgcagggctacgaatcggccaagtggctgctgttctctgagcatcaggtgggcgaggccatcatcaacgcctga

SEQ ID NO: 46493 - DNA, 881 bp, Glycine max
  Peptide Sequence Number=SeqID_138178
atgggaggtagaacaatcagttggttcccccgatggaaggaaggaaaagaaggagtccttttctcatgtggaagatacccaaacattccgttgcaccgacggaagaaatgcatgtctcctttccttgtgagggatttcggcgcacaaaattccaagactatacaaagaatccataaggcatgggaaaccccgttaaagaaagatcaagaacttaggggcattcgtaatggcatcattggtgggtaccatgaatggttgaaagttcatatacgaggtttagattggctcaccaagttaaaagtcgtcagcgaagagagttttgaagcaccggaacaggacgaagaagtccaagctctcaaaagcgagttaggaaaggcgaaacttgccaaggagaagttcaagttggccactacacacattcggaaggagtgtgccgggttacgggaagagaatgcaactaccgcaagagcccttgaacaagagaccaagagggctcgcaaggaagagtatggctggaataaatttcgcggagctctgtggggtagcaatagtgaactcaagctgcgaagggaagagagggaccagtcgcgagcacatagcatggttctgaaagaggagttagttgcctgttcaaggtccaaaagaagcttgtctcagcatttatgcgagacggagaccaacatgctagctatcatcgccaagtaccaagaagagttaggtctagccacgatccacgagcataggatcgcggacgagtatgctcaagtatacgcagaaaaagaggctagaggaagggtgatcgactctttacaccaagaggcaacaatgtggatggatcggtttgctcttaccttgaatgggagtcaagaacttccccgctt

SEQ ID NO: 46494 - DNA, 378 bp, Glycine max
  Peptide Sequence Number=SeqID_138179
atggggacaaatcaaaacggcaaaaggttttatcaagtcaaggttaaaagtctagatgtcactagcctcaaggaattgggacgattgatgggacctttccaaaggcaagccttccgcaaagtgtacgggaagattctagatttgaccgccacggaagtaattacggaagttgtcgtatccctcgcccaatactatgaccagccgttgaggtgtttcacgtttggggacttccaaatggtaccaacgattgaagagtttgaggaaatattaggatgccctcttgaagggagaaaaccgtatcttttctccggctttcttccttccttgagcaagatgcagctgtggttggagattcagcaaaagagttggatcgcatga

SEQ ID NO: 46495 - DNA, 762 bp, Glycine max
  Peptide Sequence Number=SeqID_138180
gcccttcgtgacgttagtataacagagaggtacgcctggggaatggctgctttggttcatatgtacgaccaactgagcgatgcatctatgagccacagtcgacaactttggcagttacatcacactggtgcaggtaacaaatattgctggatttacgagcactttccctcggttgcggagtccaccgctgatcaagactacgacaaggcttctccgcgtgcgtgcaggtggatcgcgacgaagaagaccgtgaagagcattcgcacaccgtcgtacagggagcgcctggaccgactccggatttcagatgtctgttggatcccttatggggagcatcgggagtttggctacacgcagaccattcctgctcctcctgtcgattcatgggtctcgtatgatgatatacacgacatgtggatgtactacgaggatcatatcgtacctgcaggtcacgcattagatcctctgcctcatggtcacgccccgcagtcccgagtcgtccctcaggccccgcagacggatatccctcgcgtgccggagccaggagcatcgtcgacatctgcggaggagcccaaacatgcagtggaagtttgtgatgacattgctgagaggttggagcgtcatctgagtctaggggtggtcacgcctggctcatcgacacatgaggtggtcgaagaatgccttagattggccaggagtgtgatacaggaccatctagtatacgttaggtgtagacgcagacggcgcactgatcaggcgtag

SEQ ID NO: 46496 - DNA, 72 bp, Glycine max
  Peptide Sequence Number=SeqID_138181
cgattctgtggaattcttcatcgttcttcgtcgttcttcaccgttcttcatccgttcttcgttcttcaacgg

SEQ ID NO: 46497 - DNA, 291 bp, Glycine max
  Peptide Sequence Number=SeqID_138182
atggtcattctgcgccttgtgtcaaccaagaggaacgaattcgacaatatcaggatgatgttggttgtcgtgtcttatctttacttcccttttatctccaataaaagacaagtaaagaggggcaaccgtcataccctaatttcatccggggaccatctgtttgttgggatgcgaccctcgtttaaccactttgaggaagtcccaccagaaggcggtgccttctggaggaagcaacctagctcacctgggcgagctgggtggcaagctcctccctcttttacctataaatag

SEQ ID NO: 46498 - DNA, 518 bp, Glycine max
  Peptide Sequence Number=SeqID_138183
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgctgcgccttatccggtaactatcgtcttgagtccaaaccg

SEQ ID NO: 46499 - DNA, 306 bp, Glycine max
  Peptide Sequence Number=SeqID_138184
atggaaggttcccatcaaagcactcactatcctaaggaaaaattgcctaaaattattacacacaaatggaagtttggtaacctattggaggctcccaacacacttccagtgaaagacctttttgttacaaaacttgaaagcaatgaagtgcttcttagtccaatagctcttaaggtggttggcccctttcttcttaactcaaattcttcaagggatggcaccaatcctccttccaattccctatatggcaaccaacaaggaaacaaagagacaagcaataaccaaagaccaaaaaaaatgaaatga

SEQ ID NO: 46500 - DNA, 399 bp, Glycine max
  Peptide Sequence Number=SeqID_138185
atgtgtcctgcaccttcgagtttgggagctatgcgtagtgattgcttagtgcaatttagaggatccattctcaacctttttcggagccccatgaattgcgttttcattcatgtgtcctccaccttcgagtttggagctatgcgtagtgattgcttagtgcaattctccattctcaatctttttcagagccccatgaattgcgttttcgttcatgtgtcctccaccttcgagtttggagctatacgtagtgattgcttagtgcaattctccattctcaccctttttcagagccccatgaattgcgttttcgttcatgtgtcctccaccttcgagtttggagctatgcgtagtgattgcttagtgcaattctccattctcaatcttttcggagccccatga

SEQ ID NO: 46501 - DNA, 443 bp, Glycine max
  Peptide Sequence Number=SeqID_138186
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgaaagctattcaagatgtcaaattcaaaggtatttactattggatgattgttagatctagctactgtagtccttatattatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 46502 - DNA, 159 bp, Glycine max
  Peptide Sequence Number=SeqID_138187
gacttcacactttatgctttggggtcatacaatgctcaatggaatgcccaggggctcctcatgataagcacacgttgcgttcgaatccagaaaaaggagagtgagaagtttaaggtggtcttcgtcattggaagtgcggtagacaggctttgtggttga

SEQ ID NO: 46503 - DNA, 285 bp, Glycine max
  Peptide Sequence Number=SeqID_138188
atgactagaggcaatccatctgacttacaaccctttgatcctaagatagataggacattttatagattagttagacatcatttaataccttttgagcatcctgagtattctgttattggtgattttgagcattattgttttgaacattctgattttgaacattctgagaacatggcacaatctccatcccgtgagaggactttaagggaaatggttgcacctgatttcacctacgaaagcttgtgcatccaataccctgatgaggatgtcccatatgttctttaa

SEQ ID NO: 46504 - DNA, 474 bp, Glycine max
  Peptide Sequence Number=SeqID_138189
atgaccgaccctctcaatgactcaatcttttgctttctcataggggtggacccttcagtactagaacctattgcctttagaggactacacatcctcgccttcagagggctacacaccctcaccttcaaaggactacacgtcctcagcttcaaaggactacacgtcctcgccttcagaggactgcacgtcctcaccttccgagggctgcacgccctcgcctttagaggactacacgtcctcaccttcagagggctgcacgtcctcactttcaaaggactacacgtcctcaccttcagaggactacacatcctcaccttcagagggctacacgccctcaccatcagaggactacacgtcctcgccttcagaggactagacgtcctcccctttaaaggactacacatcctcccctttagaggactacacgtcctctccttcagagggctacacgccctcccctttagaggactacac

SEQ ID NO: 46505 - DNA, 444 bp, Glycine max
  Peptide Sequence Number=SeqID_138190
atggggacaaatcaaaacggcaaaaggttttatcaagtcaaggttaaaggtccagatgtcactagcctcaaggaattgggacgattgatgggacccctccaaaggcaagcacttccgcaaagtgtacggaaagattctagatttgaccgcagcggagagtttgaggaaatactaggatgccctcttgggggaagaaaaccatatcttttctccgagtttcttccctccttgagcaagattgcagctgtggtcgaggattcggcaaaagagttggatcacatgaagcaaactcgcaacggcgtagtaggcctgccacggaaatacttggaaggcaaggcaagggatatggcgaaccaagagaagtggggcccgtttgcggatatactagctttattgatttttgggttgtcctcttttcgaacgtggacggtttggtggacttag

SEQ ID NO: 46506 - DNA, 516 bp, Glycine max
  Peptide Sequence Number=SeqID_138191
atggcttctatcatggaggccatgctaaaactccagaaaactctagaggataatgccacggcaaccgcctccaatgcagttagggaagcggaaccggtgctacagcccgcaataaacttgggccgagatagaaacacaacggtgttcggtcggaggtacagtccacaagcttacccttatggcttgcctccggacttcactccccgttccgctccggaagatgtgagccaagcccctactttcgaggggcaaattcctccttatgccaattatctcctgcaagaagatggcgaaggagatgcccatctaggccctctgcttcccctcaaggatccggccccccatgaattaccccaaccaaacatagtccgccatgtcccgtcttcacccgcacccgtaaaagaatccgttcccttcgcagaagataagggaaagattgattcacttgaggagaggctaagagcggtagagggcctcggcaattacccgttctcggatttagcggacctatgtctg

SEQ ID NO: 46507 - DNA, 828 bp, Glycine max
  Peptide Sequence Number=SeqID_138192
gttccgggcatgatcgagcgctacactgctgccatcactggtgcagaaggcaagatccaccgtctggaagactggggccgccgtcagctggcttacccgatcaacaaactgcacaaagcacactacgttctgatgaatgttgaagctccgcaggaagtgatcgatgagctggaaactaccttccgcttcaacgatgccgttatccgcagcatggttatgcgtaccaagcacgctgttaccgaagcatctccgatggttaaagcgaaagacgagcgccgtgagcgtcgcgatgatttcgcaaacgaaaccgctgatgatgctgaagctggggattctgaagaggctccccttcgaaaggtcagtccatcaggaattcctcactgccagttcgtgcttgagcatcgttctgtgcaggaggaagccggctttcaccggcaggcgtggtgtcaaatgcccgttaaagcgggctacgctcgtaacttcctggttccacagggtaaagctgttcctgctaccaagaaaaacgttgagttcttcgaagcgcgtcgcgctgaactggaagccaaactggctgacgttctggctgctgctaacgcacgtgcagagaaaatcaatgcactgggcaccgttactctcgcgtctaaagcaggcgacgaaggtaaactgttcggttccatcggtacccgcgacatcgctgatgcagttactgcagctggcgtgaagtggcgaagagcgaagttcgcctgccaaacggcgttctgcgcaccaccggtgagcaccaagttgacttccaggttcacagcgaagtattctcgaaaatggttgtga

SEQ ID NO: 46508 - DNA, 90 bp, Glycine max
  Peptide Sequence Number=SeqID_138193
cctccatgtttatatagcaatgtgcgtttctgggctgcaacggcttgtgctggaggagatctatcattcttcctgaaaatctgcagttaa

SEQ ID NO: 46509 - DNA, 832 bp, Glycine max
  Peptide Sequence Number=SeqID_138194
tgctgaccgtttagtgtttgctgcatctatcctgtgtcgcctgacgggcgtgccacctctcgtcatcgggatgaccgttgtcagcgttggaacatcacttcctgaaatcatcgtctctgtctcggcatcgctgcatggccagttagacctggccgtcggcaccgcgattggctctaatatcgtcaatatattgttgattttagggctggcggcactgctccatccatttcgcgtgcattctgatgttctgcgtcgtgaattgccgctaatgttaatcccccgtctgctggcaggatgcgtattttatgatggcatactgagcgggcacgatagcctcacgcgtgagcaggtcgccgaactcccgcgggaaggcacgctccccgtcgccctgctctggcttggcgtggcgctgatcatcatgccgatggccacgcgcatggtcgtagataacgcgacggtcgtggcaaactatttcgccatcagcgaattgaccattggcctgacggttattgctatcggtaccagtctgccagagctggccacggccattgccggggcgcggaaaggagaggatgacattgccattggtaatatcatcggctccaatatttttaatatcgcgatacgtgatatttgctctgctctgctggcggcggcaacgacagattggcaaaggcgcaggcgcgctgttgacgggtggatttatcgtatggatggcgatgctgtactggctctcgcctcttctctctggaaagcaggcaaagacgttctggagattgaacgtgaaggtctggcgcagttggatcagtacattaatcaggggatcctctag

SEQ ID NO: 46510 - DNA, 419 bp, Glycine max
  misc_feature (415)..(415): n is a, c, g, or t
  Peptide Sequence Number=SeqID_138195
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgcatgcaagcttggcactggccgtcgttttacaacgtcgtgactgggaaaaccctggcgttacccaacttaatcgccttgcagctaatccccctttcgccagctggcgtaatagcgaagaggcccgcaccgatcgcccttcccaacagttgcgcagnctga

SEQ ID NO: 46511 - DNA, 393 bp, Glycine max
  Peptide Sequence Number=SeqID_138196
atgagtgaaatagaggaggtgcaagagcagatgaaggaggtcaatgcggctacagttgttctgcaaaacaagcattccttcccaccatatggcttgcctcccaactatacaccacccaatgttgcgcacactcccgatgagaatgtcgataactccgaacccatgcccattgaaagccaacaaccccaatctgatcatgcacatgtctctcaacctatgggggagacacatgaagcaccccgagaccacaatctagtcgacttcgagcttcacgtcggatatgccgctgaggggcaggcgttttgcagtgtacccctgccaaacactttgggggcccctcagtatctcccacagccacaagccttgcaaagtccttgcttttatctttcatag

SEQ ID NO: 46512 - DNA, 357 bp, Glycine max
  Peptide Sequence Number=SeqID_138197
atggggtgcccgttccccccagcaagttcatgtcgtcgtggcatagggattgtgcccgcaagacagggtcttggagttgctagctctaaatacgggtctctgtcagttctagggagtgcctgtcacccccagcaaggtcatcaggcccccctaccaattgagctttcatcaagaaatattgcgcccccaggcaggcgcagcgtgaacaccacatcagcattgggatggccggtagcgggcaatagacacaccgccaccacctctagagttcacgctaagctcatccataaaaaggtaagagcgttgcctacgacacatggccgagccataggcgaccaactccaaagccaaaggtaa

SEQ ID NO: 46513 - DNA, 50 bp, Glycine max
  Peptide Sequence Number=SeqID_138198
atggggacatacaatgcattacagacgtatgattattacgcttcaaccgg

SEQ ID NO: 46514 - DNA, 123 bp, Glycine max
  Peptide Sequence Number=SeqID_138199
atggaggaggcacgaggaggagctttgactgcgcaacaatactggttttgtaggagtaataagccttctagtaatcgatttcaggatgttgtaatcgattacaggctgcctgttcttgtgtaa

SEQ ID NO: 46515 - DNA, 405 bp, Glycine max
  Peptide Sequence Number=SeqID_138200
atggatacctcagagccctacaatggggcaatgaaaggtactagtaccctcaccttcagagggctacacgccctaaccttcagaggactacacgtcctcgccatcagaggactacacgtcctcgccttcagaggactacacatcctcaccttcagagggctacacaccctctccttcaaaggactacacgtcctcgtcttcagagggctgcacaccctagccttcagaggactacacatcctcgcctttagagggctgcatgccctcgcctttagaggactacacgtcctccctttcatagggctacacgccctcaccttcagaggactacacgtcctcaccttcatagggctacaaaacctcaccttcatagggctacacgccgtcaccttcagaggactacac

SEQ ID NO: 46516 - DNA, 361 bp, Glycine max
  Peptide Sequence Number=SeqID_138201
aaggacaatcgaggagggccaattggtgcaaaatggaacgccgttggttaatattgtccgtgacgaacagaaatggataacagcaaattataccgaaagtcagctaaaaagtattagcttaggaacaaaggtcaagattgaaattgatgcattggcaggaaagacctttgaaggtgaggtagccgctatatccgaagctaccggctccaaatattctgctgtaccagtggacaactccacgggaaactttgtcaaagtacaacagcgaatcccggtcagaattaattttacggcatccaatacgcctaaagacctcgccatgcttcgcgtcggtatgaatgccatcattcgtgttcaataa

SEQ ID NO: 46517 - DNA, 273 bp, Glycine max
  Peptide Sequence Number=SeqID_138202
atgcagaactatcaacatgcaaagagatgtgattctgcaaaagcgaggaccaacagaaaacgtgttatgcagcagaagcgacatgatcatgctcagtcatcttcacaaccaacagttaattgcacttcagaatataatagttcagtctctaattttatgactcccttcgaggattgtcaatctccaactaatcagcctgtaatcaacactgaaggtaatgactataattctgatttccagtttcagatgctactctacatgttcttaagttaa

SEQ ID NO: 46518 - DNA, 396 bp, Glycine max
  Peptide Sequence Number=SeqID_138203
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaagggagaaaataccgcatcaggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 46519 - DNA, 418 bp, Glycine max
  Peptide Sequence Number=SeqID_138204
gataaggtttctgcttcgagcagctctcgggcattgattgaggaagtagcccaaccttttttcatctacgcaaagaggaattacttcttattttattcgaccggaaatggtgcatctagatcgattcctaaggctggtaatgccgaatcaaggataaggcaatacaaaaagagacaaagaaagacctctcaaaagccggtgcttaggcagacccagctgggaagtaaactaggttttgctattccttctcgagcttctatttcatcccttaaaggagattcgggaaaagatagaataggaagacgtgtttccagaacaaacaagatacgggttgagagggggaagttagcaaagttagacaagattggaatgggcataggaacatgtattgatgtaccagatcggctaatgctcccag

SEQ ID NO: 46520 - DNA, 657 bp, Glycine max
  Peptide Sequence Number=SeqID_138205
atgtcttggagaggacacaatacttctcaatgccccaccacaaaaaccatgattatgaggagccaagacatttatagtaaccaagatgaggctactatgtcaccttcctctagtgaaagtgaagaagcaaaaggggaagaatctagtgaagaaatctaccatcatgaagaaggacaacctttaatggttaaggaggagtgtaaggaggtaagtgtctcctccaagaggttagttaagaaggaaagtcattttgaaataaagacaaatattaaagaaacttcccctcttagacaacctccacatcttctccgttgtaaaaagacacttgttagcactgccacacctcttgggcttgaggttattcctcaagtaaaggagttgttggatgaaggtattattaggcaccaaatccctacaataagtgatatgatgaatttgttgagtgttgcaaccctcttttgtaaaatcagtcatgcacccaacgtcttcatgattcatgtacatagggactcattaggcaggaataatcaacataaaaatatagaaaaaggtgtcgagggaaggagaccaaagtatgaagaacctcgggatttgaggtcaaatcctttccaaggtggaggggatgatgcaatcctacccccaagggtacttggatag

SEQ ID NO: 46521 - DNA, 228 bp, Glycine max
  Peptide Sequence Number=SeqID_138206
atgtgggtgcaagccattggtttgtttgctcaagcgacatgcgctcctgagtttggacttaaaagatcgttcagtcagaaaatactcgtgctacacatttgtcgcttctttcattcttccttgctacaaggttgtgaaaacaagacaacgattgatacctcaaagccctacactggagcaatgaaaggcaccatgcataaacctcaagcgaacctagcggcagattag

SEQ ID NO: 46522 - DNA, 411 bp, Glycine max
  Peptide Sequence Number=SeqID_138207
atggttgtcatcatcaaaaagggggagaatgatggtattatttcttctgaggtgcatggtgtttctatgatcattgatcaatctctattcttttcattaactaaattacccagtcaaggtgcaccttttgagggcaccattgttgatgactggaaattcgattattctagtcatgatgctcgatgtatggtttgtgatgaccaggctgaaatgaccggtagattgctgaccggatcattaacctttgattgtcccgtaatgcactatattattgttagaattttgcttccctgttcttcaaatttggctcaagcctctgatgaggacttgattttgatgtgggctttccttactggtcgtcagatcgactgggctcacttggttgggtaccgaatgcataaggcattatag

SEQ ID NO: 46523 - DNA, 1050 bp, Glycine max
  Peptide Sequence Number=SeqID_138208
atggagccggctatagcgaagggcctctataataatgtaaaaggctacaatttgaagtcttttgatgaaaggatcataccagagcctattttagatgagttcttaaaaattggactcatttctccagaagatgtcacgaatgcagctgggtacgcgaaagctaatatcatattctattttaaaaatagagaagtaggtgatatcgctaaaccactaaataaacagtctattcccttaacgtttgatgatggtagtcctatttctaagtcagagatatatgctagtgtgtttagtagtatatttaaattaattgatatttatgacggttttggggttgttagaatagctattcgagcacattttgaagaaaatatccccggccctcttcaacctttaaaagaggagttgctagaggaggctctctctgaatgcattaagccatcttctggagaaatcgatatcagtaatttacctgttaaaagtcttagttctacttctcgaaagtaccctaagaatataaccgttccaaggaaatcgggcaatatatccctgaggccgttcttggtggccgatactgagaccataattaacaaaaatagtcaacatgtaccctatgcggtcggtgtcatggttgttaatccggggattcccgttagtaggcgtgaaaggatcgatacttacttcagcgaagattactcttcaagagtcttcccaacctttgaagaaaggagctgccaaatgctcaaatcatttatctttagggtcgcggctattactcgacaaaataggtctgctaaaacaatctactttcataatttaggtcgattcgatggcatttttctacttaagcaccttgcattatatcatcctaattacacggtcaccccccttatgagagacaatagactctacgaggtagctgtctattctaaaaaaaggctattatttacgttccgagactccttacatctactccccggcaaactagatgaccttgctaagaatctatgccctgagttgggttctaaaggatctatttcctatgaggat

SEQ ID NO: 46524 - DNA, 999 bp, Glycine max
  Peptide Sequence Number=SeqID_138209
atgcggtcggtgtcatggttgttaatccggggattcccgttagtaggcgtgaaaggatcgatacttacttcagcgaagattactcttcaagagtcttcccaacctttgaagaaaggagctgccaaatgctcaaaatcatttatctttagggtcgcggctattactcgacaaaataggtctgctaaaacaatctactttcataatttaggtcgattcgatggcatttttctacttaagcaccttgcattatatcatcctaattacacggtcaccccccttatgagagacaatagactctacgaggtagctgtctattctaaaaaaaggctattatttacgttccgagactccttacatctactccccggcaaactagatgaccttgctaagaatctatgccctgagttgggttctaaaggatctatttcctatgaggatgtaagacttgaaagtcttagtattatgaaagagagtttgttagagtatatggagcaggatattcttctgctagggggaattatgcagtccttccaggacatatattataaggcttaccaggcagacatagtaaataagcttacaatagcctcactggctctaagtctatttcgtgaaaaatattacgattacaataagcatcgtatccacatccctaatcagaatgaggatacatttattcggcgtggatattacggtgggcataccgacgcatacttaccatacggtactaatttatactattatgacgttaactctctctatccttttgttatgaaggaattctcaatgcctgggggtacaccagtctggcattctgatttagaatatatgacattagataacatgttagggttcattgaagcatatgtagaatgcccaaaaagtataaataaaccatttcttccctatggggataataaggatggcactcttatctttcctacaggcacctttgtaggggttactatagtgaggagctcaagtatgctagagacatag

SEQ ID NO: 46525 - DNA, 370 bp, Glycine max
  Peptide Sequence Number=SeqID_138210
atggccgagaggagaaagaaacttctacaagacagaacagttgcattcattcttgaggaggagactcatttctctaatttattatcacctgattcaccatcatcgagggaatccgccactcaattacctgaagtcattaccatggcagaagagcatgaccagagaattacccttgaggattactcaagtagttcagtaccacaaattttcaccaggattgcacgtcctgaagtgcaagctaacaacatcaactatccacattccttaattcatttaatacaagggaacttatttcaaggattacctaatgaagatctctatgcacacttggcaacgttcattgaaatatgtaacattgttaagattgctg

SEQ ID NO: 46526 - DNA, 393 bp, Glycine max
  Peptide Sequence Number=SeqID_138211
atgtgtctcccccacggattgagagacatatgcatgatcagtttggggttgtcagttctcaatgagtacgagagtggagttattgacattctcactaggagtgtacgccacattgggtggtgtatagttgggaggcaagccatatggcaggaaggcatgcttgttttgaatttgcgcataatgggggccgcccatgggggcattgggttcaccttagcaatagtgctggtagcggcaattgcaaccgcattggcttccattatcttcttcatgctcatcatggcctccatcattgtggccatttgctctttcatggcctccatgtcggccttcatctactcttgcacctcctctacttcacccattactctagctctagcacgggttcggtaa

SEQ ID NO: 46527 - DNA, 129 bp, Glycine max
  Peptide Sequence Number=SeqID_138212
atggagaaggagaaagatgaatggagatgccacttcaagtggaagatgagtctagaagaagctcaccaccctatgattcagaccactaatccaagatcaagtccaagcttctccactaagtgggcttaa

SEQ ID NO: 46528 - DNA, 210 bp, Glycine max
  Peptide Sequence Number=SeqID_138213
atgggtgttgatgtaagctccgttggagcttgtaggcctaggatcttcttcatcaatggattcctttgcttcttggaagatgaatggcagtggaatggagaaaggaagagagagagcccactaatccaagatcaattccaagattctccactaagtgtgcttaggtgtcatgagacatgtaaaagcatgaaggacatgcgcaaagtgtga

SEQ ID NO: 46529 - DNA, 182 bp, Glycine max
  Peptide Sequence Number=SeqID_138214
gattctcatcattccctccttcttggaaaacatttgccctcaaatgtccaagatcatcaccgggttcaagtaccacttccttccttttcttgttggcttgcttggtaataaagctctggggaggagatcaacttgatattctatgcctcttgaaggtggcagtccatgaggaatctccttag

SEQ ID NO: 46530 - DNA, 228 bp, Glycine max
  Peptide Sequence Number=SeqID_138215
atgatgggagatgcatcaaagttcaatcatatatctcccaagaaaagtggacatgtgacttatggtgacaacaataaaggtagaattcttaaaattggaaaaataggagtgatcatggaggagaatttgtgtcgcaacctacccatcggcgggagggcgacgcgagactcgcgggatgcgtgttccacgaaaggaatacgcgcggagtcgccaccaacgtttatttga

SEQ ID NO: 46531 - DNA, 651 bp, Glycine max
  Peptide Sequence Number=SeqID_138216
atggaaccaattgcctccctcgcccagtattatgatcagccgttgaggtgcttcatctttggggacttccagctatcaccaatgggggaagaatttgaagagatcctaggatgtcctctagggggaaggaaaccatacctcttctcagggttctacccctcattagccagaatttctaaaaaagtccaaatctcggcgcaggaattagaccgccaaaggcaagtcgaaaatggggtggtcggaataccgagaaaatatttggaggtaaaagcaagaatcttggcagataaaggcgagtggaccccattcatagatattctcacactgttgattttcgagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatggggggcgtctgttaa

SEQ ID NO: 46532 - DNA, 531 bp, Glycine max
  Peptide Sequence Number=SeqID_138217
atggttgctagaacaggattaagtcctctgatcgcgtgttcagtagacaccggcgatcggggacttatatgctcgtttgtcgagaggtggcaccgggagacgagtactttccatcttccagtgggggaggtatccatcatgttggatgacgtcgcctctcttcttcatctaccgatctttggcgacttccacaccttccagcctctgcacatcgacgaggcggtgttgatgctggttgagttactaatgatctcaccagaggtagccatggacgagataggacattgtactggaccatatgtacgcttgtctgggctacgagacatttatcagcacagatgtcagacccagcactggacagctgcagctcatgccctgtgtgacctcactcagactaggaggtacgcatggggagctgctggccttgtccatatgtatgatcagcttaatgatgtcagtatcagcaccaaccgacaggttgcagtgttggatatatcagcactttccatcagttgcggagtgcaatgctaa

SEQ ID NO: 46533 - DNA, 450 bp, Glycine max
  Peptide Sequence Number=SeqID_138218
atgactcaagagctggtagcccgcggagacaccttacagttatccgcacctcgtcattcagtgaccccaagtgtgattgacgagcagaggcgaatgtggtcatctgcgccctttccagagatgtcagcattttccgatggagacttttcaagtctcacaagttatccagaactacgtaggagcaagagccttgcttttgtcggccgccccataatctttgtcatactgaccctgaggtcacgtgacatgcacccttgtatcatccagaggcggcggggcccgatgatacgcggaagataccttacggttatccgcacccttgtgtcatccagaggcggcgggcccgatgatacgcggagataccttacggttatccgcacccttttgtcatccagaggcggcgggcccgatgacaagcagagccccagtttggtcattctgcacccttga

SEQ ID NO: 46534 - DNA, 378 bp, Glycine max
  Peptide Sequence Number=SeqID_138219
atggcgaatcaagaggagtgggtcccatttatggacgtattagcattgctaatctttggggttgtcctctttccaaacatggatggtttggtggacctagccgcaattgatgctttccttgcatatcaccatagcaaagagagcccggtggtagctatcttggcggacttatttgacacatttgaccgaaggtgcgagaagagtagcgcacggatcatctgctgtttacccgctctttttgtatggttggtttcgcatctattccaacaagacataaggcatccatgtccgctccgaagccatcgctcgtgtgtcgaaaaaagaagagtagattgtgaccaagacttggctgggataggaggcagaacaatcaactag

SEQ ID NO: 46535 - DNA, 515 bp, Glycine max
  Peptide Sequence Number=SeqID_138220
atggctgatgcgcttgccactttggtgtccatgtttcagctaacgccgcatggagatcttgtaccatacattgagttctggtgtcgtggcaaaccactgacattgttgccaagtggaagaggaagcgggacggtaagccttggtatttcgatatcaagcgatatgaaccaccatgactctcctgcgatgcgtggatgccaaagaggtgaacccatgatcaggaagttgacggtctttgagaacgcctactgccaatgggcggacgctccggaagatcctgaagcaggaaatgcaagtgtcaagcgcttggcagatatttggtcacagcctctcaacgactatcagcccatgcatcccgaatcttggatgagatcatgtgccttgacttttggaggaaaagctagacaaggtcatcgggacaagtggaccgtgtggctgggttttgattgcaccaacaatatggttgagtataaagcgtgtgccctgaccctgactccaatgtcaagctactcaag

SEQ ID NO: 46536 - DNA, 345 bp, Glycine max
  Peptide Sequence Number=SeqID_138221
atggaaatgaaccaacagtccccttctagcgacaactcccaagggtggtttcatggactatcagtgacaatgcatcaccaaaagagaaaaactttagatgaggcttcactgttatcaagtgagtcggagacccaacatgaacacagatcgacctccactccctactgtggaagcaatgtcttccaaggttattttgatgatgccaaagaatcaagagttaagcaaagtttcaagcaaagattcaagaatcaagtttcaagaatcaagaatcaagaatcgagaataatcaagatcaagattcaagactcaagattcaagaatcaagagaagactcattcaagataa

SEQ ID NO: 46537 - DNA, 171 bp, Glycine max
  Peptide Sequence Number=SeqID_138222
ggggagatcagagttatggtggtgcgcatgatccgcactcgtctccctgtgtcagtttgggcgaaatcttgccccggtatgcatagtagttgcacgatagcctccttctctggttgtgctcgcacagttggccctccttcgagattaagggggtggccaaggaacagataa

SEQ ID NO: 46538 - DNA, 228 bp, Glycine max
  Peptide Sequence Number=SeqID_138223
atgatggcacatcagtacatctcttgtggatcaattctagtggaggctcaaagatcaatcaagaacaattcaagagttcaagataagaatcaagaagaattcaagactcaagaagaaagtctagagacaagaatcaagattcaaggttcaagatctcaagaatcaagatcaagattcaagactcaagattcaagaatgaagagaagactcaatcaagataagtattaa

SEQ ID NO: 46539 - DNA, 438 bp, Glycine max
  Peptide Sequence Number=SeqID_138224
atgactgttgcagacagtattaagacatctctccctaagaccgataatgctaaagagtttatgaggttagtgggagagagctctcaaacagatgataagtctcttgttgggacattaatgagtatattgaccaccataaagtttgatggtttacgtactatgcatgaacatgtcattgaggtgacaaacattgtatcaagacttaagaccttgggaatgactgtgaatgagaacttccttgttcagtttatgtttaactcattatcgtctaatatgttagttcaggaagagacagggcttaagaatcaaggaagtcactcagtctattatgtcagccaccaagggaatcaaggagctgaaaagaaatttatgaagaagcatgataaaggcaaaggatcattaaagatcaatgatgactctttgcaaatccaaaagaag

SEQ ID NO: 46540 - DNA, 176 bp, Glycine max
  Peptide Sequence Number=SeqID_138225
atgatgctccacaacctaaatcgaaaggctcctgctagttggattatcgtcaaagagttcaatttgaacgcgattgaattctatcttggagcctacctaaatggtgctttaaaaggtcttgatgatgctccacaacctaaatcaaaggctcctgctagggtggattgtcgtcaaag

SEQ ID NO: 46541 - DNA, 336 bp, Glycine max
  Peptide Sequence Number=SeqID_138226
atgtctccacactcgtggggtggattatgcgtgaacgaaaacgcaattcatgggggctccgaaaaagggttagagaatggagatttgcacaaagcaatcactacgcatggctgcaaactcgtgggtggaggatgcgtgaacgcaaacgcaattcatggggctccgaaaaagggtgttagagaattgagaattgcactaaccaatcactacgcatggctccacactcggttagagaatggagaattgcacaaagcaatcactacgcatggctccaaactcgtgggtggaggatgcatgaacgaaaacgcaattcatggggctccggaaacagggtag

SEQ ID NO: 46542 - DNA, 276 bp, Glycine max
  Peptide Sequence Number=SeqID_138227
atgggtattttaagaaatcaagatattatatttttttcaagcataaattcaaaaagaaagggggagaaagggatgagtgaatggattgtcatcatcaaaaagggggagattgtggaagtaatgtcttccaaggttattttgatgatgccaaagaatcaagagtcaagcaaaatccaaagattcaagaatcaagtttcaggaatcaagattcaagattcaagaataatcaagatcaagattcaagactcaatattcaagaatcaagagaagacttaa

SEQ ID NO: 46543 - DNA, 198 bp, Glycine max
  Peptide Sequence Number=SeqID_138228
atgatgaatgttttgagtggtgcaaccctcttttgtaaaatcactcgtacacctaacatcttcatggtgtgtgtacatagggacccattaggtgttgaaggaaagagcccagagtatgaagaacctcgggatttgaggtcaaatcctttccaaggtggagggaatgatgcaatcctactccgtaagggcattgggtag

SEQ ID NO: 46544 - DNA, 456 bp, Glycine max
  Peptide Sequence Number=SeqID_138229
atggtcgcatgtcatcaagcaaaggtccccgaaaatcagtgtatgacactaatttcctcctctcggttggcgagagtcgcgggtgaccgtgacttgtcgttcctaggatttcacaaattgcctaatgatgggtgccaagcacctcacaaggaccaaagaatgctgtctatcaagcaaaggtccccgaaaatcagtcaaaaggtgcagaagactgtgccatgcccctgcatgctatcaagcgttctgtcttacaatagcaaaagaagggtgcgaataaccataaggtatctccgcgtatcatgtgtgcagaatgaccaaacttggtctctgcttgtcatcggacacaacgtgtctaaatgcaaaggggtgcggataaccgtaaggtatctccgcgtatcatgtgtgcagaatgaccaaacttggtctctgcgtgccatcggacacaactgtgtctaa

SEQ ID NO: 46545 - DNA, 721 bp, Glycine max
  Peptide Sequence Number=SeqID_138230
ttggaactcttacgtgccgatcaacgtctcattttcgccaaaagttggcccagggcttcccggtatcaacagagacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcccgaagtaactaattgggtggtcctcaggcctgaggggcatgcgcccgtaggtcattttgctattggagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccggtgcgtcagcagaatatgtgatacaggatatattccgcttcctcgctcactga

SEQ ID NO: 46546 - DNA, 507 bp, Glycine max
  Peptide Sequence Number=SeqID_138231
atgaacaggacgcatcactatgaacagctgattgagatctttgacggctgttttgctgacgattttaatacccgtctgattaaaggcgacgacgaaccgatctatcttcctgctgatgcagaggttccgtataaccgcatcgtgtttgcgcacggtttctacgccagtgcgcgtcgcgagctggtggactttggttactggtactgtccggacggacgtgacgcggcgacgcagggtcagtttgaagatgtggaagtcaaaccgcaggcgctggagtggctattctgcgtggcggcgggattcccgttcaacgtcagctgtgacaatctcgaaggggatttcgagccagaccgtattctcttccagcgccgcgtgcatgcgcaggtgatggagtatcttgagaaaggcatcccggaacgcccggcacgtctgatcaaggctttacagaattattaccatacgccggagatcacggcggaatgcttcccgtggccggaagatctttaa

SEQ ID NO: 46547 - DNA, 390 bp, Glycine max
  Peptide Sequence Number=SeqID_138232
atgtcgcttgtagccatattttcaatgagatacatcgcttcttcaggggtcttcaatttgattttcccacctgtagaagcgtctaatagctgtttggactacggtcttaacctatctataaagatattgagctgtatcagttctgagaatccattagtgggagtctttcttgtagaagcaaagcttcatgataaatcaaagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcatgataagtatgaaaagtttttctccaaaattgagtag

SEQ ID NO: 46548 - DNA, 102 bp, Glycine max
  Peptide Sequence Number=SeqID_138233
atggaaaaaccacgtcatcatgcctacttgaatagcagtggctctgctattcaagagacacagagttaccactattcaaggcttgtcagaaccatttgcact

SEQ ID NO: 46549 - DNA, 1199 bp, Glycine max
  Peptide Sequence Number=SeqID_138234
atggggacaaatcaaaacggcaaaaggttatatcaagtcaaggttaaaagtctagatgtcaccagcctcaaggaattgggacgattgatgggacctctccaaaggcaagcctttcgcaaagtgtacggaaagattctagatttgaccgcggcggaggtatttacgaaagctgtcgtatccctcgcccaatactatgaccagccgttgaggtgcttcacgtttggggacttccaaatggtaccgactattgaagagtttgaggagatactaggatgccctcttggggggagaaaaccgtatcttttctccgggtttcttccctccttgagcaagattgcagctgtggtcggggattcggcaagagagttggatcgcatgaagcaaactcgcaacggcgtagtgggcctgccacagaagaacttggaaggcaaggtaagggatagggcgagccaagaaaagtggggcccgtttgcggatatactagctttgttgatttttggggttgtcctctttccgaacgtggacggtttggtggacttagccgccattgacgctttccagtggtggctatcttggcatatttgtttgatacatttgaccggagatgtgagaaaaacagtgcacggattgtctgttgtttacccgctctctgtgtgtggaagagtcgattgggaccaacatttggctagaataggaggcaacgcaatcaattggtttcctcgttggaaggaaggtaaggaaggagttctcttctcgtgtggggactaccctaatgttccattgatagggactaggggttgtattaattataatcccgcactcgccataagacagctagggtaccccatgaggggagcgccaatagcagaaagtctctcgcctttccttgtgagggatctaggcgcgcaaagtctcaaggtgatacaaagagtccacaaggtgtggagaagtccgttgaagaaagacaaggagcttagaggcattcgaaatggcgtcatcggtggttatcatggatggctaagagttcacacgcgagggttagattggctctccaaattgaaagttatcaatgaggagaacttcgaagctccggaggaagatgaagaagtccaagctctaaaattagagctagggaaggcgagactcgccaaggagaagttcaaatcagccgctacacacatccggaaagagcgcaccga

SEQ ID NO: 46550 - DNA, 755 bp, Glycine max
  Peptide Sequence Number=SeqID_138235
atgaagcagaaacatattttagctttgctgatttttggggttgtcctcttcccgaacgtcgacggtttggtagacttagccgccattgatgctttcctcgcatatcaccatagcaaggaaagtccaatcgtggctatcttggcagatttgtttgacacctttgaccggaggtgtgagaaaaacagtacacggattgtctgttgtttacccgccctctgtgtatggttgatttcgcacctattccaacaagacacgagacacccgtgtccgattcaaagctatcgctcatgcgccgaaaaaggaagagtcgattgggaccaacatttgactgggatagggggcagcacgatcaattggtttcctcgttggaaggaaggcaaggaaggagttcttttctcgtgtggggactatcctaatgttccacagctagggtatcccatgaggggagcgccaaccgaagaaagtctctcgcctttccttgtgagggatctaggcgcgcaaggtctcaaggttatacaaagaatccacaaggcgtggaggagtccgttgaggaaagacaaggagcttaggggcatccgaaatggcgtcattggaggttatcatgggtggctaagaattcacacgcggggcttagattggctctccaaattgaaagttatcgatgaggagaacttcgaagctccggaggaagatgaagaagtccgagctctaaagttagagctagggaaagcaaggctcgccaaggagaagttcaa

SEQ ID NO: 46551 - DNA, 988 bp, Glycine max
  Peptide Sequence Number=SeqID_138236
gttgtacaaaaagtccacaaggcgtggagaagtccgttgaggaaagataaagaacttaggggcatccgtaatggcatcatcggtggttatcatgaatggctaagggttcatacgcgagggttagattggctctccaagttgaaagttatcaatgaggagaactttgaagctccggaagaggatgaagaagtccaagctctaaaattagagctaggaaaggcaagactcgccaaagaaaaattcaagtcagccgctacaaacatccggaaagagtgcaccgagttacgagaggaaaacgcggccactgcaagagcccttgaacaagaaaccaaaagggcccgcaacgaggaacatggccgggataaataccgaggagctttgtggggcagcaataatgagctcaagctccggagagaggaaagggaccagtcacgggagtgggtcccatttgcggatgtactagctttgctaatctttggggttgtcctctttccaaacgtggacggtttggtggacctagccgcgattgatgctttccttgcatatcaccatagcaaggagagcccggtggtagctatcttggcggacttatttgatacatttgaccgaaggtgcgagaagaacagtgcatggattgtctgctgcttacccgctctttgtgtgtggttggtttcgcaccttttccaacaagacataaggcacccgtgtccgctccaaagttatcgatcgtgtgtcaaaaagagaagagtagattgggaccaatacttggctgggataagaggcagaacaatcaattggtttcctcgatggaaggaaggaagggagggagtcctcttctcatgtggggactacccaaacatttcattgatagggacgaggggttgtattaactacaatcccgcactttctataagacagttagggtaccccatgaggggagcacccacggaagagagcctctcgcctttccttgtgagagattcggcac

SEQ ID NO: 46552 - DNA, 645 bp, Glycine max
  Peptide Sequence Number=SeqID_138237
gtggattgcgacaaagaagaccgtgaagagcattcacacgccatcatacagggagcgcctggaccgactccgaattccggatgtctgttggatcccgtatggggagcatcgggaggtccgggacttccacgtcagatcatgctactccggtctcttgcgttgagggcctgttgctgtttattaccgaccggagagggtcgtgcggcagtttggtggatgcactacgaggatcatatcgtacctacaggtgaggtgtgcgttgtgccaggggcgtgttccagtgactacatcgactggttcttccgcatctctcatcctttcatgacaccaggccacgcagtagatcctctgcctcatggtcacgccccgcagccccgagtcgtccctcaggccccgcagacggatatccctcgcgtgccggagccaagagcatcgtcgacatctgcggaggagcccagacatgttctggaagtttgtgatgacattgctgagaggttggagcgccatctgagtttaggggtggtcacgcctggctcatcgacacatgaggtgatcgaagaatgcctcagattagtcaggagtgtgacacaggaccatctagtatacgttaggtgtagacgcaggcggcgcactgatcaggcgtag

SEQ ID NO: 46553 - DNA, 381 bp, Glycine max
  Peptide Sequence Number=SeqID_138238
atgacccaagagctggtagcccgcggagacaccttacggttatccgcacctcgtcattcagtgaccccaagtgtgattgatgagcagaggccaatgtggtcatttgcgccctttccggagatgtcagcatcttccggtggagactttttcaagtctcacaagttatctagaactataggcggtgggcccaatgatacgcggagataccttacggttatctgcacccttttgtcatccagaggcggcgggcccgatgacaagcagcggccaatgtggtcattctgcacccttgtttcatccagaggcggcgggcccgatgacaagcagcggccaatgtggtcatctacacccttgtgtcatccagaggcggcggcccgatga

SEQ ID NO: 46554 - DNA, 570 bp, Glycine max
  Peptide Sequence Number=SeqID_138239
atgaagcacttcactgacaccctcatcagtgccaacataggaacaaaagctggtaccgggccccccctcgaggtcgacggtatcgataagcttgatcttcgacaagctcgccggcgtcagcgacccggaagccaagcgcaagattatcggcaacctgttcgtcgagatcttcgacgaagagtcgcagaaactcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46555 - DNA, 324 bp, Glycine max
  Peptide Sequence Number=SeqID_138240
ggcgaattggagctccaccgcggtggcggccgctctagaactagtggatcccccgggctgcaggaattcgatcgaaacagtctgcattcttgtacaaagttccattatcggtgcataccgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 46556 - DNA, 171 bp, Glycine max
  Peptide Sequence Number=SeqID_138241
tgtatatcatcaactagacagattttagcgcttgttactagacgcgatgactacacaaatgcacgtttgttgaaccataataatgaagtgctctacaggcgaatagaacgactagagcaccaaatgaatccaaatgctggagaccttatggtggcaacagaaggtcaatga

SEQ ID NO: 46557 - DNA, 165 bp, Glycine max
  Peptide Sequence Number=SeqID_138242
atgcctcacctcttggcgaaaaaggtgagaaaagcgtcgatcgctgctagatccaccaacccatccacatttggaaagaagactcctccgaagatcaacaatgcgagaatgtctatgaatgaggcccattcgcctctacctgccaaggacttctgccatggctag

SEQ ID NO: 46558 - DNA, 316 bp, Glycine max
  Peptide Sequence Number=SeqID_138243
atgatcgaaagttttcaacaacaacaacaaatgtcagttctagaattgtacgtagaaaaggatgttgctggtagttctatgtttcatgctgcaaattctgttacgtcatgtggacgtaatgtatctcatcatgagtcggaactgccaagccctataagcaatctacatgatgatgaagatgatgatgattatcttgcatctaactcatacattgaagagtcttttgatgaagatgatagtgatgatggaatatctgatacagacgatgaagtcactgacatcgttgaaccagtttcaattgttcacccaaccgaag

SEQ ID NO: 46559 - DNA, 426 bp, Glycine max
  Peptide Sequence Number=SeqID_138244
atgtggctacgtctagacgattcatctaccagtcgctgcaggcagcatgcatggtctctcgtggcagaggcgaaagtgatgaatgtctgtttcatctcagggaatcacacgacatggaaacctgccccgcggtggaagagttacttcaatggctcatggactgggggcagctcgaaggatgtgaccggctccaggtccaagtaccccccgacagcgcccaagccaacgccgttttcctatcagagcaataaggccgttccatggaagtatacccctcccgcttttggagaaagagctgcaaccgaggttgactccttgtcagccaaggtgaccaacatcactggccttagtggcgtaacccgcggtggccaggtgtttgctccccctcactcggtggaattgccctccaaggggaagcacccatga

SEQ ID NO: 46560 - DNA, 243 bp, Glycine max
  Peptide Sequence Number=SeqID_138245
ggccttgtagataaaccttctgggggtcgtcacgtccttcaaaggtttggacctacgcggcctacccgactcgacggcattaaccgctccccctccatgattggcaagcgggttgcgttagggttataccactttgggaaaggagactggtggatccttccaggagatatcacagtgatctggttggcgactagggatgccaagaggtcttcgtacgtcattgggatcagggtgaattcttga

SEQ ID NO: 46561 - DNA, 270 bp, Glycine max
  Peptide Sequence Number=SeqID_138246
atgcgcggagtcgccaccaacgtttatttgtggaaaacgtcgaaaaaaccgaaggaaccggtcatgaagaatattccagattcgggagttgtatttaagtttgaggaaggtcgacaaaagtggggctcttgctcctacgtaccctccatcgaagaggaaatcagacctacgcagttctttctaaagggggaatcaagcgattcttttttcttggaagatggtccttttaaggcgttggatcttaaaatgatccatttttacttggtgtga

SEQ ID NO: 46562 - DNA, 210 bp, Glycine max
  Peptide Sequence Number=SeqID_138247
atggcgagggcgtgtagccctctgaaggtgaggacatgcagtcctctgatggcgagggcgtgtagccctctgaaggtgaggacgtgtagtcctatgaagattgactgtccttttgaaagaggtgataattcatgcgaccttatcctatcttttgcaaatctctccgggaactccctcaaagtgtatgttctttttgatttagtcacttga

SEQ ID NO: 46563 - DNA, 459 bp, Glycine max
  Peptide Sequence Number=SeqID_138248
atggctccgaagaagctttccttgaagagatctaggaaggacgccgcggccgcagagactagtgccgctcccgagttcgatagccatcgtttcaggagcgctaagcaccaggacaacaagtacacagatttccaggaggagatagctcgccggtgttggacgtcgctggtcacgcccatggccaagtttgatccagatatagttctcgagttttacgccaatgcttggcctacagaggagggcgtacaggacctgcggtcctgggtgaggggccagtggattcctttcgatgcagacgccctcagtcggttcctgggatatccgctagtattggaggaaggccaggagtgcgaatatggtcagagacggaactgggccgatggatttgatgaggaggccattgctcagctactctgtataccaggtcaggattttgcccggaccgttgccgggagacgg

SEQ ID NO: 46564 - DNA, 162 bp, Glycine max
  Peptide Sequence Number=SeqID_138249
atggcaaagtcattggttgggcatccatttgcaggtcgactgacaaaggatgagaagattgttgttgctgatatgacgaagtccctgggatttgtctttgatgaatgcaatgaaaactgtattcccgggtgctacaaacctactatgtcggttccatattga

SEQ ID NO: 46565 - DNA, 280 bp, Glycine max
  Peptide Sequence Number=SeqID_138250
atggcgaccgcgctcgtgatcgaggacgatgacgacatccgccgactgctcgaggtggtgctgtcccaggccggctacaccgtcgccgccgcagccaccgggacggaggggctcgaggcgctcggcgcgctggcgcccgatctgctgctggtggacgtgggcctgcccgacatcgagggatacgacgtggtgcggcaggctcgatcgcagatgagcggccatatcgtgatgctcagcgcccgttcccaggaggcagacgtccagctcggtctcgaggccg

SEQ ID NO: 46566 - DNA, 177 bp, Glycine max
  Peptide Sequence Number=SeqID_138251
gagctacctcctgagcctgctgtagatgctcttgactttctagagggcgatgaggacccacttcctgaggtggattctcccgaggaagtcatgtcggcatctgaggcagattctacggaggatagtggcccgggggagatggcaatcagcggaggctcttcatcacctgatgtatag

SEQ ID NO: 46567 - DNA, 291 bp, Glycine max
  Peptide Sequence Number=SeqID_138252
cctatccctcttaagattattgaggccacaaggtccaacattagccagtacattggctttgccgagatgatagctaagctcaaaatcataatctttaagaagcttcaaccatctcctttgacaaatgttcagctctttctgagtaaacaagtacttaaggctcttatgatcactaaacacctcaaacttggagccaaacaagtaatgcctccacatcttaagggcaaaaaccacaacagccaactccagatcatgggtgggataattcctgtcacgagtcttgagtgttag

SEQ ID NO: 46568 - DNA, 495 bp, Glycine max
  Peptide Sequence Number=SeqID_138253
aggaggtcctatggggtggtggccttgatcagaagaaaattgcatgggttaaatgggactactggctcatggaacaggaacctttaagggagaaatatcccagattgtataacatatcctgtcaacagcagaagcttattcaggatatgggatgtcagtctgcaaatgtttgggaatggaagcttgaatggagaagacacctttttgaatggagaagccagtttctgagcatcactacatccaacagatgggaagtcacaaagacaatgggtgggagtggagctttatttggagaaggccattgttttgacaatgaaattgatacggctggtgtttttctcaatgaggttcaggatatggccattcaacaacatggacctgatgtgtgggaatggactgctgaccctacagggacagtgaggatgatgcaattttcattctttggacctggcttaggaactttgagaaaggcttcacagaacattttaatcactg

SEQ ID NO: 46569 - DNA, 192 bp, Glycine max
  Peptide Sequence Number=SeqID_138254
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgtgtaaccaccacacccgccgcgcttaa

SEQ ID NO: 46570 - DNA, 468 bp, Glycine max
  Peptide Sequence Number=SeqID_138255
atggctaagtttgacccagatatagtcgtagaattttatgctaatgcttggcccacagaagagggagtgcgggacatgcgatcatgggtgagggggcagtggattccgtttgatgcagacgccctaagccaattcctgggtgacccgctggtgttagaagaaggccaagagtgtgagtttagtcagagaaggaacagggtcgacggatttgacgaagaggccattgcccagctattatgtgtaccgggtcaagattttgcccggaccgctgcagggaagcgggtgtggatcatgcgcaccagtatgaccaccttgacacagatgtggatggcgttgctgctcagcaatgtcctacccactgatcataactccgaccttcctctgccgaagtgtcagctggtatgccacccaccaggcaccctcaagacccggataaatctgacagggccctggggtttccagtgttga

SEQ ID NO: 46571 - DNA, 165 bp, Glycine max
  Peptide Sequence Number=SeqID_138256
atgactttccaatcttttgaagtagtaagcatcgcctccatagattccctctctaggcagcctcgcctgttcgatgcggcaatgatggtggcccgggtaatgctggggcacgactacgagcccggaatgggtttgggcaagaacaacagcggcaggaccagcctg

SEQ ID NO: 46572 - DNA, 942 bp, Glycine max
  Peptide Sequence Number=SeqID_138257
atggcgacccaagcaatgcaagcacctgcacaactgaccatcagccccagactggccaagaacatccgccggaatgtgaaagaacgcattattgagctgatcctcatgttagctgccctggtagcggttgcaaccaccttcgcgattgttggggtcttgctgtacgagtccctgagtttcttcaagaccgtatctgtcgtagagttcttcaccgatacgcaatggacgccattgtttgaagacgcgcactatgggattatgccgctggtttcaggcacactgaccacttcggcgattgcgttggcagtggccgtgccgattggcaccatttctgccattttcctatccgaatttgcttcacataaaacacgtgaaaccatcaagcctatccttgaattactggtgggtgttccgaccgtagtatttggttactttgcattgttttttgtgaccccattgctgcaaagtatttatcctgatttgccaagcttcaatatgctgggtgccgggattgtgatggggatcatgattattccttacatcgcttccatgtcagaagacgcgatgcgtgcggtgcctatgagtatgcgtgaaggctcttatgccatgggcgcgacccgcttccagactgcgatccgagttgttacgcctgctgcggtgtccgggattgtggcagcctatatcctggcgatttcacgtgccgtaggtgaaaccatggtggtggcgattgcggcgggccagcagcctaatttgacgtttaacccactggacagcgcagcgaccatcactgcctatatcgtacaagtcgccatgggtgacctaccgcatggcagcattggttaccaaagtatttttgcggccggcctggtgttgatggcaatgacattgtcattcaacattgtggggcattgggtacgtaaaaaataccgtgaaagctattaa

SEQ ID NO: 46573 - DNA, 782 bp, Glycine max
  Peptide Sequence Number=SeqID_138258
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggatcaaagctaaaggcttctgggatggaccctgtatgcactttcaagggccagtctagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46574 - DNA, 255 bp, Glycine max
  Peptide Sequence Number=SeqID_138259
atgaaagcacacacaaagtttaacaattccacaattcctaagataggcctaactcacaaaagtccccagtggagtcgccaactgtcgcaacgtgcccttcgcgggcgagcgagggcgaggctcacgggtgcgctttccaaaggaggaaaggtcgacaaaagcggggcttttgctcctacgtaccctcctttggagaggaaatcagacctacgtagttctttcttatgcatgaatcaagcgattctttttacttga

SEQ ID NO: 46575 - DNA, 872 bp, Glycine max
  Peptide Sequence Number=SeqID_138260
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcatcacatcacatcgtatagtggaatggaatggagtgatggttgttgtgtgtgttgcaccaccaggcatgtctcgagctgctgcaaatgtcatatcaaaacgatcatcaatattgtctggtcaagtgtgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46576 - DNA, 378 bp, Glycine max
  Peptide Sequence Number=SeqID_138261
atggtgaaagttggaacctcttacgtgccgatcaacgtctcattttcgccaaaagttggcccagggcttcccggtatcaacagggacaccaggatttatttttctggaagtgatctgtccgtcacaggtatgttattcggcagcaaaggttggttgcgggtattaatgctccaagcttatcgattaccgtcgtacctcgaggggcccggtaccgcttttgttccctttatgagggttaatttccagcttggcgtatctggtttcatagctgtccttcctgttcagctacgacggggtgaaattgttatccgctcacaattccacaaacatacgagccggaacatcagcgcggcaagtgtaaagcggggtgcacgctga

SEQ ID NO: 46577 - DNA, 654 bp, Glycine max
  Peptide Sequence Number=SeqID_138262
atggatatcatttctgtcgccctgaaacgccactccaccaaggcgttcgacccgactaaaaaactgaccgctgaagaagcagaaaaaatcaaaaccctgctgcagtacagcccgtccagcaccaactcccagccgtggcactttattgtggccagcaccgaggaaggtaaagcgcgcgtggcgaaatccgccgcagggacctatgtgttcaacgaacgcaaaatgctggacgcctctcacgtagtggtgttctgcgcgaaaaccgcgatggatgatgcctggcttgagcgcgtcgtggatcaggaagaagccgatggtcgttttaacacgccagaagccaaagccgcgaaccataagggccggacttacttcgccgatatgcaccgtgtggatctgaaagatgatgaccagtggatggcgaaacaggtttacctgaacgtcggtaatttcctgctgggcgtgggtgccatgggtctggatgcagtgccaatcgaaggtttcgatgccgcgatcctcgacgaagagtttggcctgaaagagaaaggcttcaccagcgtagtggtggtgccggttggccatcacagcgtggaagatttcaacgccacgctgccgaagtctcgcctgccgctgagcacgattgtgaccgagtgctaa

SEQ ID NO: 46578 - DNA, 212 bp, Glycine max
  Peptide Sequence Number=SeqID_138263
atgattattgaaaaatcaattcatgttgcttttgatgagactaactctaaaaggccaagaaaggaaatacttgatgatattacagattccttagaagatatacatattcatgaaaaaggacacaaagacaaaggagatgaaaatagtagagactctcaattcaatgaaaatcaaacaaatgaggatcttccaaaggagtggagaacttcaag

SEQ ID NO: 46579 - DNA, 252 bp, Glycine max
  Peptide Sequence Number=SeqID_138264
atgccaatctccccctgcagatgtatcagcgagggatcgcgcccacaagacacccagtggacccgaagaagtccaacagggccctggggtttccagctctgggatcgtgcccacaagacacctagtggacccgaagaagtccaacagggccctggggtttccagctctggttacgggcctctggatcgagcccgcaagacacccagtggacccgaaaaagtccaacagggtcttggagttgccaagctctaa

SEQ ID NO: 46580 - DNA, 243 bp, Glycine max
  Peptide Sequence Number=SeqID_138265
atggaccctaagagaataaaggtcattcatgagtggcctactccaccaagtgtcgaggaaagaattaatgagtttcaagaacccctggatttgaggtcaaatccttttcaagggggagggaatgatgcaatcctaccccccaagggcattgatagaagactccaagaagattggaccaaagatgcaagagaaggccctagggttctcatgagccttaggatagattttgggcccatgggctaa

SEQ ID NO: 46581 - DNA, 634 bp, Glycine max
  Peptide Sequence Number=SeqID_138266
atggataatgaagagggcatgcaggaacagatgaaggccgatctatcggccttaaaagatcaaatggcttccatctcagaggtcatgttaaaactccagaaaactatagaggataaagccacggcaaccgcctccagtacagttagggaagcggagccggtgctgcagcccgccttaaatccgggccgagatagaaacacgacagtgtttggtcggaggtatagttcgcaagcttacccctatggcttgcctccggacttcactccccgtgccaccccggaagatttaagccaagcccctactttcgagggacaactccaaccttataacgactatctcgggcaagacaatgaggaaggagatacccatctcagtcccctgctccacctcaaagatccgtcccctcatgaactaccccaaccaaacatagtccaccatatcccggcttcacccacacccgtaaaagaatctgttcccttcgtggaagataagggaaagattgaggcgcttgaagagaggttgagagcagtcgagggcctcggcaattacccaatatcgtcattcctcccaagttcaaagtatcggactttgataagtacaaagggacgacatgtccgaaagggcatcttcggat

SEQ ID NO: 46582 - DNA, 546 bp, Glycine max
  Peptide Sequence Number=SeqID_138267
atggactggaagctggcgctgccgctgcacccggaataccgcaccttaccgatggtctggtacgtgccgccgctgtcgccgattcagtcggtcgccgacgctggcggcctgccgagtaacggtaacatcctgccggcggtagaaagcctgcgtataccggtacagtatctggcgaacctgctgagcgccggtgataccggcccggtcttgcgcgcgttaaaacgcatgatggcgatgcgccattacaaacgttcgcaaaccgtcgaaggcgtgaccgatacccgtgcgattgaagaagtgggcctcagcgtcgaacaggtggaagagatgtatcgctacctggcgatcgccaattatgaagaccgcttcgtgatccccaccagccaccgcgaactggcggaggacgccttccctgaacgcaacggctgcggttttaccttcggcgatggttgccatggttctgatactaaattcaacctgttcaacagtcgtcgcatcgacgctattgacgtcggggacgttcgtcgacatggggagggagagtaa

SEQ ID NO: 46583 - DNA, 813 bp, Glycine max
  Peptide Sequence Number=SeqID_138268
atggattttcaggaagagatagctcgtcggcgttggacgtcgctggtcactcccatggctaagtttgacccagatatagtcttggagttttatgctaatgcttggcccacagaggagggagtgcgggatatgcggtcatgggtgaggggtcagtggattccctttaacgcagatgccctcagccagttcctaggcgacccgctagtgttagaggaaggccaggagtacgagtttggtcagaggatgaacagggccgatgggttcgacgaagaggccattgctcatctcttatgcataccgggtcaggatttcgctcggaccgctgcggggaggcgggtgcggatcatgcgcaccagcaagaccaccttgacccagatgtggatgacattgctgcttagcaatgtcttgcctagtgatcataactccgaccttcctctgccgaagtgtcagctggtgtatgccatcctgacacggatgagcgtccatgtggctcagttgattgctgacgccatctatttatttgcaggtatgccacccaccaggcaccctctagacttggataagtctaacagggccctgggatttccagcattgatcacgggcctctgccagtcattcggggttctcgtcacgcctagtaaggcatggagcggtatgatgcaagctccattggagcttgtaggcctaggatcttcttcatcaatggattcctttgctccttggaagatgaatggcagcggaatggagaaggaagagagagaggagacaccacttcaaggagaagatgagtctagaagaagctcaccaccatag

SEQ ID NO: 46584 - DNA, 411 bp, Glycine max
  Peptide Sequence Number=SeqID_138269
atggccccgaggaaacttgcctcaaagagatccaggaaggataaagcggccgaaggaactagttctgctcccgagtatgatagtcaccgctttaggagcgctgaacaccagcagcacttcgaggccatcaagggatggtcatttctccgggagcgacgcgtccagctcagggacgacgagtataccgatttccaggaggagatagttcaccgacggtgggcatcgctggtcacccccatggccaagtacgatccagacatagttctcgaattttacgccaatgcttggccaacagaggagggcgtgcgtgatatgaggtcctgggtgaggggtcagtggatcccgtttgatgcagatgctatcggccagctcctgggatatcccttagtgctgaagagggccagagtgtga

SEQ ID NO: 46585 - DNA, 420 bp, Glycine max
  Peptide Sequence Number=SeqID_138270
atgaccatgattacgccaagctcgaaattaaccctcactaaagggaacaaaagctggtaccgggccccccctcgaggtcgacgaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcggtgaccgctacacttgccagcgctga

SEQ ID NO: 46586 - DNA, 252 bp, Glycine max
  Peptide Sequence Number=SeqID_138271
atgtcaaaccttaaaagcactgagttagcattgaagaaccttgaggtccaggtgggacaactggccaagcagatagctgacaagtcatccaacaattttgtggcaaataaagaacaaaatcccaaggaggaatgcaaagctatgatgacaaggagtaaaaggtttgtggaggctgaggatgaggatagtgttgtgcataagaagaaaattgctgacaagaaaggtatgttggatcaagtggcctcagaataa

SEQ ID NO: 46587 - DNA, 230 bp, Glycine max
  Peptide Sequence Number=SeqID_138272
tggagccagttcaagtgatagaggtgtcatcctctgaagaggatcctgaggaggacccagaggagttacctcctgagcccgctgtggatgctcttgacttacctgaggatgatgaagacccactccttgatgttgattttccagaggatatcatgtcagcatctgaggcagactctacaaaggggagtggccctggagggatagcgaatagtgaagactcttcatcatag

SEQ ID NO: 46588 - DNA, 426 bp, Glycine max
  Peptide Sequence Number=SeqID_138273
atgtctgccaaagcaaacatggtacaagacaaacctttccataagatgtatgccaacaaaattgatcacaataataagaataagtacaaatataataacccacgtgttgctccttctaatcccatcccacgtgctcttgcttctaatcattctttcaagaaaaaaggagcatgttttgtttgtgggcagccaggacatttagctcctcagtgtaggtatagaattgtgagaaatgaaaatcctcctaaacctaggcctaacctagttgaaggagatgacattattgttgcgttcatttctcaagtgaatgttgtcaccaatgggatggagaagaacaagtttatcttggtgattcgagaactactccagttcaaggaaaggggaaagttcttctcaagctcacatctggggaaacattggctttga

SEQ ID NO: 46589 - DNA, 207 bp, Glycine max
  Peptide Sequence Number=SeqID_138274
atggctgaagccgtaaaacctgtcaacaacgttgatgcttccaaccccacgccaccgacgacaatctttgctaagccattgcccgacgtctcaaaaattgaggaatgtgttcgtaccttgctggacatgcatggagctgtcttcgctctttccactcccaaacctgctgccgatgctgatgccaatcaacttcaacaatgggtttaa

SEQ ID NO: 46590 - DNA, 191 bp, Glycine max
  Peptide Sequence Number=SeqID_138275
ccaccttgatgtcaccctaacatcaagtgttggacctgagtgtgtagagttgatctctattgttcagagagcaatctctggttgcacgggtagtgtcaaatataatctgcatgatctgaagcgtgatgtcgtgacatccggtacgacatctgtcattggtatcagaatttcagtcaggattttgggtcaag

SEQ ID NO: 46591 - DNA, 303 bp, Glycine max
  Peptide Sequence Number=SeqID_138276
atggtgtcaccacaagggaggaacacatgggcagttgatgatctcgtgccttacgtgaaaaagttagcgattatatccgaagagcaagagagaatcactgagccaatgtcacatggcagacgaagggagcctgttgaagcggaagaatattcccaacaaatgatggagcgtggtcatggaatgtattacacgccggcaacattttcccaatatctttcacagatgtatcattatccttttgaaggtcatcacactgatacttctgcgagcgaacattcgttcggtggtgttgcgaaaacatag

SEQ ID NO: 46592 - DNA, 539 bp, Glycine max
  Peptide Sequence Number=SeqID_138277
aaactgccggaatccgtcgtggtattcactccagagcgatgaaaacgtttcagtttgctcaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgcctttcggtttaccggtgtcattccgctgtatggccgc

SEQ ID NO: 46593 - DNA, 607 bp, Glycine max
  Peptide Sequence Number=SeqID_138278
atgaaggttacagccctcaagcaaaccagccatgacatgattgctcatgtgggtaaggctcgggctgccgtggaagagctgagaaagtttcttgtggctgattcattagaagaagtgaacaggaaactggacaagttttacatggtccttatcctgagaagcttacactcagactttgatcatgttcgtgatcaagtactcgctggggatcaggttccatccatggattctctcatcactaggcttctccgtgtgcctcacttatcgaaggatgaaaatcctactgatagtgtggagacgtcagcaatggttgcatcacgtggtagaggaggcggtcgcaacagcagaggaggccgcaatggaaggggtggacgtcctcattgcacctactgcaagaggatgggtcacacccaagagaattgttattcgttgcatgggtttcctgacaaggttgcacaggtttctagatcagagaaagtagagtctaagttctctgatgaggagtatcaggagtatttgaagctcaaatccgagagacccagcaaccaagctcaatcctcatctgtaccatgtttttcaacagcttgtatctctcaatcaattgaag

SEQ ID NO: 46594 - DNA, 423 bp, Glycine max
  Peptide Sequence Number=SeqID_138279
atgtcaccccttccgatttcttctacaacaggaaccacggccctatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46595 - DNA, 201 bp, Glycine max
  Peptide Sequence Number=SeqID_138280
atgtacaaagataattggacccaaccttggcccatgggctcagaaatctaccctgaggttcatgagaatcctagggccttcttcagcagctctagcccaatcttcttggagcctcttgctcatggatctagtgactggtcccttcctagggaggattgcatcacgaactttattggaaagtgtaccgagtcattaaagtaa

SEQ ID NO: 46596 - DNA, 330 bp, Glycine max
  Peptide Sequence Number=SeqID_138281
atgtctcgggcttcatccttctcagtttctgctttaccgggggacactcaggatttaggggtaatcggtgctgtacaatgtcagaactcaaaccgagcatatcttgggaaagtcccacatcctcgtcctgttcgtcttctgttttattcgtttcttgctcgaagtcgatgggcgggtcccaggtttacattatgcttgtcgcgtaaatgcctgggcgctcctccactcgccaatttcctagttggaaatcaggagggcatggtctaccaaatccgaaccactcggagcatcatcttcgcatattgcaacgacttggccttcgtcccctag

SEQ ID NO: 46597 - DNA, 190 bp, Glycine max
  Peptide Sequence Number=SeqID_138282
atgggaggctgtgggagacccgtgaaggcaacacgaggtgccgatttcggggcaccattcgattcacggctacttctttgggcatccagagaacctcacggagcttcagttggagaccttggggacgtcagtgggggtgctattgcccaaaccaagcttgaccaatcccgacccaacccgggcatagtcg

SEQ ID NO: 46598 - DNA, 267 bp, Glycine max
  Peptide Sequence Number=SeqID_138283
atggtctttccagctgactttgtggtcatggatgtggatgaagaccatgaggttcgcatcattttgggatgcccctttatgttaaccgcaagctatgtagttgacatgggaagaaagaaactggaaatgggttttgaagatcagaggatcaattttgatctatttgaagaaaacaagtctgtaccagatcagaatgtctgcttgcaagtgatggagggtgataaggaggttttgaagttaaaggacaaagtggatatcacccattga

SEQ ID NO: 46599 - DNA, 384 bp, Glycine max
  Peptide Sequence Number=SeqID_138284
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgggaggcaagcagcagcatggtggatttatgacaataagatag

SEQ ID NO: 46600 - DNA, 802 bp, Glycine max
  Peptide Sequence Number=SeqID_138285
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcggcgccgggggcggggcctcgtgtagggcgccccgggattggctgtggggagagggggcggggcctgccgcggagaaaacagccggcgcgccgcgcgagtgcagtctggccccgcagtcgggtcctcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 46601 - DNA, 483 bp, Glycine max
  Peptide Sequence Number=SeqID_138286
atggccccgaggaaacttgcctcaaagagatccaggaaggataaagcggccgaaggaaccagttctgctcccgagtatgacagtcaccgctttaggagcgctgaataccagcagcgcttcgaggccatcaagggatggtcatttctccgggagcgacgcgtccagctcaggaacgacgagtataccgatttccaggaggagatagttcgccggcagtgggcatcactggttacccccatggccaagttcgatccagacatagtcctcgaattttatgccaatgcttggcctacagaggagggcgtgcgagatatgaggtcctgggtgaggggtcagtggatcccgtttgatgcagatgctatcagccagttcctgggataccctttagtgctggaagagggtcaggaggattttgcccggactactgccgggagacgggtgcggatcatgcgcaccaacatgaccaccctgactcagatctag

SEQ ID NO: 46602 - DNA, 168 bp, Glycine max
  Peptide Sequence Number=SeqID_138287
gcaatgcatccacatcctccaactcttctagtgaaaaagatattgcaaatatgtgtttgatggtagactcaatggatgactcctcaaccattgaagaaactgaggagttccaaaaggcaagggactcactatggtacttggatagtggctgctctaagcacatgacgg

SEQ ID NO: 46603 - DNA, 447 bp, Glycine max
  Peptide Sequence Number=SeqID_138288
atggctactccacctgcctcgcctcctcctcctcctcctccagcattagcatcagcgtctctatcaaccttgaagcggacacgcaaagccacacggctacgatccttggccactagaccacctggggcagagagaccagtggtccatgtcgatcttgcgatcgggaaggccgacagtccccacaagaagaaattaagaacacatttggggattgtcactggtgataaggcggaatttgatatccctgaagcttctgatgccaacaaggacagtgtggacgacactgtttgtgaaaaatacggcattagcaaggagaaattggcccagttttgtcagacccgcagaaaccccttgtgggaggatgtgcggaaaaaggcacaggccatccagaagcaaaacatcgcccctcacgtgttgtctcgtgggggttatgaatatttagaatag

SEQ ID NO: 46604 - DNA, 201 bp, Glycine max
  Peptide Sequence Number=SeqID_138289
atgagtgatggattttgcggtactcatttgcagatcatggttaggactagaggattaggtcgtgccttaggtcaggtcactggcagaggtctgggcagaggagatcgtgatgattccgatgatgctccgcagcgtcgacggcctactgcatccgcacagaggcaacgagtcgctgtgactgtggatcacgtcgatgagcta

SEQ ID NO: 46605 - DNA, 1092 bp, Glycine max
  Peptide Sequence Number=SeqID_138290
atggatccctccaggcattgtcgaggcgttatgacacaccaacctctgattgctgaggtgccgaatcagcaacacactttaaccgccatcgtcgaacaggatgcgctacgccgtgcgcggctgctggttgcgcaatctgctgccggcaccgcgcaggaagatcgcgaagcgatggagcagggtattgcgccgctgctcagcgccagctattgccgcacgctggaagcggagccgatgctcgatccggccggcctgcagattctgtgggagcccagcgacgacggtgccgcgctgtggtattacggccagctgctggcggtgatccccggctggagcctgtatcaggacaagcaggtcagcttctcggcgggctgcatcaaagagaaccgtctcaccgcgccgctcggttcggcctccaccaacgattactacgcgcgcgccgaacagcagcgtcatttctggcgtgactggcacgatggccagcagtgggatcgcgtgcagagcgaactgctgcaacgttaccaggcgcagtttggtgagtcggtaaaatattacgccatcgatcagggcaactggccgccgatggcgatttcgcagcactggcataacggcgtgtggtatttcttcacgctcggcatgagtatccggccgatgccgcaggtggattacctgtttgacgagctggcaccgcagtaccggcgtgtagagctggcgatggcggtggatggtgaagtgatgaccgaggccaacgcggtacagatggccagcgcgctggcggagtttgctcatctgccgtgggcgcggctgacgtggattggcgaagggcacacgctggcgtcggaagttgcgccggtcggctttgaaagcttcctgctggccaacgggctggcgggcgaaaacgcgcaactgcggttgccgaagcgcgacggcgatcggccaaatctgctgtgggcgacgccgatcaccgaagccgagcggctgtttgcccaggcggacgatcgcggcggccagcagctgctgcagcgtttgctggcgcagggcagcgatcatgtgttccgtccgcgccaggaagtggtggagtccgcaccgtag

SEQ ID NO: 46606 - DNA, 519 bp, Glycine max
  Peptide Sequence Number=SeqID_138291
atggaaaaaacggctttgccgcggccctctcacttccctgttaagtatcttcctggcatcttccaggaaatctccgccccgttcccttttttctcctgccacatgaagcacttcactgacaccctcatcagtgccaacataagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 46607 - DNA, 189 bp, Glycine max
  Peptide Sequence Number=SeqID_138292
gaagctgggtgtttcggtcttttcctcttatgtggggcgggatatcgccagtcgacgaatgatttgaaaacatggcaaatgtcgacaccaggaagaaacactcaacattccattatgggttttccttatgactcggcggaattcacaatcagacccattgtccaaattatgttcccatcagttcaatga

SEQ ID NO: 46608 - DNA, 687 bp, Glycine max
  Peptide Sequence Number=SeqID_138293
atggcaccgaaaaagctttccgcgaagagatctaggagggacgccgcggctgaagggaccagtgccgcccccgaggacgatgagtacacggattttcaggaagagatagctcgccgacattggacgtcgctggtcactcccatggctaagtttgacccaaatatagtcctggagttttatgctaatgcttggcccacagaagaaggagtgtgggacatgcggtcatgggtgaggggtcagtggattacctttgacgcagatgccctcagccagttcctgggtgacctgctagtgttggaggaaggccaggagtgcgagtttagtcagaggaggaacagggccgatgggttcgacgaggaggccatttcccagctattgtgcacaccggggcaggattttgcccgaatcgctgccaggaggcgggtgcggatcatggcgcaccagcatgaccaccttgacacagatgttgatgcaccgcaggctgcagacgcaccgccaccacctcatcaggctgatcccgctgggtcattaggcattggagcgggccagggtttcgctccttttgcatgccctactccagatcagtttagggttgaggtcgcatggcccagagattggcccgaggcccaggcaggggaggtgcctgcaagagctcccggcgatgcagaggaggcctgcatggattag

SEQ ID NO: 46609 - DNA, 594 bp, Glycine max
  Peptide Sequence Number=SeqID_138294
atgacaagggtgatgagaatcatgaaactggccaaatacaggctaaaggcccaagtggagaaggacaaagcccccaagtggagaacgatgaaggctcaagtggagaaggatgaaggcccagagacagagacactatcaagacaattaattacttatcaaggtaatccttgtggcgtctaccttgacttatcttccttcactggaagtggcgtctacccggacttatcttccttcaccggaagtggcgtctaccctgacttatcttccttcaccggaagtggcgtcatccaaatatccgtagcctgtatcaagcgatccgccccgaacttaagagggaacacgagtggtaaaaggcaagagggaatacattacacaaaagcctatattgagagcatcaaacacgagcgaactaccatcaaagagagaaacacaatgagagaaaagagagaacaagagaaagaaaatagtgaggcaccacaaaggaatatgaaaaagaagagtgatacacccgatgatgcgaacctgagtatgagcggatcgtttgatacaggctacgaaggtttggatgacgccacttccggtgaaggaagataa

SEQ ID NO: 46610 - DNA, 910 bp, Glycine max
  Peptide Sequence Number=SeqID_138295
attgtggggcgggcattcgccgaaccgctgattctgcgcattggccatgcttatcaacaggtcagtgactggcacacgctacggcctgagggctgggcgctggcagacaaagcggttgctatcaccttggcagcattgcaagctggccgaggtggaaggggcattgccgtacaagatggaggagctggtggcatgagccgtaacggtaaacaaggagacagcgaaattacccagagtgaacttgaagaactcagcggaactttgctggtggaccttgctactacccttccgactaaccagtgggggggtggtcgctactgtggtggtaacgctcacgcagtagcgacttttggcagtaccgcgctcgcaggtccctgccggcccgtaatcttcatgggtatgagcggggagcagaagctactgcaccggatcactcaccggcttggcaaagatggccttgagttcgctggtcatcgggaactccagttcgcccagcgaggcgttcaccagcgcgaggaactgcgggtcatccttgcgcaccatgcagctgtagatttcccgcgactgctcttccccgaccaccacccagttgtgcgggtcgcgcgccttggcgcgttcgccgtacagcagcgcatcgtccatgtagaacgccgccgcccgaccggactgcaacatctggaaggcttcgccatggtccttggcgctgatcacgaacatgtccatcttgttatcgacgttatagcttttcaggtaacgttcgttggtggtgccggcggtggttaccacattcttgccgcgcaggtcggcgaagctcttgatcccgctgtccttggccgtcatcagctggaccttgacgtagatgaagccataggaaaacgccacctgtttctgccgctctgcggtgacgccg

SEQ ID NO: 46611 - DNA, 310 bp, Glycine max
  Peptide Sequence Number=SeqID_138296
atctcccacaggcaacctagttcctctggactttgaaattgaagctaccttaagaaggaacagagccgagaggagaaggaagttgttgcaagatagggcaatagcttatattctagaagaagaagctcaatcttctgactcaacatcatctgattcactatcatcaagggaatcagctatatacttaccagaagcctctgtcatggctgatgaagaccagcaaagggttaccttgaggattattctagtagctcagtgccgcaattctttacaagtattgcgcatcctaaagtccaagctcacaacataa

SEQ ID NO: 46612 - DNA, 273 bp, Glycine max
  Peptide Sequence Number=SeqID_138297
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgtag

SEQ ID NO: 46613 - DNA, 372 bp, Glycine max
  Peptide Sequence Number=SeqID_138298
atggttatttctagtttcttgaaaatatctaaaaatctcgccaaatggcattccttctccttcttggaaggtaccacaggatatgatgtggtgattaatttggaatctacagatgtggtgattcatttggcaaatagaattgttgcttaccccgctggtttcatagaggatgtgctcgttcgggttggtgaacttatttttcctgttgatttttatgtccttaatatgtgtcgcaacctacccttcggcgggagtgcgacgcgtgactcacgagagcgtcttccaagaaaggaatacgctcggagtcgccaccaacgtttatttgagaaaaacatcgaaaaaaccggaaaagacgtggtcttcaaactttaa

SEQ ID NO: 46614 - DNA, 264 bp, Glycine max
  Peptide Sequence Number=SeqID_138299
atggtgaaagttggaacctcttacgtgccgatcaacgtctcattgttcgccaagaagttgcagagcgtgcccggtacaacacgaacgacaccgaaagaacgcgcgattatttatcaagcttatcgataccgtcacctcgagctgtccttcctgttcagtatgaaattcggggtggtatccgctcacaattcggcacacaagcataccagccggaagcatcagcgggcaagtgtaagcctggggtgcctaagacgctgcagctaa

SEQ ID NO: 46615 - DNA, 372 bp, Glycine max
  Peptide Sequence Number=SeqID_138300
ctactgacggggtggtgcgtaacggcaaaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttgagacttaaaagtgatattttgcggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 46616 - DNA, 357 bp, Glycine max
  Peptide Sequence Number=SeqID_138301
atgtgtaggtttagaataggtagcaaaatacctttggcaatttacactttgggtgtggtagcaaaatacttggatgtatgtacatgtattagaaataccggaatgtgcacgtgtgcaatttttggtagccaagatgctttgagtatgcatgtagaagaatgtcttgtgcgagtgaatgttcataaggaaaaaatggccccaaggaagcttgcctcaaagaggtccaggaaggccaaggcggctgaaggaactagttccactcctgagtatgacagtcaccgctttaggagcgctgtacaccaacagcgcttcgaggccatcaagggatggtcatttctccgggagcgacgcgtctag

SEQ ID NO: 46617 - DNA, 780 bp, Glycine max
  Peptide Sequence Number=SeqID_138302
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgagcatcctgatgaaaagatttctccattagaggcatattacaaagctgaagcattattaagaaaagcaagtccaaaacttttacaagcaacagaacttgatgtcgcaaggggggcccggtaccagcttttgttccctttagtgagggttaatttcgagcttggcgtaatcatggtcatagctgtttcctcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 46618 - DNA, 545 bp, Glycine max
  Peptide Sequence Number=SeqID_138303
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggagcaactagaactctcctacattgctggtgcttatggtacagtaattgcttatggtgtttgtgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 46619 - DNA, 427 bp, Glycine max
  Peptide Sequence Number=SeqID_138304
atggaaagaacacccagagctcttgcaatgtggatggctgggctaacgctagcattcgctatctccatagcgcttgctcaaaaggttgacctgctttgtgacagatgtggaatggagcctgaatctaccattcatgttttaaagggctgcccctgggcatctggcatttggctactctgcccattagcccttcatactcaacagatgcaggctctcaacttctcagattgggtgaaggagatggggaagtgtcttgatgaagagcagctggaacttatgctagtagttgcatgggctttatggagtgatagaaatttgctgctgttccaggacatacagaactatcctgtggatgtggtgaacaaagcaatcagcttcttcgaagagtataagaaggagaagctaaaaatagtgcaaacacctatag

SEQ ID NO: 46620 - DNA, 423 bp, Glycine max
  Peptide Sequence Number=SeqID_138305
atggagaagaggcccacgaggacgaggagatggccgatttgcttgacttcttgggagggagtggagatacatgactgggagatccccaagattcatggtgagaatgtcaatccttaccctcggaagcaaaaaaagaagagaaggaaaatttccaatcaaaggaaaaaggagaaggaaaatttccaatcaaagaggaagcaaaaaaggagagaaggaaaatttccaatcaaaggaaaaaagagaggaaaggaaattcccaatcaaagagtgggagaaagcaaaaagaaaagaaagaaaattcctaatcaaagaatgggagaaagaaaaaaagagaaggagaagaaggaaagaaagctcctgatcaaggatcgaaagaaaatagaagaaatgtgcagagaggtctttggaccagacaatatctga

SEQ ID NO: 46621 - DNA, 432 bp, Glycine max
  Peptide Sequence Number=SeqID_138306
atgtaccctctcttgttctcagtcaaacccaaggaatgggaagaatcaaaagaattctcagactgtgtcgttttgaattctttgacaagggagaagggagacacagaagaattcaggcggttagtcctttgttcttttggaaaagggagaagagagacacaaaaagaattcagacggttagtccttggcgaattctttttggcaaagggagaagagaatgaaaagatgaatagcacaagttttcaaggtttggaaaaaccagaaaacttcagaaagcttttggtacaaagacgaagaaaaagttcaaagagattcaaggcttgtaaaggattgtatgaaaataagtgttcaagatacttgacatgcaaaacaaagccttgcttttatagactcttcatgtctggtcaagagaaccattcagaagagttataa

SEQ ID NO: 46622 - DNA, 234 bp, Glycine max
  Peptide Sequence Number=SeqID_138307
atggcttccgggactcccgtaatgcttctagtattttcgaagcaggattgcttctggaggaagaaaatcaggtcgcctgggcgagctgagcggcaacctcctccccattttcctataaataggcagaagggggttgttctaagggtccctgattcccctggctatgcatttcagctgttttgggtaaaaaaaattgtttccatgaagaaaatcccagccgaggagctgccgtaa

SEQ ID NO: 46623 - DNA, 87 bp, Glycine max
  Peptide Sequence Number=SeqID_138308
atggagaaaaatgaagaaacaacaatggaagagaagcggaaggcaaagcagaagaggataggggaggcaccatccactagggaataa

SEQ ID NO: 46624 - DNA, 271 bp, Glycine max
  Peptide Sequence Number=SeqID_138309
ggccttctcttgcatctctggcccaatctacttggagtcttctatccaatacccttgcggggtaggattgcatcacggtatctacagcacttggttcgccagcaggcggccaaccaccgggggcagggctgaggtcgcatggcccagagattggcccgaggcccaggaaggggaggcgcctgcagaggcttccggcgatgcagaggaggcccgcatagatgaggagatgatggatttgctcaatttcttgggagggagcagagccacatga

SEQ ID NO: 46625 - DNA, 366 bp, Glycine max
  Peptide Sequence Number=SeqID_138310
atggacacctatgttagtcctttgaccgctcaaatcactgagatagaggtcaccaaacctactttattcgaggttgcactagaacgatcaccaccaatctgtgcttcttcctcgtctatcagtgtagttttcaaaagcaaaggtgaaaggaaagatattgagctggtagaggaggaacaagcacggattggtgctgatccttctagtgggacctccaataaatctgagaattataaggaggaagcatggaagaaaacacagaagcataaaccaaagagggtggagagtgtcaacgctgatgcagaagcctttggtgatgactcgaaaattgtgattgctctatgcattgtgaagctgaagcagtag

SEQ ID NO: 46626 - DNA, 339 bp, Glycine max
  Peptide Sequence Number=SeqID_138311
atgactcttttagctgaggaagaggatagaattattgaggcacacgaagaagctcctccttcgcttccacaatttgaacgtcaacgttcacctaagagccatctcaaatgtcccccatgtatccgtacccatatcaaagcggaatttgatcagatgcatatttcatgggaatgcaacctccactacaaccaggatatgttacggttgacttatttggatctccttctcttgcgggaaccccttcatttacacatggttgtcagatatcaacacctaacgccccaatgggtcctccatggaatgtgtcgggaaacattcctaacattactaatttattag

SEQ ID NO: 46627 - DNA, 231 bp, Glycine max
  Peptide Sequence Number=SeqID_138312
atgcccgtgccgtctcttcaacacccgcgtgggtcaaacccccgcagacacctcatggtacccatcagaacgcgcaacatcacccgagcttctcggcttataccgggaatgatgcaatcctaccccgcaagggcattggctagaagactccaagtagattgggctagagatccaaggaaaggccctagggttctcatgagccttagggtagatttcgagcccatgggctaa

SEQ ID NO: 46628 - DNA, 294 bp, Glycine max
  Peptide Sequence Number=SeqID_138313
atgtatcagtatccttttgaaggtcatcacactgatacttctgcgagcgaacattcgttcggtggtgttatagaaatacaacctcatttttcatggcccactatgactcattcacaacaacacgatgccccaatggcaacacctaacgcctcatttgctccgcaatggaatgtacctggaacaatacctgatatgggggacttattaggtgttgatttgcgtcaggagttttctgctaaggctgagcaagtagaagcggggagacatcgcggcagaagaaatcctgatcgttaa
